United States Patent 9,328,346 (POLYCOMB-ASSOCIATED NON-CODING RNAS) - sequence listing, part 74

SEQ ID NO: 13882 - RNA, 46929 nt, Homo sapiens
acaaacuguaaaaacaaugcuguuuuucuauauggcauuucaguuuuuagguuaaaaaaaacaaaacaaaacccuauuuauacucaaaacuuggauaaaagcuacaauuccaagucucauuuucccuuaaccccagccacccaaacacuacucauuucauaaaugaauacuauuuaguacuguacaguagauacauauugacagcuucuauacuacuccagaaaggcaaauaucuguauuucaccgaaaauauaaauuugcuagauauaggugggauuuguuuauacuaaaguucauugcuuuauccaaccccauucccacacaaaaaauaagcaauaaaaugauacuaagcuaagaaaaggacuauuuuggauagaaauuaaaucauuuuugacaauuuugauggcaauuaucacuacagugauagacuuccucuuuuuacuauacugaaauauguggacagaaagggaaagaauuuguaaaaugaaugagguaaaugucauacauucaguagcguaaauaaauacaaauacgguuuuacaggaacaugaacauaaguuuaaggguuuuauuaucaaagucuuguaaaacaauuucagaaacuguacaucaacauggcacagacuguagccuacuuuuguuucuacugcacaaaagugaagcuugaaacuucuguaacuaagaaaacaguugccuacuuugcauauauaacaugaaaucaccgugugcauaagauuacuacugcaguaacacaaauuuauugguuuuauacaacuugagaucaaauaaagguacauuaucaaguagauuugucuuauuuuaaaagcguaugaaggucaauuuaaaaugcacuaccccuuuuuuccaacacggagcuuaaaacaaauuaaugaaagaguggaaaauucaaaauaagggcaagagauaagguuuuuuucuuuuuuuccuuuaagauagacucaggauagguagauagcuuucacugauguagauguggaauaaauuauuacuucaggaaaaaaauucccaaacaucuuaugaaaaaguauacaacucuacuucaaaauaugcuauuuacucacugccaaagacaguuuuauuugaaaucuuguuucuguauuuaaacccuaauuagccaccaaaaaagguuagugcauaauaaccuuucaaaguuaaacaaaagccacaaaaauuuugccacaaggcuuaaaggauuaucuauuucaaaugcucauuuccagauguaacuauaagaauguuaauuugucaugucaacaaacaagaccauaaguagauccaucauguuggaggauuuuaaugacauuuaggauauucuugccacaauaacaugcaaucagugcauuuccuacauggcucuauuacggcaaugaaucaaauuauagaaauacuauaagugaacuuacuuaauaaaggauaucauacgacauaaacaauccaugccugcuguagaugcaugcagcuuuucauuuuuguuaugaagcagcaccagaauaguaaaacugcuugguuacucaaucagauuucaccaugacaagaauugguuaccucguaccauuuucuaaaagcuuuuugauguaaauaacuaauaugaguaacaggagcuuuauaaccauuuauaacucagagcuguauacaucuagguuugagaugaacaaauacagcauuaagaaaucacacaaaggaaugacacugaugcagguauacaguuggacucccucagaggcaauauucagucacucauauccaugucuucuucaugaugaucauccccauucacuuuggauucucuuagugaaucaccaguucccuuuuccacagaacauuccuuuguuuuaggggaaccuguuucuauugguuucuucucuucuuuuuucucuuucucacugucauaccccuguuccucuucaucauaaucccguguaaccugcuuugccaaggagaauaauaaaaguaaacuucuccaaagaaaaauaacuucugaaaguaccaacaucaccccaaauauaaaaauaaaucaauuuguaaacauacuuuuacaucuuuaucacucucugauuuucuuucccgguccuuuuccuuaucuuuacucuucuucuucuugcuuguugaucguucucuuucaucccuacuucuuucuuugucuuuaucuuucuucuucuccuuuuuaugucuagaaugacaguaaaauguacagcaacagguuuaacuuguuuagaugaugagccugacucaauuucacaggauauaaguaguacagcaaagauccaacuucaaaaccuuggagaaguaacacaggcuacaaaacuaacuuguuuauaggacuaaaauguucaguccuuaaugguguuuaagucacaagucagaaggagaauacauuaaaacauucuuaagaacuguaacugcugaaaagaaaaacuacaggacaguuuuaaaaugaaaaaccucugaaaaauauaaaaaauacauuuaaaugauuaacauucuuaccuccuaggggauggugagcgggacaauuuucuuuuaggagaccgaggcuuuuuaggagaucuugugccacuccugcuucuucgucgucgucucucucuagaaucacaaaugugcaaacuagguuuuaaaauacagugugaucuuaaaaaugcagacacaucauagaugauucuaacaaugaaagauguggccagauguaguggcucaugccuauaaucccagcacuuuggcaggcugaggugaggggauugcuugagcccaggaguuccagaccagccugggcaacauggugaaacucugucucuacaaaaaauacaaaaaaauuagccaggugugguggugcaugccuguagucccagcuacucaggaggcagaggcaggaagaucacuugagccugcggagguugaagcuggagugaguugugauagggccacugcacuccagccugggcaacagagagagacccugucucaaaaaaacagaaaaaugaaagauuguuucacaauacugguauaagcuaaacaauuaaaugaguaauauaaucaucugcaaaccaugaaucuuucccuuuacuacccucaagaaaacuccuaauuucuaguaauucuuuuaauugaugacaaaauguuagaaauacuaagcuugagaaaaaacugauuuaacaaaacuaaugcgagaggggugacgugugaaguaaacuauuacugaagaaguuaguuuuugguucaaacauucaguguucagaguaaguacagaauaauucaauaaugugauauagaagguaguuacuaauaaaauauccccacauucaccuuuaaaucauuagaugaaauucagagaacuaguuaguggaaagguagaaaccuuauacucuagcaaaaucgcccuccugcagucccccaaaacccugcuuucaccaauuacuuugaagauauacagcugauauacagccuuccccuccuuuuuacuguaacuuaaaaaaaaaaauucuguuccugauucucaaaaguuaucagacuuaaaaaacccuguacuuaguugucuaauuuccaaaugaagcuuuuuuucuacuuacacagcccucugugacccuuguccuggaaacguuacacauaacugagcauucacuuaucaaacauugucacgacugugcaccuuauacuuuuugcuacugucuuauguaacugaaacuccaaauucucuagacggaagaaguauuuuauauuacauuuccguguccuucaacagacuguagcacaacuacaaacacaguggguauuuaauaacucacagaagaugccuuaauuuagagugauccaauaauacagcaugagaaggcacuuacaaguacauuauauaaagcaacagguaaaaaaaaaaauccucaacaguuuuuaagguaagaaaauauauguaguaccuuccaucuuuucuaucucuuugccaccuaucccucaggccugauucagcauuuccuucuguacuuacauuugguuucauuuucaugcuuaaaaauuuaguuuuuaagaaaauuuucaccaccccaaaaacucccuacccuuuaguuaucacucuaauccucccuaucuccccagcaaucaguaaucuacuugguaucuuuauagauuugccuauucugggcauuucauauaaaaggaaucacgcaauacacggccuuucauggauguuugcaaguuucauccauacuguagcauguaucaaccuuauuuaucacugaaaaauauucaauuguauagauauaccauucuguuuauccauuuguuaauggauaguuaacuuuuuggcuauuaugaaauaaugccacaaacauucacauaaaaguuuuucugugaaaauguuuucauuuucccccagggguacaacuggugggucaaaaaccucuauguuuaacauuuuuaggaaaugccagacuguuuucuaaaacaccuguaccaguuuauauucauacuagcaaugcacaggguucuaauuucuccacauccuaaucaacacuuacuaucaucugucaggcucagcuaucaucugucuuuuugauuuauaaccauccuagugacugugacauaucucacuguggucugguuuguauuuccuuggugacuaaugauguugaacagauuuuauguacuuacuagauauuugcauaucuccuuuggaguaauggcuacagauucuuugccauuuuuaaauuggguugccugucuauugcugaguucuaagaguucuuaauagagaauauauaaagaauuuucuaacuagcacucuagguuuuuacuuucuugauaguauccuuugaaauacaaauguuuuaacuuuuggugaauuccaaaauuuucuuuucuucuguugcuuaugcuuuugaagucauaucuaggaaaccaccaagcucauggucuuaaagauucacuuuuguuucuuucuaaagguuuuauaguuuuggcucuuacauuuaggucuuuuauacauuucaguuauuuuuuuuuauauggcaugaaccuucuccuagugaauuuaaguaauguugaugaauaaaacaagcacugcagcaaaacaugugaaugagaucugaaaaauggaaugaaguccagcccuuacuaucauauaaaucccaaauuaaguaugaaaaugugcuuuuugugcaguaaggucugcaacauuucaauuuucacugacagcuuaaagauagaauuagucuaagaaugacacaaaccagaaccugcauugcuucccauuaauucaacagucauuaaaagggauagaaaaauucucaaguacuaacaugcagaugauaaauauagcuuacuauaauaagcuuacuuaauggaacaauucaguaugguuuagccauuaaaacuuaaacuauaaagagaaaaacucaccucucuugaauuccauguuacuucaaauauacucuagaccauaaaauauuaaguaaaaagaaaaauaaacuacauuauucuucacaaauugccuuuuaaaaacuuuaaauaacagcaaaauguaacuuuuuucaacacugaaauacuuauguucuggaaaagacuucauacugacagcguacugauacuguuagaagcaaaguuaaaaaaauaauugccaagaauucacaaugccaccuuaccugcuugcacuucuagaacgucuggcugugcuguaacuuuuuggugguguuuuagaacguuucuuuucuuugucuucuuucuuuuugucucuaacaaaugaacacaauuuaugaaugcauuagaagacucagcugaugccaauuuauauagcacuacaaacacaaaaauauaaucagaucuaaucccauccuuaaaagcauaaauguuguucugacagaaacuguuuuaaaaauaauacuuuauguggcauauuugaaguacaauaacuucuuuuaaaauccuauuauccuagguuuucucccaaguagacuaaaguagacuaugggugagaaaauaacuaggauguuggcuugaaauauacuugguaaacaccaauaaguuaacuaucucuaggcuccucaagacuccuuuuucucucagcugauuaccacuuucccaacccaccucuccuaucaggccaaaacccauagagcacuaccaaaauccaucaauaucaugaauauucuuccaagacacacaucccaugucaaccucuaucauggaucaagcaagcuucuuuuucugcggcuauuaugaacuauucagggcuuauuagaaaauaucaacagauuuugacuacagccguaacucaauuuuuuuuuuuuacagauuccuauaaauuuuuacuccucacaauauuuuuuccccaagaucaucauucuccccaagacucuaagcaaagaguagauaaacgauauauauuuguugaaugagaagucucauaacaaccccccucuuuaacuauucucuaauuuuaagaaucaaaguaucccucucuuacuguucuaagcuaaucuuuccauucugcauucucaauuucauuuuuuucccuucucuggucauccucgguucccucuucauucaaucuuuaucauugguucccucuucauuugaaucuuuaucaucuaacuccuagauuacuagaacaguccccuaguaggucccagucaugccuuccauaaacugauucuguacucugucagaaaucuuuuaaaguacaaaccugaaaauauuaauucccuguucaccauuuucaacucauuccaguugccuccuggaucaagugcauagugugaacaacaaagccuuccacgaucggucucauuauauuuuucugaccucauuuucuaguccaacuacaucaaaauauuguuauuucaagaaacaccauucuccaccugaaagcaugccucccguugagucuagucaaaucuuucagaauuuaauacucgagucauucucaaaccucuuccaauaucagcaaguagcaaucaucauuuaacaguuccuccccuguaauuaaauccaucacucuucuccuaguaaucagaaaguccuuaaagaaaugcuuaauuccuuuguauaacuguucuauuaaucuaccuuguuugauucacucugcagcacauaaggacuaaaagccccauuauuacagguuuaacaaugauaguaaagcuacccccacucuucuguucucaucaguugaguuuuaugcuucccaagaguaaguuauguuguguccccagcuguacuuacuuuaaugacaugauuuaacuaaauauauaaaugaacaaaauaaugccaaauauagaguugcuucuagaaaauuaagauaaauauuuuagcaagagauaaaaagcaguugcuaaaaaaauuaagugcugugaaauuguaugccucacaacuauaaaugacugggggcauacuaauuuaaaaguguuugguucuacacgaaaagacugguuuuugaauauauuuuuagauggaaauaaaacguuacgguauuucuuaugaaagaagguagcaggacagcuaacaauuccuacuacuaagaaauuuuacuuaggcccucagcuguaagcugaaguuucaguuuacaaggaagcaccagaaagcaaacgucagccuccucaaacucaaauauugacaguuucuuccccugucuagcccuauuucucugccccgcaccccaaccaccucuuuuguuacuaaguagcacaguacuagggguacugggaacccuaaaauuugcuuucucacccaaugcuauaccuuguuuuugaugugcuccuugaccuucuaccucuuucucuggaaugagaucuucuccgccuugggcuuuuggaucgucgccgacuccuagacuuagaaugugaccgccgucucgaucugcuucuugaccgccuaauaguguaaaaggaagccaauacauguguauaaauguaaaaagacuauaaauuuugugcuuaguaucagacaaaagauucggacauauggacuaaacaauuaaaugggggauaauucccuuccauuugcuauuauuuagcccauagaacaaacaccuucaacaccuuagaaauuaguaauaccuuuuaacacuuggaauuccucaccuuuuaaugauuugcucaaccugucagauagguccuucuaugcccacuguacuuacaacuccaagguuaaaaauacuacuagaucaugaaggagaauaaaaguaugacuuauuugcaucaucuuauacaauuauauagcauuuuagcauguauuucuuauuugauuccucauuagugcagcuuaaaccuuccucaucauaaaucaaauacuuauaucacgcuauauauaaacuacaaauuggucucguaaguccauaaaguaaaugccacuauuauuucuauuuuauaaagagaaacuacuuauuguguugccaucuccuauuucgaauuuuucucugaaacaaauuccacuccuuuaauccacaauuuaggaaacuccaggcaaugcagaccuuuuacagauauauacaauuuguauaaacugccucuuuuacucucauuuuucccugacauaucuguuucucuacucccugcaccgagcccccauccauuguguccugaccuggcucuuccaggacuaagaagcacaauuaaccuuuagauguugucauccucccuacugcauuaaaacucauucuccucuaucuuuuaagcgaugggguuuugccauguugcccaggauggucuugaacuccugggcucaagccaccagcccaccuuggccucccagaguugggauuauaggcauuaaccaccacaaccggcccauucucuucuauuuuaaaaauuaaaaauaaguugcaauccuuugcuuagucuugaucacuuaacuuuuagugaccauucaacuucucucugugcaacauuucaaauauagucuaaauuuucugccuacuuuucuuuucaagguacaagaaagaguauggacaucuuaaagacuuguguuaaacucucauuuauaagccagguaacuuaagaguauuaucuaaccucucugaccuuguuacuucagcagucaaggauaguaacaccucuaucaccaaauaaugacaaagauuaaaugcaguauauagagucuagcucggugccuuaguguaggcacacacaagugacccuugaauaacaugagcuuuaacggcaugguuccaccuacacacuguguuuuuuuuuuuuuuuuuuuuuuuuuuuuuuuuuuuuugccaccaaccaaauguggauuaaaaacaguauuugaaggaugaggaacccauguauagucaggacugaguuuuccuauauguggauuccagaggacuugaguaugcauggauucugguauagauggauuuguaaccaauccccugcauauacggaggggacuguacauuaaauauugauguccuucuuuccucuuacugauguacuaauauagcuucuguugccauaacucccuaaaacaacugccucaaaacccauaguaaugccucaauaaacuauuugaguuauugaacucaauuaacuuuaauuuuaaucucuuauuuucagccauauuugaaacuauuuacuaaacaauuccuugcaauaacaucuccacauccuaagauguuuuuaucuacuuaacuacccuaccauaggcuccacaaagacaugggaaguaagucuuuucaugacuguauucuugagcaauuacuacacugccugauuuaaauaaaaggcaccaauaauauacuuugaaugaaauauaggcauauaaaauaucagaaucauaaccuuaagagauuaaacaguuguuuucaaaggggaauguacuaccgucacuuuucuacacuuacuaguucauaugagcuuuuaaccagcaaaagagauuaguguaacauauuuuuaauaaagucaaaaagcuugugaaagucauggucauuuaacacacuaugugaugcuugauacuacaacugggcuggacucaguggcuuguaucugucaccccagcacuuugggaggccgaggugggcaaacagcucgagcucaggaguucgagaccagccugggcaacauggcaaaacccugucucuacauaaaaaaaaaaggugcaaaaauuagccaggugugguggugcaugccuguagucccagcugcucaggaggcugaggugggaggauggcuugagccugguggggguguggggugugggggguguguguguguggugaggguuaccacaacccacaacaaugauuucuguuacgauguauuacaaguaucuggauucagggacauauuucacuucuacuuuucacuggucauaguaaaguaauuaauauuaaaaugagagagucccaguaagauuuaauauaaagaaaaagacacaggcucucccuuuuuuuuuuuuuuuuaagacggagucucgcugucaccaagcuggagugcaguggcgccauccuggcucacugcaauccccgccuccgggguucaagcgauucuccugcuucagccuccugaguagcugggauuacagcugcgcgcgccaccacacccagcugauuuuuguguuuuuaggagagacgggguuucacuauguuggccaggcuggucucaaucuccugaccuugugauccuccgccucggccuccccaagugcugggacuacaggcgugagccaccccacccggcccaggcucuccuuuuuccuaagaguuugguaaaaggaaacacauauaaauuguaguaaucaugagguauauccuauugcagagguuaaacuaaacuaugagagcacugucauggaagauuaagacugcaagcauuguaucuugaagaaagaaaaaggaguuccucaaagcggaaauggaagauguggaaaagcauuaggcagaaaggaucaugagcagaaacaugaagacauaaagaaaaugguauguugaggcaauuaguccuguaacuuuuggaguggcaaaugacacguguaaaaagauaaaccagacggaauaguaaagaacccugaaagccauucuaagguuuuauguaucaccuuaucaaggcaauaaggaacuucucaguaucugugacaugaucuguauuuggguuucugaaagacaacucuaagaauaagacagugggauaaggugggugacagggaauaaacagacauagcauacaggauaaccccuguaauacuucaagaaaugacuuaaaauaagaaaaugauauuaaaagauaaaaacagagugaaaagaucaucucugagacagaaaugugacuuuuuagauauuuuaugauauaagugcuuuuaauagagacgugacaaagucuaggauucaagucacacugcucuuucaaaaauccugacaauaaauaggagaaaugguuuuaucuaacccuugguaaaaacuaagggguaacggacacuaagaaaaggcagacaacugacagaacuagguuccagaagagaugaagccaggagugaagguuuaagagucaaguggugaauggccgggcaugguggcucacaccuguaaucccagcacuuugggaggccaagguggguggaucaccugaggucgcggguuugagaugagccugaccaacauggaaaaacccagucucuacuaaaaauacaaaaucagccaggcaugguggcacacaccuguaaucccagcuauucgggaggcugaggcagaauugcuugaacucaggaggcggaaguuguggugagccaagaucgugccauugcacuccaggcugggcaacaagagugagacuccgucucaaaaaaaaaaaaaaaaaaaaaaguccagugauggagggguauguaaagugaagcugaaacuggcugaaguaaauaaccacaacuggaauauccuaguucugaaugucaauccuaaaggguucugacuagaagaacuaggaugcaacuaggccaauuaggauugaguuuggaaauuaagaaaaucgaagaauggcugaaauaguuggugaauaaccuagagcaauggcuuuuauauugucguuugcacaacuguggaugcucuaagacccuuuuaugggguccauaaggucaaaauuauuuucaaaguaauaacaaauuauugccuuuuccacuguguugacguuugcaccaaugucacaaaagccauaguggguaaaaauacugacucuucaacacaaaucaagguaggggcuauugaacugcccuaggagucacucacuaucuucuucacuggcauuucuguaugcacuugcaguaaaagaaaaaaauaaugccacuuuuauaaagaugucuuugaugaagcaguaaaguuaauuuuauuaaaucccccuucaguacuauuaauauaguagcagaauuaaaucuagucucuugaguaauauucugugugaugaaauggaaaguaugcauaaaucacuucugaugcuuaugaaguauaauggcuguauuaaggaagacaccuguguugaguuaugagcugaacuaacugcuuuuucauuaucaccuuugagaaucuagaaacuaugauuaauuagacuuggguauuuggcagacaauuuuuugaaaaauaaaugaagucuauuauauaaggaaaauagaugaaucuguugccaaugauaaaaaucugagaaaauuaaauuuuggaaaaugacuccauuguugugagcaugccagauuccuaguacuugcauuuuacugaucugaucuaaggugauauuaccagaugucacuuuuugacacuagauaacaaauacaagucaguauuuggaaacuuguauaauucaaugaaucaauuauuuuucauuuuguugcucuaguuccaaugcuuuccuaccaccucugaauuuuuggggguuuuaaagcauaaaucaucuauuucgucugucgcuuuucuuacuuuuuacaugugugaacagucauucacacauucuaacagcagagguuacuaaaacacuuuaaccagaggauaacagauuaacagcaaauuaaaaaagaugugacauauauaaauuaucuuugucuaagguauaauugacuaaaaagcaaucuaaccugugucuagaagaugagggaguccuccuccuccuagaacgugaucuugaucuugaaugccuucuuuuuucuucuuucuuaucuauauuuaaaagaaaaggaaccugcauuuagaaguuauuaaauaggggccagacgcaguggcucaugccuguaaucacagcacuaugagaggcugaagugggagcaacacuucaguccaggaguucaagaccagccugggcaauauagugaggccucaucucuacaaaaaauacaaaaauuagcugggcauggcggugugugccuguggucccagguacuuggggaggcugagcugggaggauugcuugagccuggagauggacggugcagugagcugugauugcaccacugcacuccagccucggcaacagagugagaccccucaaaaacaaaaacaagcaaacaaaaaaacacaucaaauaggaagauuauucccuuucagaaguuauucuaauaauuuuucaccuuaguuuucagcuuuuacauacaacccuugaaugucacaaguaaccauuuuauaaucacgauuuugaagcuuacugaaauacuauaaauugcaaaucauccaagcuuuugguagauccaaauuagacuucuaauucucagcuagcuaaagguuccuuugccuauuuuacuugccagacuuaagaggcugugaaguguuuucuguaaagcagucuauaaagaggguaaauuucucauucucuggcucugauuuacucuugacaagguucuaaaugagggguccccuuuccuuuccuugauucuucacagacucaauauuuggcccccaaaugcagaaagucaugauucacucacugauuuuaguccacuucugugacagaaucagauuuuaguaagcuagcucgcuuccuauuaucugcucaucacuccucuucccuaccaauuuucaauuguguaaauauagaaaggaaaucuagaacuacacauaagaaauuccuuaacuggggacauaacaagagaaauaaagucauuguauucuacauucacugacuaucaucaaagugagauugaguuucuuuuacauuuaagucauuucauuaauaggguucaauuuauugugaaugucauuauaauaaauucauaaaaauauugguaaaaacaucaguucauaaagaaacuacauucagucacuuuaaucauauauuuucaauauaaacagcaguuagaacacggugugucauaaacuuuacauacacccggcugugcuaucuaaaaguuccuacugcuugccauguaacuguggcuaauuauuugacauuuuccugguuaaauaacauaauacauauaaagcauuugguaucaguuuauccacuauuauacuuuaaaauuauuuuccuaacaauaggcacauuaaaaaacauucccauuuauuaaugaacaagauauuuauaagaaagaaaauccagggccauagaucuaaauauauaugggcagauaauaugauaucuauucauuuacucucaaaaagacaaucugcaaagaagacaacuaauuuucuuuaaagaaauaucauuuuaaacagaagcauuuucacuagguucucuugaucaaugaaaaaaauuaaaauuaggcuaucccaacuuagaaaaacauaaauaauaagaaaaacaaaauaucguuucaaguauuagauaauccuacugacauuuuggacuagauuaaccacugcuguggaaggcugugcuguuuguugcaggauaucuagcaacauguugguccuuugcccucuagaugcaguugguacuccugugaccaccagaauugucuccaaauacgucugaguggcacuccacuauacaaucuuuuaucagaguuuacaacauuuuaaacgacuagggugucacucaacacaauuccacauuuaugucaaaaucauuuuugcuaagaaucacacaacaaaauugcauaaacauuguuuaccugguucuauagcagcagaaauuagggacugugcuucucguacucuuuucauagcuuccucuauuucuuuacuagagguauccgauuucagacuuggugaaacgagaccagcagcuacaugauucaaccugaaacagaaccaagaaaugggaucugaaauauuuuaaaaugcacacgagcauuucaaauaaauacuuaaguauauaacauuauuuuagcaaaauauuccuucaaaaaaagggaggggaggacuccaugauaacuuugguaaacaacauauagcauagcacuguuuugaauauuuacaaguauuuguuuuaaugacuaagagucaucuggaauuagaaaaauaccuauuuugcugaacauccauuaacuuuccauaaacaaacacauuuuuagaaaugccaguacaagaaaauaugcugaugcuaagaacuuuuauucauauaaauuaaaaauuuuugggccggugugguggcucacgccuguaaucccagccccuugggaggccaaggcagguggaucacgaggucaggagaucgagaucauacuggcuaacacggugaaaucccaucucuacucaaaauacaaaaaacuagccaggcaugguggcaggcgccuguagucccagcuauucgggaggcugagacagcagaauugcuugaacccgggaggcagacaucgcgccacugcacuccagccugggcgacagagugagauuucgucucaaaaaaaaaaaaaaaaaaaaaaaaaaaaauuuaugacauaguaauuuuuuggggaagagcauuaccuuuuacuuuguagguggggaggaacugaggcagaggccaaaggccuaccaaaauuacacaugaagucuugaguggaaaggcuaaagaugccccuuacagguuuacacauguaaaaaaaaaauuguaggccgggcaugguggcucaugccuguaagcccagcacuuugggaagccuuggcggguggaucaugaggucaggagauugaggccauccuggcuaacacggugaaaccccgucucuacuaaaaguacaaaaaauuagccggaugugguggcuugugcccauagucccagcuacuugggaggcuaaggcaaaagaauugcuugaaucugggaggcggagguugcagugagcugaguuugcgccacugcacuccagguugggcaacagagugagacucgucucaaaaaaaaaaaaaaaaagaaaaagaaagaagaaagaaaaaaaaauuauagacaacaaauuuaguaguuauuugugggcagaacaggaaauguaauaaauaauggguauauaggaagcuucaacuguauugguauuauuuuauuuuauaagcugggugauggguacaugcuugguuuuauuuuuagauaauuucuaagaaaaaaguccacuaacuacugaaguccaacgauucuguccuuuucaugcucucucacuuacugauagugacuuucaccaaguuaaggggaaaagguauaaaguucaaauuuauuaugccaacaaauaaccagugaaaaaaacugaugaaucugucacaucaucaagucggaaacaauuucugugacagcaugaagagcacuuaucaaaagcaccuaaaauaaaauguuggcuauuaauuauauaauauguaauacuacuuugcucugggauagugauucccucagcuuugccucuaacuccuacuauccucaggacucagccucugaucuucaaacgaaguugucccuuauuagcucuuuugcuaucauccagguauaagucauuuacaauuacuauucaagacucaaaugacacugaaacaaaauaguuuagaggaccuuacuuacuucuguauuucucuccuuguuucuagguaacaauacauauugcuugucuugagaaaagauaacuugauaacuuucuuauaagcuaucaaaaaaacucuaauucuguagacauucagauaccacaucaccaaugaaaacaaagaaaaaacgcuuacuugggaucaacaguacucauaagcuucagcaacugaucugcagcaagagacuguaaaaauaaaacauaagaauaaugagaauacauaaaacaauaaaugaccgauauuuucuaggcagaaaacugaacaacagaaauccaugcagacuacaugccaugaaacauaaauuuuuuaguagccacauuaaaaaagaaaaaacaaaaacaaaaaacaaaacaaaacaaaacaaaaaccggugacaucaguagcuacaguauuggauagagcagcuuuagcaaguuaucuaaagauuaugaggcugaacagucuagguauuauagaauuaugucuccuuuaagacuuuuugacauaaagaaacauguaaaacucaaaacaccuuagccaauauaaugcaaaagaccucuacaaagaacuucagaaaaaaagguuagcuaaauuaaaauaaaagaaaaauuuccaugauagaaaaauuauaaaccacauucuuaucuuuucaugacuauuuacucugacucuaugacacacugauaauguacuggcuucuugugaaucuauuuucuauuuugaacuauauaaaagaaauccauuaauggauaaaggaguuagucauucagugacuguuuaaagcucugacaaguuuaaacaagaaaaaaaauuacuacaacauagccauuagcuucugcucuugaaaugcaaaccaacaguuaaugaaacagaucuucuguaaaaaugggugaaaaauuugaaguuacuaagguauaccugagaguucaaguuugcuccaggaagcccaagugcagcaagggcaggaucaagaguaggagcccccaaagcagccaguggaacagcgccaaucugugaaauggcaaauuuuauuuauuuaaaacuucauuucaguuccuuauaccagggguuaauacuuuuuuaauguaaagggucagauaacaacuugaguuuucaggcuacauggucuccguacaacuccucaguuguacacaaaccauauaacuacugccaucauagcuugaaagcagccagagacgauaccuaaacaaauggcugugguccaauaacaaucuauuaacagaaauaggagucuugcucuauaugacacccauguuccacccauuacaacacauuuccccccuaaauccuagauuaagaaaaaaagacaaaauauuucaacauauucuugugcugauuuuaauuauuuauugcuucucaggauccaaaucuacuauucuuugcccugcuguuuugugcuaccggaggcaggaccuuuacaaagcauuucuccuuugacaguugccaugauauaagacuucauuuggaaagagugcuggaaggacacugacuaagaaaggggcucuuccugguugcuguguccccuuucugauuauuccugcagcaccaugucaaacacccaguagcccucgccucucaguaaguuuuaauaccaacuccuuaugcagcuccccagggcacccaagagaacuuauuuacuagucacccuuccaaaaacaaaucuaaguuucagcauagauggggaaagaggaguccccugaacuaaauggguguuccuucugcuucagccucagagguagugguuguuucuuauacuugugauuccuguauucauuagaguuccccuaguaaucuccuauaacuaguuaguaauuccuuaaauguucccuguucaaaucacugcaggguucugccaccugcuugacaccaauucugauuaauccauaauguaauagacacaaaccaugaaagugaggcuacuuuaaaaccaucuguagcuuuugaaacagccucacuuucuccaccugugcuacaaguucuccuuguuucaauuuauuuaguaaacacaaacuaucaaacuuucuauaauuuaacuguuuauucguaacaggcaaaaugcuguguuaauacuauuuuaacuuacuguccaacauagcuauugcauagcuuuauacauuaaaggaauuuagaaaauuacccagaucuggacugggcgcgguggcucacgccuguaaucccagcacuuugggaggccaaggugggcagaucacuugaggccaagaguucaagaccagccuggccaacauggugaaaccccaucccuacuaaaaauacaaaaauuagucaggcaugguggcaugccuguaguccuagcuauucgggaggcuggggcagaaucgcuugaaccagggagguggagacugcggugagccgagacugugcuauugcacuccggccugggugacagggcgagacucuguccaucucaaaaaaacaaaaacaaacaaaacaaaaaacaaacaaaaaaaaacaaaacaaaacagaacaaagaauaaagaaaauuacucagauccucauuuuauagguuaaaagaaauaaccuaggaguuaagugauaaaagucacaccuaaaaagcuuaggaacuccuaaucuuucauucuauagugcacuucacaguuaagagucaauuagucaauuauuuagacaggcaaaaugauacacuagaaagaaugcuuuuauaaauuuccaguugaggcucauucacuacaaucuuugaaacuacugaccaguuacaaucucaguaauuagaauacacaguauuuaaagugccuuuuaguucuaaaauaagcuucguacagcacugucaguguuagaaacacuauugcaaccaauuuucuuucacauucccauaucaaacaucuccaucaagaauugccuuuguuuucaagccaccuauguaauucaaaaccccccaaauaacaggaaaagauaaaggggaaggaaaaaaaaaugaagggcucacuugugaaauuuuaacuucaguuuucuuuccugguccaaaugaauauauuuuuaacaguguguucagagaaguguucaugccucaggagacuguuccaaaacuacucauggguuauuuugagagccaaugguaaaagugacagaacagauauuuuaugauuuuucagaauguucuuaaaauacaaaagucuaagagaucuucuauacuauuugugauuuugauauagacaugugauaaugcuaucugaacuagaaucuuaugaguacuuacaaaguucaaauauguuuagcuuuaugcacaauucuguuuuuuuccccacccuuuaagaauucaauagaacuaguaccuggguaaguggguuaggaguaggcaggaguccaccaccaggcagaagaccugccacugcauuagcuggugccaacagagacaaagcuuuagcuucaucaggaauaacuccugcagagaaacauccuugcauuagaacacauucuuuucuaagacagaaaacacacaaaaacacccagaaaaugucucccugauacaccaccugaguuuguugaaaguacuuauguucgcuaaaauacaaagcuugauuucuaugauuauuuaucauuaauuuuaugucagaaugaacuucaaugugugaaaauuuguuuccuuuuucucuacaaaugguuaaguuucuagaguaaaaaaaaauagcacaauacacacuacuuuuuuguuaacacugccaagauuucaucaccuguacucgauuuuuaagucaugaaccaaacguaagcaagcacagucgguucuccaggggugugcucucaacuuucaaaagcuguuuuaugaacaacgacucgugucggcugcuucacuauaaagcacacagaaaaaucaagauacacaagacaaaaaaaguuugauuuagggguuaauaauaugguacaguuacuaugauuuucuuuuacaccuaccauacaaauuuuguaaaaauuaagagaagaaaguauguaaaggaaauauucuguuggaaucaagcguagggcuuuugcugacucaugaaaaugaauaugaauguuucugaaggucucugaauacacacaggaugugugcaugggagugagagagaaagagagauagguaaaacaacauggcacauuccuuaccuguacaguaaaaugcuuuauguuucgccaugugccaugcuaaccauaccaaaaaaugcugccauacagugccaguugaaaagcuaacuuagccaaacuccuuaagccaaaaaugacauauauaucuguuuuuaaagccuaaucuguguauucagauaaaaucuaaggguccuaaaacaaauauuuauguagacaauuuaaauucuauccaacagcaaaagcccuauacagauggauuaaucuguuaaugugcccaagcccccaaaaugagaguucaauaauacaauuaaacuacauauuugcaaauaccaguaguauuucuguaauacauauuaagaaacugcaucucaucauaaaacauacaauauguacagggcacuuaagagaaacuggauaagcugcagaagaaaacuguugggugguauuuucagcagggccugguauauaguucaggcugaaccagggaaaagaacuguaaaacacaacaacaaaaaagaaaaaccacuguuaaauaaagguaaugguuccuuccaccuauacugagaagugccgauaauauaaacaaauguauacuacacagcacuguuaucuugcuugugucagagcugucaucaauuuagauaccaagaguuauggaggggaagggggagaagaucauuuagauauagggcaguaaugcaucaauauuaacaaaccuacaaagauuaugggauaauuuugcaugcaaaauuaugucucaagaggauauauucaguaucaacaucuuacucaaauuagugcauuugcaacauuucuggcaaacuaaaauccucuugaauuuauugugagacaccugauagaagaucugcauccauuaaaaaaaaaaaagucaugcaucugauccucugauuaaaaaaagacuauuuaaaaauaaaacuacaauuuaaaaauagcaaugaggccccucaccaguuaauuuucaugcgucaagaguauuuuuuuuacugcugcuuugauagaaccaugaaauacugcaugaauguguagaaaugaaagaaaaagaaacagacaaaagaaacaaacauuaaccaaggaaccuaaaaaauccccaaauccauuacuauuaagaguuccuuccaaauucagcuaucuuaguuuuaccaauuaagacuauuccuuaccguagacuaugucuacuguucuaaaacacugaccaagagcuaacaccgaaguguaauagcuaaaucuggagggaauuguauuuacuggagguaacauuaauacagcauaucauaccagaauuaaauucaccaacaauagaauucugaaugaaauauuccccuaauucuauauacuguauauuccuaaauacuucacuuccaaaaauaggucuagaaaaauuacuauggccugaaaauauuuaugaaagucauuuauaugauauacuguauuauguucagggauugggaacuauaauacuuagccaauaaaaaauuuaaauuuacaggcuaaccaaaauguuuuacauauuacucacaugauuugacccuuguuccaagaccuauacucuauuuuauucauccugaauuugaauucuguaaauuuucuguugauggucuuauccuacaacaggcacacugacauaaaagaaauugcuuaaccaaaacacacuaacucaaaaauuuaucuaucuauacauuacaaaaccuuaaaacugggcucauacacuuuaauaucauggagacagagguacuauuacauaacaugucuuaacccauuuauaaauauaaguuaauuucuuuagaaaaccagaggcaacuucucuguuaaggacuagacauuucacaacuuuuacaagguaugguguaaaugcucacauuuguuuucaaagauuucagauagcaucuaaaaugaacaauauuaagauuccacuuccacugaccaguuuauuaaggaaaggggaaagcauuuaaauccuggucagcauauuaaauuauuaacuuaaaauccagcaguuuuaucauauuucagugauucgaguaaaauuuauaguuaccaaaaugcaaaucaaguagcaguacauugggaacaaacuaauuauaaaauacgccuuagaaaauuuuacaaaaugguauuaaaauuucuugucacaguggcuuuuuagauccaaaaaaccugcucauuuuuuucugucaaauuacuuuaacagccuaaaauguaaaaagagagaaaauguaguuaacaaaugguuacaccaggaaaacacuuggggcacuugagugcuugcuggccuuuaguuaaugucuagaauccccuguagcugcagaggacccacuguuuuucaggcaucuggaaggguuuugcauuugccuucuccacuauaaaaaucacacacacaaauaacagagagaagaauuuauuauuuagagauauucuagaaauauagcaagaaugaacaagaaaaucuggcauaaaauaaaacacccagugcccauuuggcaccuaagcuacaggaaaucuugaacuuucacgaaaaccaaaaucacugcaacccuugguauacugaaauucaauguguuuuuuuuuuuuccagauuaucaaugugaggaagcuuuaagaaaauaaaaucaaccuacucauuuauuuaaaacagaaauaacaucaugcauuuauuugaaggcucuguaagcauacauggagugaaucauuuaccuucagggcuuuuucauaaaacuuaacauuaaauuaacuaaguagauguaucucagggaguuacaauaagggacaugguuuuaaacaacuuaaaaauguuuuaaaagaaaacaaaagguaaauaccuuauaauaacagaccuaauuucuaauuuuuagaauuaaaaaaaaucugcaagcaaaaauuacggacugcaguauaacaaggguuuaaaaauguuaauagcuuagauuuaacaugcuacuaaugcucacucuacaucuacugagguagauggucaucuuaggaugcccacauagguaguuaaacaaagcacaaaccuucugcauaugguacgacuaucaaagcucugucaacgaauacaguguuugucagaugcugugccacaacugcugagucuggaucauggaacuuaacaaagcagacacgagaugagacuggcaaaggcgaaucacuaaaaaauaaacaaauaacauaaaagagaaacagaauagcaguuaaaacaaaugcuaauucacaaaccaacacauuucaaaaguaaaacagauuaaaaaaaccuaacuguauacuaauguaguuaaauucaaaagaaaacauucucaaucauauacuguucacugaaauaauguagugaauugcaguucagauaaaaacuuauaaucauaacuuauauuuacaguguaucagguuaaaaacaauuugguacugaagucucagagacugaggggaccacaaaauugucaacaguuucuuuauaauaccaauaccagcuauuuuuagauacagguaacaguaguuuggggcuuagaaacuuccuaauggcuuucucagaguaagaaagaugaacaauuuuuauaucagggacaaaugaauaucaugagaacgaacauguacucaauaaucaaugaguuuucuugaacugcauaaaauaaacagguuccaugcccugcacucuuuuacccacagcauguaagaacucuuaugcacuguaaauaaucaaggauuucuggcuuggagcacuuucagauaaaagaaaaaauguaggcacacaugggaguaguacuacguuccacuagugccacccugcaaaguuucaauaagcaaaagggcuaguucccucaacaaauuacuuccuuagguaaaagaaagacaagugcuaaacugcaagcuauggcaguguaaguaagacagauaacacaggaagcaggguuuuuuucaacuguuaaguuacaggguagcucaaauuucugccuugaaacucugugcaugaauacagggauggcucaagcccauaccaaaaguuauuuggaaagcuagugcccuaaggcagaaauaaacacaccaucccuaguuaauacacucuaauguguauuagagucaugggguuggggguuggggguaauccacacucuucacaugaauuaaaucaagaucucugaugaaguuugaguucuuucuccuuuaauucucucugacaauuuuaugcacccaggguacaaaacuacuucauuuuaacaucaauauaacacuuacaucauaggacucauuaaugaaaaggaaaauccuguauuuuaauacuaucugaaugaggcuucacaguuucuaaaaaaugaaacacaccaauguguacauaaaauuguaaaugcaucagauuugguuauacuaagaauuucagauucauuguugaaaagaaaaauaauuucuuuuaauuuaggccuaacaaaaaaccccauaauuuuuaucacaacucaaacacuaacaugaugcuauauauggccugagaacucaaacccauuagaacuucugauacaagcuucccuacaaggaccucucaggcuaaacacagacccuaacccaaguucaaagcaaaauuaacaggauauccacaagcaaguuaagccaccuuguuauacaggcuuacuguugaauguuucuuaaagaauacagugguuuuuagaugugaaacacugcugcuauaaaauuuaacaauguugcacccgcaguaguaaaaagaauguuuaagcaauuucuccuuaaagaaaugggaggggucuuacuauguuacccagccucccacuccagcuuccccaauagauggggcugcaggugugccucacugucaaguacuuuagcagguuuaguaagcuauggcacuucacauuucuuugcugacauccauguuuccaucaauaaauuacaaagcucuuuuaaugcuaucaucuuauauuauuaacacccaacacaaugcccugggaaauagcaagcacuuaacacuucuuaaaacugaccucuaccaauucuuuuaacacuuuuuauuguuaucuuauuaaaagaaaugacucccaaauaugauauuuuuaauaaauaguucuuuaggaaaaaaaguacugcccccgugcucaaauuguauucuuuauacuuggcaaccuuaaagugacucauauuuuuuuuccuacucauuaauggcauaggaaugcuccaauuauuuuggcuauaucaaaaccuguuaagugaugguaggguacagauuaaauaugaauuugaauacugugaauaagaaauauaauuucaucucucuccacuucaaauggccuccuuuagauggguuuaaaacaaguuuuugaugguaucugggcccacaauuacauucuuaacauuuuuucgauuaaaauuuuuuuuuuuuugagauggaguuucacucuuguugcucaggcuggagcgcaauggcacgaucucggcucaccgcaaccuccaccucccagguucaagcgauucuccugccucagccucccaaguagcugggauuacacgcacacgccaccacguccggcuaauuuuucuauuuuuagcagagaugggguuucaccauguuagucaggcuggucuugaacuccugaccucaggugauccacccgccucagccuccuaauaaaauuuaucuuaauaagauaauauguuaauauaagauagaggacugaugccugaaauuaauuuuugugcucuaaaauucuguggaaguacugcuuccaaauacgacacauauuuuacuccguaucucuuuagaauuaauauaaaguagggagaaaugaggaacaagauaggguaaagugaguccugcaugccacuucuguccuccaacuaagagcggugguguaguuuuuaacaguucuuacguguccucugagggcuauuucagaaucuucuagacuacagagagaaaaccugagauuuccguuguucaccuaagggucuguagagaaucuuuuuuacaugaaggcccagauucuuaacaagguauucaugccuacuaacguacgagaacuucagguuuaggccacugauaucagccuuccaauuuccaccuuaauagugugcuaaguggagaauuucgagcucauaaauaaaaguaucgccaacccacaaaaggaggugugugacaaagacgacauuaaccugaaaacuugacugcugaccucaugugcccccuucucacuauguaaagaaauauacaauaaaauggugcaucaauuaaaaccauuuuuucuuuaaaggugcacuaaacucuuucccuuaccuaauauacuaauuuauacuuauauaaccauuaaaguauccauuuugggucacugaaaaguuacuaaugaacuucaauguaucuccguauuacagcagccuuaaguuacugcauaacugugacauacuucacugggaucaucaccugauaagcacuuugcugggcaaucccacuaaaagaaagcaugugaagaucuuacaaguuacuuggcuaaaucagcaaacuccugaucaagugguaaaggagagucacaacuuggguucaaguucuaguucugacauuggcaguauggcuugggcauacaaaaaauaccuauguaaauuucaguucacgaacuuguaaaacagggucaaaaacauuuuuuuccuccagguuuguaaggauuaagguacauuuagaaagcaacucacacacaauagauauucaaacaaugcugcauuuccaguacgcauuucagaaacaaccagaaucaaaauaacaguuuaacaaagaguauaugugggguucaacuuucaaauaccugcaaagccaucaugcuguagagacaguuagaauaucaccuauuguaaagauaguauuucuauuucucaguaaaauuacaggccagaaauucugguuuaaaagaaggaauaaauagauggacuuaacaaugacaaugcaggaaaccuccuagagcagguugucauugaaaugucugucauaaucccagaaauguuuccccaaaauaggcauucagaaccgaaaugaagagcuucaguaggugugggugagguucagucauacauguauuuuaaagcaccucauauucuacaggagagaaguuguuaaacuuaaccugucaacuggugacaggugcuauagaaaaaaaguaguguuaaggagaauaaagcagcagcagaggugcuuuauuuuacauaggguggucugggaaguuuucucugauuaaggugacaucggaaaaauaaaaguaguuaagcaugucacagauaugucuaggggaaaaagaguuacaggugcaugucacugccuucuugggggaaaucauauaguuuucccucaguauccaugguuucaggacucccugcagauaacaaaauccacagaugcucaagucucuuauauaacaugaugcagggagggggaagagguggaggaaaaauaaaaucauggcauauuaccugugcacauccucuugcauacuuuaaaucucgugauuacuuauaauaccuaauacaauguaaauaguugcuauacuguacuguuuagggaaugacaagaaaaaagucuguacauguucaguacagacguucucuccuuauauuuucaauucacagugggcugaauccauggauguggaacccagagaugaagaaggccaacuguguagauaauaguuacaaucaggugaccuguucacaacagauagaauuuuauguaaucugagccauucaauguuaugaauaaauauuuuuggaaugaugaacccuguggaccacugggaacuauaugcaacuugugccagucagauuaguguauugaaacuuauaguuaaaaaaacaaaaugcaacaucaaguaaauaaaaguagccaucuacauuacugaucaaauguagaaggccacuaauaacauuuaacuuauuguaaccuuguacauuuuaaaagacaaaaugaucuuguaugugggaagauaaaugaaggagucagaguaaaaaugugucaauuuaucucucuuucucccaauacugggaagggaguccuuuuaaugcagaauaucccagaucauauaguugagggagacauucucaagcacacacuagcuguccugguuaugaaggaacuauucauuugauuacaaaacaaaaagacucugguccaucacaacuuccucuaguauacuggucaugcauuagguaaaagaugaaccaguauaaugccuacaucucucuuaccuuuuuucuaaaugcaucauaaaacugccuucagagaauaaacagcauuuaaaagucagcaaccauaacaaaauuuuuaacuuguaggauuggaaagaauuguaguaauucgaauaccucaaauaucucacuaauaaaacuauuaaaaucauccaauguaucacuauuuucugcuauuuuacuguucauuaauuuuacaagcuuaaaacaguaagucuugagaaaacugaacaacagcaaagcaucuauuuuuguauguucauguuaugaaagcuauuugucuuucauuaccaaaucaaguaucugucaaaauaacaggaauaaagauuuacguguuuguucccagaacuccacgucaugcaaacuaaguaaauccucucuccacauguacauuucccuaaaaauuagaaacauaccaauuugaaaacaccaauaaucuugugaaaguauuuuaaguggaaagugaugaaauaugcuaauacuuaacaaauaucucauuaugauaaacuuuugucaauuauuuuauugagcagaaaguuaaugguuacacguaccauaacaguagauucuuagaggauuccaauuuccuguuuaguauuuaagugacaucauaaaauucucaauauaugauauuuacugauaaugacauuugaauugucacuucuccaccaauaagucuuccaaaaagcacaagacuauuauuauuauuccaauugucuguuuuaguaguacacuuuaucuuacuucuuagcuucuuugaacuauuuuuucuuuacaauucauccacuuaauauucuugcgauagaaauaauuuucaaaauaaaagugagacaaaaaggauaaaaagucauacacucuaauucaaauuucaacauuuauaaaaauccuucucaagaacaacugugaaauaucacaaaucuguauauuauucaaacaaaggaaaaucucugguuuauaacccguuuuuugacauuauacaaauuaaguaaucaggcucacacuaaacuaagcgucugucaaaaagaauaugaucuuugaauuauauugcugggccagaaccacauaacagcaauaacaauaagugaacaaccuacaaaguuuaacaccaaauuaacacaggcaugaauaauuuuguuaccuuucuuccaagaacgcaaagaacaaauacucaguuuuuuaaaaaagggauuuaaccuauauacgacguacagacugcgguuagucuugcguuaaguccccaaagccaaacgaccacguuggcacaauuuaaggcggaaaaaaaaaauuucccgagaauaacagccaguguuuccuaauuccaaaaagcccuggcccugccucucugcauuuuuuuguaggccuggaacacaaccgucuuaaguaaauccaccagccaccagccacucaagcagccuggcccggggaagcagcgacaggggccuaaggaaauuguguguguuaggcccaggcugaggcggcguuagcaggaacagugaugguggacgauacucacuccggcgggaagaggcgcaguucgucgaucuugccuaggaaaccgaagagaguccgcaucugcucagagcuagcgcucggggagacauuagucaccuggauuaccucggugccgccgccuccgccgccaccaccaccuccgccaccgggcccgccgcuggggcccggaccugcagugcuggggacgacgguaguguugcucauggcgcugcucggguucucgcuccugcuuuaacacaucaaacacacaacaaacagugagaaggagggggaagaggaaccggauugcgggagagaggaggguguccgaugcuacagccucugcuacugcugccgaugccgccgccgccgccgccguuucuccgccccgccgcacgccgcgggggaggggaugagagcgcgcgagcucgagaccacgagaaaacaaacggccgccccaccucgccuccaaccacgacacuagcgggcccgagcucccacaaugcuuugcggcgcagggcgcgucagcgucggcuccaccccgcgcaggcccagcagccgucgccugcagcccgagaaaugagaggcaccggggucuagagaaagguguuauccaccuucgucucucguuuuauucuucuuuuucuucucucuuuuuuuuuuggaagagcgaagaggcacguauaaacuuuuuuuuuaaaaaaagcauucauccuccugcaaaagucacuucagcaacucuucuuauuaaauacugcucacgaugucuuuauauacugauaaucaucuacagagcuauccgauuacuaaugauauuuaaacccaagcuaagaugccaccccaccaccaccaguauaaaaugucccgaaauuuucaauguacaugaauuuugguaacauuaaaucuguaacuaauuuguuuugucacuaaaacuuucagaaaagauauauuuuaauauuacacuuauuaauaagcguuuuguacauucauucacaauggaugacuuuuuuuuuugagacagagucgcccugucgcccaggcuggagugcaguggcaccaucuuggcucgcugcaaccuccacuuccccuguucaagccauucuccuaccuaggccucgggaguagcugggauuacaggcgccugccacgacgccaggcuaaguuuuguauuuuuaguagacaugggguuucaccauguuggccaggcuggucuccaacuccugaccucuggugauccacccgccuuggccucccaaaguucugggauuacaggcgcgugagccacugcacccagccaauuccacaauagcugacuuuggaaacacaguuuauaguacuuaaauauauucaaguauauauuucuaaagaaaauacugcaauuucucaagaaaaacuuguuucacauacauauucuugcuuaaaauaauuuugaagcuuuugacuauuaaaaaaauccuugcuuuuguuuucaaccucaucugaacuauucucucaacugcauccaguguguaguccagugacuuguagugccccaaacaugacaaaaaccauaaugucucugugccgauacacaaguuauuaauaacaucacucaucuuaucugucaucuucuguagagcauuccuucccucacugcuaugacuucugcaagcuguuagggcuuccucuuuucugcuaaguaacagaagauacauguauuuauuauugacauguaucacucaaaguugugagcuuccugggucaguccagaaccuggcacaaugucugucacacagucagucccaaugaaugugcuggacacacgcacaaauauaccuuaaugacaauggcauuuaagacaguucacuaaauaauucacuugaccuugaauguuuuuagagguaaaaguuuuagauguuuuggagguaaaaacaaacaaacaaacuugaagccuuacagaguaucuacauuagugaauaccucuuggcacaaugcagucaagaugcaauaugugagagauuagagcacaagguuauugagauuuggguguagagccaacuggcuaagugacuuucacuagugcuuauacagaaaauggauggguugacugaaugugagccucagcaaaauuacaaauuauggccuucauagaaaucaacuaacauuagcuagagccaagacuuuucagaauuuuaaagaaaagcauauagcugucccucaguaucugugggggauugguuccaggacccucccacaaauaccagaaccagaggaugcucaaauccccuauguaaaaugguguuguguaauaaagcauuugaucuguauccauggguuccauguauguggauucaaccaaccugggacugaaaauauuuggaaaaaaauugauggucuaaacauguacagacuuuuuauuucuugucuaacaacuauuuacacagcauuuacauuguauuauuauuaguauagagaugauuuaaaauauuugggaggaugugcacagauuauauacaaacgcuauccuauuuuacauaaagaauuugagcaucuguguauuuugauauccucugggguccugguaucaauuccccaugaauacucaccucaggacugguacaacuguauuugcauauaauguaagcacauacccucauacucuugaguaacccuuaucuaaaaugcuugggaccauaaguguuuuggauuuuggauuuuuaaaaaagauuuuggaauaucugcauuauauucacugauuuagcaucccuaauccuaacauuuaaaaucugaaaugcuccaaugagcauuuaccuugugccaguuagugcucagaaaguuucagauuuuggagcauuuuggauuuugguuuggauuagggauacucaacuuuaauacugaauacaauguaaaugcuauguaaauagcuuuuauacuguauuucuaaaaccuuuuauuuuuaaugucauuauuuuuuauuuuuugaauauuuuugauggggguugguuaaacccaaguauguggaacacaugguuauggaggcugauuguauaacuaacugcacgucacucauaaauaaguaucugugaauacaaagaaugguaauuaauuuucucauuuugaaucagacauauguaacugccaguuacagauacuuaauaguuuaacauuuauugugagugccuacuauaugccacgcaugcuaaaauauuugaugauaaaaggacaaauaacagaaggucaggguucaugccuuuuucuuuuuuuccugaaauguuaacacuuauuuauucucugugauggguacacauaaaucuuuuauaugacucuacauuuuucuguauguuugacacauuucauaauuaaaacuacaaauucaaaccaaagaaaaagguaguuguaauaaaauccuuuaaaccaccagaagccaauuuauguacaauaacuuacugaacaaauagaugauacuuugcuauagagaaacuaaguggcaaaaaguuuaugcaacugaagaggauuuuaaaauauuuuauuuucacaucauuuagcagcuaacaacaacaacaaaaaauuacugaauuuaaaguuagaaggcuggcuuaaaauaccagcccuguuggccagguacaguggcucaugccuguaaucccagcacuuugggaggccaaggcgggcggaucacgaggucaggagaucaagaccauccuggcuaacauggugaaaccccaucucuacugaaaauacaaaaacaaaauuagcugggugugguagcagacgccuguagugccagcuacucgggaggcugaggcgggagaauggcgugaaccgagaucgcgucccugcacuccagccugggcaacagagcaagacuccgucucaaaaaacaaaaaacaaaaaacacacacaaaaaacaaacaaaaaaaacccaccccugucaucaagcaugugauuugagaaaauuucacuucacuucuaagaaccugugucaguuuuucagucaaaugaagaguugaaucauaauuuugaagauucuuguaggucuaauagauuaaauaauuauguuaaugucuguuuuacauaggaauaagacauauaccugaagacgaaugacagauauauuaaagcaaauaaauauaaccaaucuaugacaguuuuaaaucacuucagauuuauuuaggcucacaauuaaacaagacuauagaaaauauagaaucuggagacaggauucaugccuguuuuauucacuguaucuacaauaucauugagaggcagucaaaaaacucacaaauuucuucaaauauuauguacguaaaucuguuccaaggauuuucccagcugcuggaaauagaguagggaaaaggaagugaaugucccugauaacauaaaacuucaggucuaguauggcagacuuucaauaaaaaaacaacacagccaggcgcgguggcucaugucuguaauccaaguacuucggcaggccaaggcaggcggaacaccugaggucgggaguugagaccaaccugaccaacauggagaaacccugccucuacuaaaaauacaaaauuagccgagcaugguggcacaugccuguaaucccagcuacuuggaaggcugaggcaggagaauugcuugaaccugggaggcggagguugcagugagcugagauugcaccacugcacuccagccugggcaacaagagcgaaacgccaucucaaaaaaacaaaaaacaaaaaacaacaacaaaaaaaacacaaaaaaccccacaaagaugaaaggacuaauguguugugaugaaaugaaauaggacaggggauggcggaaaaaguguuaucugcugagaccuuacuaaaaggaagaagcaagacauuugaauuucuggaggaagaguauuccagacagaggaaauaacaaauuagaaagacccuaaggauaagaacaaguuugaagcuuucaagaaaagaaguccacucuuugugaagugaaugcauuccaguuuauacuucagagagagacuuagaaaucuugucauguggaaagcaaagugaaggaaguaugcacagagaagguucaauuggcucaucuuuggauguaaguaagggaaagcuucuaguuauauauaaaugaucauuauuaucaauuuuauuaugaguuaaugcaacuggguaugguggcucaucccuguaaucccagcaguuugggaggcagagguggguggauugcuugagcccaguuguuugagaccagccuggcaacgcaaagaaaccccaucucuacaaaaaauacaaaaaaguuagcuggguguaguggugugcaccuguggucccaauuacuugggaggcugaaguggaggaucaccugagccugggaggucaaagcugcagugagcugagaucgugacacuguacucuagucugggugacagagugagaccuuaucucaaaaaaaaaaaaaaaaguuaaauaaccuaucauuuggccuauaaagucacauuauagaaaagugcaugauuucugauaggcuuuugaaacacaagaaauaacuuacagguuccccauaauacucugaagauucacagguaggacacguagggaaccacuacauugaaaaaaaaaaauuaacuggugcgugauauuggcaggaaagcaugucaaauaauauuagacaaugaggcuuuauacacauccguaaaacaauacuaauccucuuaguccuaaugaacaagcuuuaguucuuuuccaucucaagcuucuaaaaagaucuuuguauuuagauggaaggucuuuuagauaaaggagagcagacaggccacgcacgguggcucacgccuguaaucccaucacuuugggaggccgagguggguggaucaccugaggucggggguucgagaugagccugaccaauacggagaaaccccgucucuacuaaaaauacaaaaucagccgcgcgugguggcgcaugccuguaaucccagcuacuugggaggcuccucgaggaggaagaauugcuugaaccugggagguggagguuguggugacucaagauugugccacugcacuccagccugggguaacaagagcgaaauuccaucucaaaaggaaaaaaaagagcagacacagguaugcauaaucccgcuacccacugggaacccuguuugcaguuggauaaaucaagucccuuuuagccacuuuuguucacacuaacggaaaagacaguggaguccucccaauuaacacaauuuugcaaaucggcacaagcaacaggccuuuuaugaaauuaguuguuaaauagcucuucccuccacccccaagcaaauacauuuuuuugaggcuagaaaaggcaauuuaucagucuuuggguuucugauaccuaacaauaucauacuggaacaaguccagcauuagacaaaaaucuaccaucaccuaugugcuagaaacuuuacaaaugccucauacaaucugcucaauucuuguaaggcagauggcuuaucaauaaaguauacuaagggaaugcaugcagcaaaggcuuugugaaugaagaugguauguauuuguuccauuuagagggaaauuugguugagcaaacucucaaaguauuuggcuauauuuuuuuuccccuuuagcuauacagagccaugagaagaaccuaggaaauaaauugcugguuacaaauccguaaguuuuaaaaaacuuacggccaggagugguggcucaugcuuauaaucccagcacuuugggaggccaaggugaguggaucacuucacgccaggaguucaagacuagcguggccaaaaugacgaaaccccgccucuacuaaaaauacaaaaacuagcugggcgugguggcgugcaacuguagucucagcuauucggaggcugaggcaggagaaucacuugaacccaggaggcggaggcugcaguaagcugagauugugccauugcauuccagccuaggcgacagggcaagacucugucucaaaaaaaaaaaaaaaaaaaaaacuuaucugcagauguauuuugauuucuaguucuauaaauuagauaauauuucuacuguauuucuaauucuauaaauuuacacaauuuuauaaauauuaauaucuauuuaaaaaucagauuguaaaucccacgcuccuauucuucaccuaaaugaaggggagaggauaaggaugaguuagcacuaggggacugacugacagacaaaagaacacauggacacacauaccaggacagaaaaaaagucuaccuguguuuauuuucaaauacuucuuucauaucguuuaauauauauugucuuucaauagcaaggauuuuauauguauguuuuuaaauugacagagcagggucugugaacacccuaaaauuauaggcaaaaaucuaucugugaccauuuuuuucaacuuuguuuuaugauuaaauagaggaaaaaaguaguagucagagcauuaagauucuggugcuugcaucguauacacaguauucucagcuauagugcacauguauugcuuggaaaaucagaaucaauuuauuuguacagauuugcuuggcuuuuuuguuuaaucggcucaaaagaaacauuuggcuggggaagcuccagacacugauuucucaauacuaucuucuauguuauaaaagauucuuuuggagucuuaacugacaaaaagccauuggagggaaugcuucacgaucuuaaaaaauaaaaaaaaguucaaugcaagaaaauauccaguagaguuauauguaucuuuaccucuaauaguuucaugcauuuuaauacguuuuucguaaucaaggaauuaaacauaugcaccauuugaccuuuuauguuuuuuucccccaugcaguaaauuaacuuucucuucaugaaggaaaauuauuuuuaaagacuuacuuaaaacuggaaaaaaagugaaaguguacucaaaucaguacauuucauuaauaagacugaauuacauuaauugaaugcuuuuaaaacgaccuucaauccucauaacacuuaaaaggugcuagagugauuaauaaugcaggcccuagagucaaccugaagggacucuaccaauuaagauaauugugugaacuucagcucauuacuuggugcuucaauuuccuuauuuaaacugaggguaauaauaaugcccaccucauugggguuguuaugaggauaauacgugagaauacuaauacaaaugcuuagaauaaauuacuauuauaaugacuauucuauaaauaaagaaacuaaggcuuagaaaaguuaagcaacuugucuaucauauaaagcagguaauaguagagcagggauuaaaaaaaccaaaccagguacuacaucucacuccaaagccuguauuuccacuauguuguacugucuccuaccaugucuugucauaauaaauccacaaaaauuuaaacucacaugaaagauauaucucagaagaguuaguuuacacagugagaacagcuuauuuagauuucauauuuuaacacagguuuuuuguggaauguuaaaaauuauaaagcaauaaguuuaaugcuaaauauucaaacuauauaaauguaaaaaacauaaguggcuucuauucuauucccugauucuacuccccuauguguguucucaucuacuguaauaaauacuucuucuaauuagccacaugagcuaaugugucccuuaugugaaaaauggggauaaugaugccauuugaaguuucuaagauuaaaaauaugaauacaaagcacuuagcagagugcccaacacguaggcacccaacaaauguuacaugucauuacaagaaagucggaaaaaacucuccaauuuccucaucuuuucuuuuuaaauuuuuuuuugaggcagggucuuguucugucacccaggcugaagugcagaguucacagcaaccucaaacucauggguucaagugauccuccugccucagccccuuacccccacccccccaguagcugggacuauaggcucacgccgccacacccagcuaauauuuuaaacuuuuuguacagacagcaucucccuauguugcccaggcuggucuugaauucccaccagggcaucccaaagugcugggauuacaggcaucagccacgacacuuggcuuuccucaucuuuucaauugaugacuaacaauaguaauacuugucuuacuuuauagcauuauuguaaaaauuaaauugauaagaaccuacccuauaaacaguuaaguuaaagauaugaauuauaccauuauuagaugccccuucuccuuuaagaggcuacugcaauacaaacaugacaccaacaugaaaagacacaaacaacuguaccuaucuuugauuaauauuaaauuaaaaccaggcauaauggcucacaccuguaaucccagcacuuugggaggccaagguggguggaucaccugaggucaggaauucaagaucagccuggccaaaguggcaaaaccccaucucuacuaaaaauacaaaaauuagccgggugugguggugcgugccuauaaucccagcuauuggggaggcugagggaggagaaucgcuugaacccaggagguggagguugcagugagccaagaucucgucgcugcacuccagccugggcgacagagugagacugcaucucaaaaauaaaaaaauaaguauuaauuaauuaauuaauuaaaaguaccaugacaugggucagaacaaaaaaacuaucaaauaaccaaagcauaaauuuuaaaaguaaaauacuacucacaacuuuacuaaaauuaaacaauuuuaguucuuaaaaauaaaguacaguaaguaguuuuuaagggccauguuucucuccaccaauugccaccccagucacuugaaacaauaaacuguuguuaguuucaagccacaauuagcucaggcugaagucuaaagcacuuggagauauugaucaaguaauuauuuuaggggagggaugagaugguagagauguaguauuucuaggaaaugaguuaaaaagaaaagcaaaaaugucagcaccucuaagauggccauaaaguuguauugauggcugauaaauguaauguugagugaaaaacauguaccucuagaaugaugauggcuggguucacagauuugcaucauagguaccaaguauuuaaauguccacuaguauuucaacacucugaugaugcauaccuuuaaaauauuuaaguauauguaacugugauauugcaaaggauggaaaaaaaccaaccucaaguagaaaaaaaaauugugagcagucuugaagguauucugaaagcuaaacuagcacuuaccaaauugugaguauaaauauguggccuagaaaucuaaguaucaaauuuuaaauuaacaaucuacugauugugacuguuaacaaacuaccaaauuauucagauuuuucuccuuaaguugauguuaaggauaaagucucagggaccauaucaugucuuauuaaaacuguaggcgagcuuugcuacauaaacaguauuugccauuuuuaaacauuuacugugucucccuuuuuaaaguaaaugaaauugcaagcagaauccaauugaacaaaauugugggugggaggggguggauaugaagucaaauuuuaaaauaguggauuuugauugaaauuguuuuuaaaacagacuuacucaguaguguauguguuaacauaaacauaggguuuggugcccuaacuuuacuucuguauuacuuuacuaguuuaaagccaaaaaaaaaaaaucauaaaauccauacaauuaauacaaaaucugagacuuuaagucagagaacauauuagucuuggaaaaaagagcaagaauacugcacuagcuuuuaaagguuaugaguaauaaucacugugaauaauaggaaacacuuccagcugauuuaagaaccgauaaacaaaucucaauauuauacugcuuuuuugaaaaugacauaagcaggauugguuuaccaccacccuuguuucaguuucuuuuuauaauauaaugaaauaaaccagaaaacccccaaauuaaaagcauuuuugauaauuuuuuuuuuuacuaguucuuccaccuucaaguaaauaaaacuaacauuuaaaaaaagcccucauauaagagggaaaaaaauuuuuccuaaaucuggggacuaaaauuuuuuuguguugaaaguggagagagcugggcaugguggcucaucccuguaauucccuacagggucucgcucuguuguccaggcuggaguacaguggcacaauuuuagcucauugcaaccucggccuuccggggucaagccauccuccuaccucagucuccugaguagcugggaucacaggugcaugccacaccacacccagguaauuuuuguauuuuuuguagagacagaguuucaagauauuguccaggcuggucucuaacuccugaacucaugggaucugccugccuuggccucccaaacugcuggaauuauaggcaugagccaccguaccuggccaaucccagcacuuuggaaggcugaggugguaggacugcuugagccugggaguuugagaccagucugggcaauauggggagacccugucucuauaaaacauuaaaaaauuagcugaaugugguggcaugagccuacagucgcagcuacuggggggcauggggaggagguugaggcagaaggaucacuugaacccaugaguuugaggcugcagugagcucugcacuccagccugggugagaaagggaaacucugucuuggaaaaaaaaaggggggcgggagcagaaaauauuagaaucaaauauuaaaccuccuagagcaagcuguuucacgauucaaaaguauauaagagaagcagagaaaacaaagaauauacaaaugcauuauuccaaagacaaugcacucucuccauuagaaaaaauuaccauauacaacuccaguaacaacauaauacaaauuucaaagccacauuugaaacuaucaguaaaaugcaaaauauguacugucuucacugaaaagaaaagaaugucuucuuggccaggcaucguggcucaugccuguaauuccaacacguugggaggccagggcaggugggcugcuugagcccaggaguuugagaacagccugggcaauauggcaaaacuucaucucuacaaaaaaaaaaaaaaaaaaaaaaaaaaaaaaaaaaaaaaagaagcgaggugcuuuuagucccagcuaguugugaggcugagaugcgaggaucucuugagccagggaggucaaggcugcagugagccugggcaacagacugagacucugucucagaaaaaaaggaaaaacaaacaaacaaaaaagaauguccucucccagcuacucuuaaaguuggcaaugauagcccugaagggaaaacaaaugugaaauuguaagucuaaauuuuuaaagaaaacuaaaauguucucucaauaaacaacuuuuaccauaagauagcagcucucauacauaaggcaauauucugaaagauaaacacaauacaauucaaaauaggcuaaauuuguuacuuuacacaaaaagaaacuuccuagaaugucugcaaaacaaauacacuuugcucuuacuugacuccauuuuauaaacaagugugcuugcaaaucugccaaauuaacucaauuuacccuuacuacaauuucagacuucaauaauccaucucaucaauuguaccuuucaucuaugucuuaauaaauuuuaaugguagagacaagcugcucuauacuuugauaacagucuuacuuucuguuaugaaacaaaacuguacccuuuggccaaugugauuuuuagguuuaacauaaauuugguuucuucauuuucuuuucucauuuagcaaagaagcuugaagagggaagccuuucaucacuuaaauaaaaugaauauaauaaauucuggcuagacaauuccauuacaaaagguagcuaugcaguagucuccagccuugacacaggagacauucauuucacauuauuuuaguaauguauauaaagucaauuuuucuaaaaaagcaaauacuuugacuuaaaugccaguguugaaaaagaguuagaauuuuugcuuucaauguauucuccuuaaaacaauggaaauggagcuaauucucacauaaguauauauaacuaucuuuucauaaagaagcucaguugaaguugauuagcuuucaguuuccauccauuugagacaaaacauguuauuuucucuauugcauuagguaauaauuuuuacuguaacuugcucaaucugcacuuacuacauaaauacaauacagcagcugggugcgguggcucacaccuguaauucccgcaauuucgggggccgaggcagguggaucacaugaggccaggaguuugagaccaaucuggccaacauggcgaaacccugccucugcuaaaaaaauacaaaaaaauuagcugggugugguggugcguaccuguaaugccagcuucuugggaggcugaggcaggagaaaucacuugaagcugggagguggagguugcagugaccaagguugagccauugcacucuaggcugggugacagugcgagacuccaucucacucacacacacacacacacacacaccauacacuguauuacaguaacuaguacauucuuauauaugucaguuuauaucuauuggaguuuaccacaagcauauggccacugggauuuuuuuucagaauuacucuuugccauuaaacagaagauacuuuccuuauacaagaugaaacaauguuuuaauacaguaucauuaaaugucaauaaugaaauauuuaacuucaagaacaacaaauuuaaaaauuauaccuugcuguuauuuuuuaauaaauugaacuaggcagggugugguggcucaugccuauaaucccagugcuuuggaaggccccagauagaaggauugcuugagguggcucaugccuguaaucccagugcuauggaaggcccuagauggaaggauagcuugaggccaggaguucaagaccagccuuggcaacacagacucguuucuacaaaaaauaaaaacaauuagcugggcaugguggugugauggcuacucaggaagcugaggugggaggacuguuugagcccaggauuucgagguugcagugagcugugaucgcaccacuguacuucaucaugggugacagagugagaccuggucucuuaaaaaaaaaaaaaaaaagaacgaaagaagaaucuauuguagggggaggggugguuacuguaaaauuuuguacucgagcaauucaauucuccaaagguggguuguuucuuccccaaagguagguuguuacuauaaagagaaaaaggugguucuuuaauaaagaaaucuucuuaaaaacaacugaagugucucuuacaaugauuacaggauuaaaaaaaaaagcaaguugggaauuaugaaaagccacuagggaagucauggugauuaaaaagaaagguuuuggagacagaucuagguucaaauuccuggucgugcuauucagagaaacuugugagguuggguaaguuucuucaccccuuuuagccucaauuuccuuaucugcaaaauuagucacuguguuaaauaagaaauagcaaacagagguauuauuagcacugagccugguaugggcccaauaaggcagcuauuaccauuacugugaagacaagcugaccagggaccucauuaauaacguugcaaaagcugcuacggucguuuuccuuuaaaacucaggcugggcacggcgacugacaccuguaaucccagcacuuugggaggccgaacugggcggaucgcuugaggcugggaguucgagaccagccugaccaacauggcgaaacuccgucucuacuaaaaaauauaaaaauuagccaggugugguggugcgcggcuauaaucccagcuacuggagaggcugaggcaggagaaucacuugaaccugggaggcggagguugcagugagccgggaucacgccacugcauuccagccuaggcgacagaccagacuuugucucaaaaaaaaaaaaaaaaaaaagacaaaaauccacucuuugcuuuuuuaguaggguaacaacuauugguaacuuucucuuguucgauauuaguguaaaggacuccacagaaauaagaacaaaaaggguagaguuaaaaaccgaauuuuacagguagcaauaaccuggacucagguaaaagugcgugaugaagaauugaucaaagggccuucauccuagcuuucaacuauucuaccaauccucaguagacuugauggggguuagaaugguauucccuggcauaugcuuuuaaaacaaaaucauuucaggcaaaagaaaagucuagcacccaggauaguacacauacuaggcaggauuaaucuuaauaauuacuuguugaaucaagaaguuguacauuucagaugaaaauuuuaauuuccuaggaaacaccgacuuacauugaacaaaauuuucauuugcuauuauucuggacucaccgagagcucaagauucuaguuuuuaucuucacuuauuucaaaaaccuuaugcgguaggaauuauccccaaaguaaugaaaaaaaggaaugagcuuuaaaagcgguugaguaaacugccuaaaguuaacaguuucuaaaguaaagaagcagcugagauuugaacuugcuuuuuagggcucaaaaauccaagcugucugagcuucacuaaagcauguaccacuacuugucucccuaaacugucugauacacagaacauuuauuaaauuuuaaggauuuuuguuuuugucuucuauguugccaguccuuccauuucacauuaccuccuuugcuggguaagcuauauacccucaauacaacgagaauggugucagaguacaagccuuaagaacagaaaauuucuuuuacuccguacgccagaggucuggcgccaccaccacaagcgacaaacacaggcugggguccagaaacgcugccgaccgcgcccagaucucaaguuuuagucaaggcccacguucagacuaggagaggggagaagagaggguucucuuuccccacacccucgccacgguggaagcacagaggagaagguuggagucgcaguaacagugcaaacaauaaacccgaaagccccucuuaagcccguuaaacgcacuuacuugauugaaguaauuccaggacgcuaggccggcaccggcaacggaaaaggcuucucuguccuccagcccaggcgcuggugcugacgacaucuggacugcgccgcagagagugaaggcccagcgcgaggccgcgagcccagcgcccagagcgcgc

SEQ ID NO: 13883 - RNA, 66589 nt, Homo sapiens
aucccaacggcgccaccuuuaagcgucacggguggggcugcagcuucuggaccuaggacuuugaacaugucgcgccugaagcggauagcggggcaggaucuccgcgcugguuucaaagcagguggaagagacugcgguaccucgguaccccaagggcuguugaaggcagcgaggaagagcggccaguuaaaccugucggguagaaaccucagugaagguaagacccagagguacgacccuauugugucuccugucagaaagccuuuggcccaggcaaccucccuuuucucugggcuggcuuuggcccccuuucucagacugcuagccagaauuucugugcucuaaucuaaucccugugcucauuucgaccgguuugguuagcccaguucaguuccuucccagguucccgcaaucucuguuaaagggacccugcuaaaaauacggucuaaauuuaaacggggcgcuuucugggauucccacauucugugggauaagcaacauaauaugugacgaaaccagcuaucaaaucacgggcaaaucuuuuguuucuuuggcccuuauuuuccuccucuuauuguaaucuucaagggcaauuaccaaagcuaaaauuauauguuuuaucggccccuuugugaaccugcacuguucccugccgagacgcucuucuguaugcagcugugcagaguucuacuuacaaggaauaaugaguauauuuucuaaguugaagaucaggauagaugccacacagaguguuugaauguggggacauccugagaaaccuguuaaagaccaagaagcacaaaucuggguaccaugaaugaauggccagaugcucuucugauugucguguguguguguguguguguguguguguaagagagagagggaggggaauggagagauggagaaauagagcauuuuuccuguaauguuuuucuucauuuauauuuagguuuuaagacugauuaaaaccuuccauuuuccuucuaaugauugcuuucuuauugugacauguauaaaguagauuaggcaagcaaaugcuucugaaugaaugaaaagacacagaauccuuacuccaccuaaaagaguuuuugaucaaugggaacauacucauuuucaaacuacaguugugcauauauauauaucuacuugguuuccccaaaaccugaaacauuuuucucuaaacuugcauaccuaucaugcuaacauucuguucucuuaccuguuuaauuuuuuaacagcauuuaucacuaucagaauuuauaucauuuauguuuuuuguuuucucugcccuccaaccaaaagguuaauaucaugaagucagugagcuuuguuuugugcuuuguuguauuucuaucacugaaaauagugcuugguacauaguagagucuuauuaaauuuugcggaagcaauaaguaagugaaugaguauucucaaaucauaaguggugugcuagaauguacuuauugacuagacucaggugguuucgucuguuaaacuuuaagagagcacauggauucugacucuuagguccgugaugauauggauuagaacugcuuagguuauuguuauauaaccagaaccuaacacuuuaccugguacauaaaaugauuuuaaaugagugaauaaacagcauuucauaggagggaaagauauaaauggcagaaacucaugguauuuguagcuuauauauaaaaaaggaaucccuguuacuauaauauagaaagucuuucucugucuggcuguauguagcccucaguuucaucacuuguuagugaaacuuugauaggcaaaccacuauaauucugaacuguuuguaguucguuacggggucgugcuucuuaucuuccuaucuuugcucacauaacauugagaugguuaaucacucugugcccuaauuucucauuuauuaugcaggagucauaacaggaccuauuaaggucuaaaugagauaaaaugaaauaaagugccugguacauaaaaaguacacaguaaaaauucaccauugcuguuaucauggcagcaccuucuaguugguuuccuggaguuuuuacuuuacaucucacucuugcuacuccagaggcugaggcaggaggaucacuugaguccaggaguuuaaggcuguagugccuuaugaucacaccugugaauagccacugcacucuagcuuggacaauauugugagacccuguccauaaacaacaacaacaacuacccucacacucuaaauccuagugucauuaccaagaguuauuuuuccaaaacagaucuuacaucacucaaaacguuuaaugacuucccauagcccagaagauacgguauagguaaacuuuuuagcacagcauacaaaagucuuucuaaaccuuucccuuaacuauuuacuuugaggccucuuuucaguauccuauacuuugauaaugauaguagcucaugccuguaaucccagcacucuggcaaauugagaggcaggaggaucgcuuugaggccagaaauucaagaccagccugaggcaacauagugagaccccaucucuacaaaaaauacaagaauuagaugagcaugguggcgugcgccuuuaguccuagcuacuuggaaggcugaggugggaggauugcuugagccugaguuggaggcugcagugggugcugugauugugccauugcacuccagcuugggcaagagagugagauccugucucuaaaauaauaauaaugacacuaacaaaaauuaccuuucccccaaacaaccauacuuuaaaauuuuuuaacgaacuuuuuuaaugaaaguugagcagaugguacauuauauucucauauacccucugucuccagcuuagaguuuccucuguuauuaacaucuugcauuaauguaguacauuuauuauaauugaugaaccaauauugauacauuauuauuaacuggaguucauagguuuguuagggcucauucuuacuguuguacaggucuaugaaauugacaaaugcaugucguauauccaccauuagaguaucauacagcauaauuucacuucccuaaaaauccugugugcucuacccauucauuccuuaccuaucuuccccugaacugugggcaaccagugaucuuuuuccuguuucuauaguuuuaccuuucccagaaugucucuuaauuugaaucauaccagugcauaacguuuucaaacugauuuuuuaacuaaucaguaugcauuuaagguucauccauguauuuuugaugacuuaaucuuuuuuuuuuauugcugaguaauauucaauuguaugaauguaccauuuuguucauucacauguugaaggacaucuuggauacuuccaguuuuuggcaguuaugaauaaagcagcuguaaacauuuauguucagguuuuugucuggauauauguucaacucauuuggauaagagccuaggagcaugaucacuggaucauauaagagacuauguugagcccuguaagaaacugucagacuacuaauguguaccauuucauauuuccacaaguaauaaaugaaaguucucugcuccacauucuuaucagcauuugguaugaucagguuuuuggauuuuggccauuuuaguggguguauuucguuauuuuauuuuauuuuauuuuauuuuugagacggaguuuugcucuuguugcccaggcuggagugcaauggcgugaucucagcucaccgcaaccucugccucccagguucaagcaauucucccgucucagccuccugaguagcugggauuacagggaugugcugucaugccuggcuaauuuuuuuuuguauuuuuaguagagacgggguuucuccauguuggucaggcuggucuugaacugcugaccucaggugauccacccaccucggccucccaaaguguugggauuacaggcgugagcccccacgcccggccuguauuguguuaucuuauaguuuuaacuuaguauuuccuaaugacauaugauguugagugucuuuucauaugcucauuugccaucuguauaucucuuuggugaggugucuauuaagaacuuuugcacguuuuuucauugggcucguuuccuuguuguugaucauaguugucuuuuuaugccacuuguuucugcucagcaacugauuguucaaugaguaagugacauauguaaauaggcugguggcuuuuugguugcgauucuuaaauuuugugucauaugaagucuagauaaauguggcagagguguuuuuugacccagucaaaaguaauugcagaaagugauuauuauuuucuuuucauauaaacuuacuaacuugucccuuguacugauuccuugcauguuguauuuuuaguauauguuaaucuaaaaaaaguguuauuaucuuuuguuuuuaccccaaaauauuaguaccucaaauuaugauuuacauucaaaauauauuuaguuguuuuuuguuuuuuugagacagggucuugcugugucacccaggcuggagugcaguggcucagucauggcucagugcagccucaaacuccugggcucaagccaucuucccuccucagccugucaaguagcuagaacuacaggugugugccaccaaacccagcuauuuuauuuuuuguagagacuggaucucacuguauuguccaagcuggucucgaaccccuggccucaagugauccucccaccucagucucccaaagugcuuggauuacaggcaugagccaccaugcccaggccaaaagauacuuuaaaacauggcuucuuucagauugcgcuuucucccuugcucucucucuugcacgcucucuuuuuuucucucucucuauacacauauaugagacauuuuaugggaaauguaugagauaaauaugaaacuauuuuguaugcuauagggaguuacacagauacuuauucaaauagcauuuauuguuuaucuacuauguuucuuccagauauaguucuagaggaaauaaagauuaaugacaccuucaaacaauucauagucucauaaguguuuaacauaagcuuuauuauuaagaauuguacuuguuaaacaaauaauaauuuaaauuuucauguuauacuuuaauucuuucucucucucuucacauuuacauagucauauuuguaaaguagauucauuucuguuccuucuuuuuuuuuuagagguagggucucauucuguugaccgggcuagaguacaguggcaugauaguuuauuagaccuugaaccccugggcuccagugaucuccugccucagccuccugaauagcuaggaccacaggcaugcaccacugugcccggcuaauguugaaauuuuucgcagagauggggucuugcuauauugcccagcuuggucucaaacucccucuguccacaauccuccugccuuggccucccgaaguacugggauuaugggugugagccacuguaccugaccccauuccugauauuucuacauugggaaaacaaaacuuagucuuuaauuuuuacauauauaaugaaaaacaguuaaaauucuguugauucuugcucuuagaugguagccuccuuaaauagaaauuuucuuaguggaagccguacaagggcagugagagauuuuauuaaccugauaggauuguuaacuagacuauuaacccaguccaguacagugauaaagagguuuacucuaccuaaacuuauuuggguagaguaagucuugaggguauuaacuuuuacccauaacugaaaccugguuacucuuugggguguuuagguauacaguugacccuuaaauaauucagggguuguggggcugacucccuugugcagucaaaaauccauguauaacuuuugacucccccaaaacuuaacuacuaauagcuuacuguugacuagaagccuuacugauaacauaaacagucaauuaacauauauuuguauauuauauguauuauauacuacguucuuacaauaguaagcuagagaaaagaaaauguuauuaagaaaaucauaaggaagagaaaauauauuuacuauucaucaaguggaguggaucaucauaaaggucuucauucucaucuucacauugaguaggcugaggaggaggaggaaaaggaggggauggucuugcuuucucacggguggcagaggcagcagaaaauccauauauaagugaaccugugcaauucaaacccauauugugcgaggauaaacuguacuuuguuuuuguaggcucuaguucuuuuuugaaaaauaccauuuauuauuuucguauucauaaaagcaggucugcuguagaaagauuagaaucuauagagaaaagcauaaaaagugaagaagccaaccagaguuagucacuguuaauguuguggagguuuuucuucuaauacugugugugugugugugugugugugugugugugugugugagacuauguauaauuugacugcuauuuuuuauuuuuuuaucuaauuuaguuuauuuauugauugagacaggaucucacucuguugcccaggcuggaaugcaguggugagaucacggcucacugcagccuugacuuccuuaucucaaaagugauuuucccaccucagcucccugagugucugagacuacagggaugugccaccaugccuggccaauuuuuauauuuuuuguagagaugaggucuugcuauguuacccaggcuggucuugaucuccugagcucaagcgaccuguccaacucacccucccaaagugcugggauuacaggcaugaacuguugugccuggcccuauuuuuuauuuuuaacaaauuuagaauuguacugacuccuguuuuucuggcuucuauuuguacauuuuccuugucacuugaaaaaucuuauuauuuuuaguggcuguauaauaguccaucuuaugacuacuauuaauuaauauguauucauauuuaaacauucaaauuuuguucgcaauuuuuaaguaaucauucugagugucaguucuauaacuuauuuagaaagauauucucaaauaggaauaauuguuaauaaccaacuucaaagaaaaauacuguacauguaagugacagcucuuuuuaugagcagcaacaugagaauauguugucaguuugguucaauauugcagcucuuuuucgucggacuagauaaaaugaagauggaguuggagguguugaucguugcuuuccaguugcaugaccaugguagaacaguagugcaagaauguuauuggaugauuaucuaaaacugaggaaaaauaaaaggugccagaguuuggaacaaaagaauacuguaaauucuaauggaaacugcacuguugaucugaaaggcaaauuaagaggauaauucauuaaauaagccaguuaaauuagcuuggaaaccaauuauuugaaagggaaauauggguguaaggcuauccugccuuaucuugaagagagcaguuugguuagcuuuuauuuguguaguuaaguaauuuggucuagggcaccuaaucaugaagaaaaccuacuauuuuaggguaaugagaauuugcccuauucaauauguauaguuuguugggacagaauaaaaagugugacacggggucaggugcuguggcucacaccuuuaauaccaacacuuugggagguggaagcaggcggaucacuugagccugggaguucaagaccagucugggcaacaaggcaaaacuucgucucuacuaaaaauacaaaaauuuguauuuuuaguagagaugggguuuuaccauguuggucaggcuggucucaaacuccugaccucaggugauccaccugccuugaccucucaaagugcugggauuacaggcaugagccacugcacccagccacauucuuuuauccuucugugcaaacaccauuuuaagcauguuuuuuauuucuucucugucucuuuauccacccauaucauauaaauguccuccccaaacuagauaguucucugugaucaacccauuugugaguccucauuucuauauuuagcuguuaccaguggaaaaaagaguaagacaguuugcuuaaaaaaaaaaaaaaagccggggguugggggggccaggugugauugcccaugauuauaaucccagcacuuugggaggccaaggugggaggaucacuugagaccaggaguuugagaccaaucugggcaacauaaugagacccugucucuacaaaaaauaagcuggaugugguggcacaugccuguaguccucauaguucuagcuacuuggaagacggaggcaggaggaucuccugaagccaugaguucgaggcugcagugaguuaugaucacaccacuguacuccagccugggugacaggcucucaaaaaaaaauaaaauaaaauaaaaaaauacaucuauacaucuuccucccccccgccgccccccaguaucuauaaggaccauguuguccauuguggaagccuguacucauguuggcuuuuuaacuuuuaaauaaucaaaauuaaauaaaauuaaaaaucaaguucaucaguuacuuuaaccacauugcaagugcccaguagccauauguggcuaguagcuauccuauugaauagugccaacguagggcauuuacgucauuguagaaaguucuguugagccaugcugcuuaaggauauuguaucuacccugugauauauguuauauguguauauuuuuccgauagaauugccuugauguguuacaucaccuauauuuuaaaauuauucuuuuuugggguuaacuuuauugaaguaucauuuacaaagaguauguugcauccauuuuaaguguacaguuuaaugacuuuugacaaauauauaccaucauguaaccaguacuacaaucaagauauagaacauuuccaacaucuugaaaaguuuacuugugccccuuugcugucaauccugcuauuggcuccacauaacuacggaucugcuuuuugucaauguagauuaauuuuaguucuuuuaaaauugcauguaaaugaaauaauacauuugcaauuuuuuuuuucgcuuagggcuucuuuuguuuagaaucauguuuuugagguucauccauguuguuuacaucaguuguucuuuuuuuuucuuucuugagacagugucucccucuguugcccaggcuagcaugcaguggcacagucauagcucacugcaacuucaaacuucuggucucaagugauccuucugcuucaguuucccaaguaucugggacucaugguguaugccaccaugccuggcuaauuuuuuuguuuuuaauagagacgaagucuugcucuuuuucccagguuggucucaaacuucugggcucaaaugauccuccugcuauggucucccaaagugcugcaauuaugggcaugagccaccacgcccagccagcaguuuuuuaaauugcugaauaauaguccauuuguguauacaauucaauuuauuuauccauuagucuguugauggacauuugagugguuuccaguuuuuggcuguuaugaauaaaauugcuauaagcuuucuuguauagucuuuuuuuuuuuucuuagaaagaaacauuucguaggucuuacaaauggaaggugugucugugucuuggacaguggugagauaagaugauggaucucugugccucauguacaagucuuuguguagacauaccauuucuguugaauccauaccugacaauggaauugcuguauuguauaguaguaaguauagguccuggcgugguggcucacgccuguacucccagcacuuugggaggccgaggcagguggaucacuugaggccaggaguucgagaccagccuggccaacauggcgaaaccccgccucuacuaaaaauacaaaaauuagccaggcaugguggcacaugccuguaaguccagcugcugcucgggaggcugaggcagagaaucccuugaacccgggaggcggagguugcagugagccaggacugcgccacugcucuccagcuugggugagaaagugagacccugucucaaaaaaacccaaaaaguauuuauuuaacauuauaagaauucaccaaacuguuucccacuagcaacauaugagagauucaguuccuccaccucauuaccagcacuuuguauucagucuuuuaaauauuaacuauucuuguggcuguguuggcauauuuuuuugugguuuuaauuugcauguccuuuaaaacuaaugauguuuagcaucuuuucuacugccuuuuagccauuuauauaucuucuguuaaguguuuguuccaacuuuugucuuuuuuuuuuuuuaaauggguuuuuauucuuggguaacgacuuuguauauauuugagauacaauuccgucucagauaucuauaucaguaucugucuaauauuuucucccaguuuagcuuauuuuauuaaugguagcuuuagaaacauguaaguuauaaauuuuuaugaaaucuaguuuaucaauuguuuuucuuuuaugaugaacuuuuucugucccaagacauuuuuugcccaucugaaggcugugaaaauuuuuuccucuguuucuuuuagaauuuuuuaguuucaucauuuacauauaaguccgugguccauuuggaguuaauuuuugagugugucacaagguaaagguugagguucauuuuuauaguuuauuuuauaguuauuccaguaccauuuguugaaaacaugauuccuuuuuuauuaaauuauauuggcaccuuuguugaaaaucaauuuucaauauuuuauuguauggaauuuuuucugaacucuuuuuccauugaccuauguguuuauccuuaugcuaauacuacacuaucuugacaaauguagcuucauggucagacuuggaaucaaauacuauaaagccuccuguuuuguucuuuuauuucaaaauuguuugaccuaauuuaguucuuuugcauuucaauacacauuuuagaauuggcuuguuaauuucuacagaaaagcuuucugggauuuuuauuaggauugugcugaauaaagccuccuguuuuguucuuuuauuucaaaauuuuuugaccuaauuuaguucuuuugcauuucaauacacauuuuagaauuggcuuguuaauuucuacagaaaagcuuucugggauuuuuauuaggauugugcugaaucuauaagucacuuggggagaagcgacaucuuuguaauauggagucuuccaagcugucuuauguuacauuucuuuauuaucuagaccuucaaguuuucacagcaauguuuuguauuuucauauacagaucuuguacauauuuuguacauuuaauacuauuucaugguuucggaugucuuguauuguaaaucuuuuaacauuuaaacauuuuuuuauuugauugcuaauacauagaaacauaguugauuuuucuauauugagcuugaauuuugugacuguucuaaacucauugauugcauauaauuuuuuuguagauuccuuagcacuuuguacauagaugaucauagugucuguuaauugggacaguuuuacuucuuguccaaucugaaugccuuuuguuucuuuuauuuauuucuuuuucuucuuuuugucuuacugcauuggucaagaccucuauuaaaauauuaaaguagugagaaugggcauccuugccuuguauacucuuuuaaagagaaagcacugcgucuuccaccauuaaguaugguguuaguuuuagguuuuucacagaugcccuuuguaagguugaaggaguucccuuugauuccuaguuuucugaguuuuuauuguugaauuuugucagaugcuuuuuuuguaucucaacaaucacauaguauuucucauuuuucuguuaauaugguagcuuuuauugauuaauuuucaaauguuaaaccagccuugcaguccuaagauaacucgcacuggaucaugauauguuauccuuuuuauauagaguugcaaaauuuguucaggaauuugggucuauaaucauuagauacauuggccuguaguuuuuguuuuauuuucucuuuuaauguauuuaucugcuuuuggcaucagaguaagacuggccuuauaagaugaauugggaacuguucuuuucucuauguuuugaaagaguuuauguagaauuaguauuauuuuuacucuaaaugucugguagaauucaccagugaaaaugucugccuggaauuuucuuuguggggacuuuuaaguagcuaauucaauuucuuuaauagaugcaaggcuacuuucuauugugguuguacuuuuuuuuuuucuauucuagggauuuauccauuucauccaaguuguuggauuuguuggcauaaaguuguucauaauauacccuuauccuuuuaacaucugugggaucuaugacauucucacuuugauuccugauuuugauaauuuguuucuuuuuuuucuucaucugucuagcuaaggguuuaucaauuuauuagucuuuuuaaauaaguauuuuuuauugcuuuuucucuguuuguuucucucucauugauuuccaccuuuuauuuccuugcuucugcuuucuuuggauuuaauuaauucuuuuuucuggguuccuaagauuguagcuuagaucauugugggaugggguuauagaugaagcaacacuagacaugugcugauaauuauuaaaacuagacaauggauacauugaguuuuauuccauuauacuguuuuuuuuuaaacauuuauuuuagguucaaggguacguguguagguuuguuauauagaugaacuugugucagagggguucguuauacagauuacuuugucacccagguacuaagccucauacccauuaguuauuuuuuucugauccucucccuccucccaccuuccacccucaagaggaccccagugucuguuguuccuuucuuuguguucaugaguucucaucauuuagcucccacuuauaagugagaacauacaguauuuuguuuucuucuguguuaguuugcuaaggauaauagccuccagcuccauccauguuccugaaaaaggcaugaucuuguucuuuuucauggcugcauaguauuccaugauguauauguaccacauuuucuuuaaccagucugucagugaugggcauuuauguugauuccauguuuuugcaauugugaauagugcuacaaugaauauuugcaugcauguguccuuaugguagaaugacuuauauucuuuuggguauguacccaaugauaagauugcugggucaaaugguaguucuguuuuuaccucuuugaggaaucgccauccugcugucuaaacugguugaacugauuuacacuccuaccaacaguguuuaaggguucccuuuucagcaaaguuucaggauacaaaaucaauguacaaaaaucacuagcauuccuauaaaccaacaacagccaagcagagggccaaaucaggaagacaaucucauucacagaugcugcaaaaagaauaaaauaccuagaauacagcuaaccagggaggugaaagaucucuacaaugagaauuacaaaacacugcucaaagaaaucagagaugacacaaacaaauggaaaaacagccuaugcucauggauaggaauaaucaauaucauuaaaauggucauacuccccaaagcaacuuacagauucagugcuauuccuaccaaacuaccaaugacauucuucacaggacuagaaaaaaacuauuuuaaaauucauguggaaccaaaaaagaguccaaagagccaaggcaauucuaagcaaaaagaacaaagcuggaggcaucacaccaccugauuucauuaugcuacucuuuaaauuuauguauauguuugaaauuuuuuauaauauccaacuccauaguaauuuuuuugauauuuauaugcuauugacauucauuuuuauguggguaguuucuauuuuggauauugauaaacuacuuguaggauagcuccacagaauuucuuaauaauuaagacuauauaugcuuuuuagugguucuuaugggacaguugcaacagugacaugaaucuugaugcuguaagcucuggaagaaauugggauaccucaaaaaugauuaguggggaaaagaaugaguaguaaguaauuguuuauggaaaagcaaauugauacauguucaauaauaguacaguaucaacauguaucugccccuugaugguucccauaaagacaaguuuguuaauaaaaauaucugaguaauaauaauaaaacauuaauacucaguauaguugauggguaacagguauuuuuauuauguuguguauaaauuucuuguuauccccaccuuucuccauccaaaaaaagacauuuguuauuacacugcuuuuuagguauaauggccuuaauauaccuauguauagauguuagaaaaaaaugcaugcacaaauguucuaugucucaucuuuaggaguagaauggugcaucucacauagcuuuuucuacauacuuucuuaguguuuuguauuguuuuaucuugccuuuuuaaaucuggagcuuuuuguuugugacucauacuauauggcacauuguaguuuuuuuuuuucaagagucacauuuauuuuuaguaaaauauauaugugaccacauuucuguuggcugcuuuuuugucaguaaauucacaugccaguugcuuggcugaucuccuuuucucuuuccuacuuaacuaauuauccauaccuacauaccaaaauaacaaugaugaugauaaauuguauggugcuuuggcucucaaaucagucaagaaugguaaaauuauuuuauuuugcuucacuuuaaaaguaaaccuccauccaccaacagaaacacagguggauugauauucuguguuguuaauaccuaauggagaaucagugguagaagaguagagaagcagagaauacauaaucagacauaaggaguaagagagggaccuuauaauuuauuuuaguaugaauguagauagcucaguuuuuuucuuuuucuuuuuuuaaguuuuuuuuuuuuuuuuuuuagagacagggucucacucuguuucccaggcuggaguucuaugacgugaucacaguuacuuacugaacuucaaaguucugugcuccggcaauccuccugccucaggcucccaaguaguaggacuacaggugugugccaucacaccagcugauuuuuuuuuuuaagagauaugguuuuucuuugaugccuaggcuggucucaaacucauggccucaagugauccucccaccuuagccucccaaagugcagggauuauagcccugaggcacuacaacuggcuagcucauuuuuucagugaguauaagucucaugccuuucaggggcuuggcuuugcuucuguaaccccauuuuaucugauuaaucauccaaaacugcacuuaaguguccugaaucugaaacuuugacuauaccuuuucauuuagucucugaugguuuugaaaugauaaucuguggcagcaagguauaaccaauuuuugccuugauuaauaccagcuugaaguucuacaucaucccuaaauguaguucuacuuuuaccgagcagugaaggacucuauugaaaauaguuuugcuacaacacuacagcauucuaccuucuggagcuucaaguuaucccugcucaauuuguacagucuuauuuucuauacaggugucaucacuugcugcaauagcauaacacaguguuguauggugccauaagaaauaaaauuguaugucagauaaaauaaagaguagcuaccaaagucagauauuucucccaaauguuaauagaaagcaagacaguauagcacugccaggcauugaaucacaucugugguacuugucuagcuuuguaacccuggccaaauuauacauuuucuuugugcucuauuuuucucauccauccaaugggaauaauaacaccuacuuugcagaauuguuccaagguuuaagugaauuaguauguuagaaguauuuauaaguguuagccauuauuacuaguucuuucugagccuuaguauauacuucuguuauaaaaguuauuacauauacauguugauuuccaugccuucucuauuaaucuguuagccugaugguagaaugcauucuuuguuguacauauuuaccacaaugugcugugcaguguaugugcuaaucaguguauguaaaccuaguaaauauaguugaaugaagguuaaagugagagcuaauguguagaggacauauuauugauauauagccuuuuuaaauaaaaucaacuuucacucuaguuauauuuauugcuauuuaacuuauuuuuuguuuuagaaaauguuuuucaauagauaaauggaauggcuauuauaaaagcaugucacuuaguaucuaguucugguuuucaucuuuuuuuuuuuuuuuuuuuuuccugguguggugcugauggaacuagugccgcagugugucuggagaauaaauguggauaucccugaggaagcuaaucagaaucuuucguuuggugcuacugaaagauggugggagcagacagauuugaccaaacuaauaauaucaaacaauaaacuucagucacuuacagaugaccugcgacucuugccugcacugacuguucuugauguaaguugacugacuauaaauauggauuauuaauugaagagacucuaaagcuaaauuuaggcuuugguagcagaaaaccuuucauguugaguugguaaugcaaggacagauaguaaauuaucauucuaggcauagcauaaugguuaaaagugcaggaucagaacaccaaguuucuaauucugacuucugcuauuaauggcugugugaccuggggagaguuaccucucugugccuuagucuccacaucuguaaaccaagacugauacuacuaccuauuuaaaaauuuuguuuguagaauuaaauaaguuaaugaauacagacagaaucaauauucaacaagugguuauuucugcucaucuuuuuuuucuuauuacuauuuugcacaggcaaaauaguggcgugaucauggcucacugcagccuugaacuuauggacuccagcaauucuccugccucagucucccaaguagcugggacuauaggugcaugccaccacacccggcuauuuuuuuuuguguguguagagaugagggucucacuauguuucccagacuggucuugaacuccuguccucaaacucuccuccugccucagccucccaagugcugggauuacaggcgugagcuacugcaccuggccuauuguuacaauuuuuaucauuauuauucuagauauuaaagcaagucuauauguauauguauuacuugccuucaaccucauugaguuaaauuauugaacuuaauuuuuuuguguuuuuauucagggauucuuuuuaguccuuuguugccauguccugugguaaagugaagcacaaggaguauauuucauaaucugcgggcuucacaaucugguauacuuuacuuaucaacauaaaaaguccuccaauucauguguugaaaaguagaaucuaaauagaucaauuuuuagggaacuuuuuauuuucuucauuuguaaaaugaauggauuggcuuacucuaagguucuuucuaccuuaaaaacugauucugugagaacaugagaaaagucccuuucucuuuucucauauaauuuuuguauauauugacauaaaucauaucaucagagagcuguuuuuaguuucuaacccccucaucucuucuuugaaauugaaacucuacuaaugaguugaaauuuuucuuaguauaauauuuaaagugguugacuuaacacuucaugacuucucuucucuucucuucucuucucuucucuucucuucucuucucuucucuucucuuccauuuuuugagacagggucucacucuguagcccaggcuggagugcaguggcacaaugugggcucacugcagccuugaccuccuaggcucaagcaaucuucccaccucagccuucugaguagauggggcuacaggugugcgccacuacgccugacuaauaagaauuuuuuuuuuuuuuguagagacaaggucucacuaauuugccuaggcuagucucaaacuccuggguacaagcgauuugccuucuucggccucccaaagugcugggauuacaggugugagccacugcaccuggccuuacuucaugauuucugaacagccguuuggucaucuucaaacuguucuacauacagaacaaguauguugaacaguaguucaacuuguugccauugaauuugaggaacaggagauuacugacuaauaguuuuguacacuggcaaagcuuauauauuguuaaugauaagacuaagaauauugacuuugucuuuuaaaaacuuuuagauacaugauaaucaguugacaucccuuccuucugcuauaagagagcuagaaaaucuucagaaacuuaaugucagguaaaaauuaagcuuauuuacuuauauuauugcccuuauaaugguuuaaaucuaauauucuuuaaauuuucucaacauuaaaaauaucuuugaauuaucucagaaaguaguuaaagcagaauaagaauuuuaaguuuuuuaaagcuuuaauucuuaguuuguauguuuuuuucuuuguuuuagcauuacccccaucauuucugauuuuauaaaugcaaggcuaguugauuuuuuuuaaaugcuuaaauuuuuuuuuuuuuauaaaacaauucuuagugguuuguuauuguaguaaaccucuuuguugaugucucaacuuuuaaguuaccuugauauucuaaaaauaucuaaacaauaaggaagaaauguaaaacaauucuuucauaaaugaaauacuucauaguuuuuauuaguagucguuuuuaaacuucuccaaggacuccugggauucuacggauauauuuuuguaacugucauggacauacugguacaugggauguucaguggcaaagauuguagcuaacucuguuugcucucugauacauacccagacuuuuaagaaagaauaacuuugccuuuguuuguuauauagacauaggcuaugggaaaggagauuuaaagaggucuuauuuuggaguagaaaaaaaugguucaggaacuuaaagcauaguuugaaaaacuguggcuuauaaaauagauacgguuacagaucuauguaauguaauauagucaaguuuguuuucuggagauaagcuaacugguuugagggaaaauagucccucccaguaacacuccuuauuugguggaaaacauaaaauuaccauuggccaaugaaaauauauauacauaaaaaggugcuaauuauuuagaacuccaucacaguaucuuccccuuacaagucaaaggcauagacguggccuguaaagacaagaguggggauuguugagaggaagagaggaagcaguaaguguugagugacauggcuuaagcuuuagauucuauacuuaagaguauguagguguguucucagugaagaaguuuaaaaaaaguaugaaucuuaggauggaguaauuagcuaagaaaaggagauggaggaaaucuauagcuaaaauuaucucucuccccaguuagaucccuaucaagugugcaaagauuucagcuagguaaccaauaacaguaaccgacuuaacaauauuauugguucuuguuuuagaagacaucauuugacuuuuuuugucccaacuaguuuuauuuuacuguaauuuaggguuauuguaagcaccuuguauuucccauuuucccccuguuauuuguaaaguaacuguauauggcaugaaaauagcauggaauucguaagugaguauuuaaguugugauaaaccugggaacuaguucagucaucucuuaauuaucaugaagucuaucauccuccaugauuugggacuucuaaaccauuacacugaauaucucuacagaagggcuuaacugaaaagaccaaguaugaagaagaguggaauuccauauuacauucaacuugacauccuagguccucaaacagaaauagcuauuuuugccuuaaaaccgaacauauaagauguaacuccauugugguauaugugugcauauaguuuugucaaaauucugaaagucaguuauaguauguauuaguccguuuucaugcugcugauaaagacauacccgagacugggaagaaaaagagguuuaauuggacuuacaguuccacauggcuggggaugccucagaaucauggugggaggcaaaaggcacuucuuacauggcagcagcaggagaaaaaugaggaagaugcaaaauuggaaaccccugauaaaaccaucaggacucaugagacuuauucacuaccacgagaacaguaugggggaaaccgcucccaugauucauacuaucucccaccagguuccucacacaacaugugggaauuaugggaguacaauucaagaugaaauuuguguggggacacaaccaaagcauaucacaguauaacaaauuaagugucuaguauguccuaucacauugcaugucaaaucaagaguugauuauaagcaugcaaucaaaacaucacaaauuauuuauguuuggcuaaaagccuuuauuucuuuguuauuuuucuuugaaaccccaaugugguuacuuuagauuacuauuauuuuaaugaguacauauuuuuggauaugaauuuugauaaguacuuaaaguuaguaacuauauuugauuuuuaugaguccagugucauugguuagcaagaaaugucuuugauaaauauuuauuguauugccacuaaauuauucaucauuuauuuuaucaaccaauagccauaauaaacugaaaauacucccugaagaaauuacaaaccuaagaaaccugaagugccuguaucuccagcauaaugaauuaaccugcauaucagagggauuugaacaacuuuccaauuuagaagauuuaguaaguucugauuuuccaauuuuuguacaauuuggggcuggugggauuuuucaucaggcugagaaauuaagauagaugauugaaacugugggaacauggacagcugauuuugugauuagauuaucagaaaugugcauuucaauaagauagcuaaauuugucacuguaaauuugguuuuccuguauuaugaaaucaacuuuaaguuuuaauuuaggaagaguuugggaaaggugcaaugaagauuacuuuguuauucagaggcuuuacagcauagcagaauagaggaaaguugucuuuagcauauaccaauucucuuuucuauacccauuuccauuuccuuccuuauauuaccugcggcccuucugccuuccaaauguccagguaauucacugaaggucugucuucucuacuuuucagaauggccacacuuccuggcaaaauuuuaauuccauuguuucacuuaccuuaaauagagauaacuguaaagcaauacaaauauuauuuuagucauauuuuuauuauuauuuuauuuuuggggggacauggucuuacccugucacccagacuggagugcaguggcgcaaucucgcucacugcaaccuccaccucccagguucaagcgauucuccugccucagccucccaaguagcugggauuacaggcaugcaccucuacugcccggcuaauuuuuguauuuuuaguagagacgggguuucaccauuuggccagacugaucuugaacuccugaccucaaaugauccacccuccucagccucccaaaguucuggcauuacgggcaugagccacugcuagucuagucguauuauuaagaauaauaaaaacaauagacauuuaucuuugagcauuacauauggcaauguaauauccccuaauacaauaagaaaguaaagcugauaaaaaggaaauuuggagcuaggugugguaguucgugccuguaauucugucacuuugggaagccaagguggguggauuuuuugagcccaggaguucgagaccagccuggaaaacauggcaaaaaaccugucucuacaaagaauacaaaaauuauccaggugugguggcacgugccuguaagucucagcuacucagaaggcugaggcagggaaguugccugagucagggaggcugaggcuuuagugagccaugauugagccacugcacuccagcguggaugacaggagacccugucucaaaaaaagagagagagaggaaagaaaaagaaagagagagaaaggaagaaagaaagagacagagaaaagaaaauuugucaaaaguaacacaacuaacaaguaacaaaauuagaauuugaguguaagucaauuuaacuccaaaguguauccaucucuuuuuuuuuuuccauuuuaccaccaaaggaauaagauuccacugcaggcuauaccaucugaaagacuuuagcuguauuaaaucgaagguacuaauauauaauaucuacuccacauaguuaauucauauugcauuguuauucuuuucccucuuacauguuuuggaaaacuccugucauuuuagcuugcuuuucauuaaaggaagaaauuacuccuuuucuauuuuugcuguguguacauccuccuugauacuucccucauuuguucuagaguuuaaaagucaaaauauauacucuucucaaccauuccuucagugucuucuugucuuuccaaaugaucagaugggaaauaaguaaaaggcauagguagauaaaaugaauggcaaaggaggaagccaucagauuuucuuauaaaaauuggugguaaaagguagcaguugauuuaaaagaguccauuuggaguugagagcugaaaggaaaauuuaaaauaaauaaaauuucuacuauccacccacauguucccagagacucguuuacauaaugaaagaauguuucauuucagaauuguguucuacagacucaguaucaaaucauaaaugugagcaacaauauauuaaaacagauuaaacaccuauaauuuaaacuaguaauauuucuuaaacuuguauaaaaacugcuuagcacaaugcaacuaauuauuuguuaaaggaaugacuuggcauaaauauggauuaauuuauauaguguauuuauguuuuauaucuaacaauuacuaacugcaguaauuauuuaacuuuauuaguaauuuuauguagaauuuacaaggggguuuauuagaauuauuuggguuuuuaaaaaugcuuugacaauuucugaauuaaguuuuuuguuaguaacuuuuuauuuuaggcuuuuuauuuuagaauaauuuuagguuuauagaaaagcaaauauaguaaaagaguucucauauacccuacauccaacuuucuuuaauguuaauauugauauaaccacaggaacacucagauguucacauugguacaauacuaauuaaacugcagacguuauuuagauuuucccaguuuuuccacuaauguccuuguuuuuguuucagaguccaaugcaggauaccacauugcauuuaguguuaguaacuuuugauacuacaaaauauuuauuagcaaucuuuugauucuuagaguuuuuaguauuagaguuguagaauauguuauguuguauguuguagauuaugauaauauauuguuauaaaauaauuauaacaguauguuuuuaaaaaaagauuugauccaguauuuuuaccuuuuucuaucuucuugguuucuucagaguuacaaaauguuacuguuagauuaaaugaauuguuuaguguuagguuguuuaauguuauauuaaaugaaaaucuuauucauuguugccauugacacugcuuaacacuuugcuguuauguaguggagcaauuuacaccuaauuugaguguuauaaaaauuaccugauucauaacaacgucuuuuaaagggaguuucaaaaaaaaguucucuuaaaacuauuuaaagaaaaagcaaacauaaucauuuaaagaaacaggagguauagcgauuaauuaagcaaucuugagugaaugaagaguagaggguagacuucugguaccaaucagaucugacuuucugaggucagcagaagaaccaauagaaaauauuuuuuuuuccucaaaaauuugaauggccguuuuuuucagcuucauuuuuccuuuucucaggaauuuuucuuucuugcaaagauguuuuucauuucacaugacaguuuauuaauaauaugccuaauucuucuuaggcacuucauaaauauuggaugaauacaugaauuuuugcauugaaaauaugaugcauaauauggcaugacuuuguuuuaacagaauccguuauguaaaauauuuuugaaguuagaauucauuuauauccugucuacuaccauugaugaacauauagugggccugcagauauugaaaaucaaucuugaaaugaaugaugaucugugaaauuuucagugaaugagaguuacacaacuuaucacaucuuaaguagucucuuuuauguuguaauuccuucaaaaauuugaaauccuuuuuagggcauuauuuauuuauuuuuuuacuuguuuauucauuuauuuugucuuucucuuuuuaaaggaucuuucaaacaaucaucuuacaacuguuccugcuaguuuuucuucucuguccagucuggugcgacucaaucuuucuaguaaugaacugaagaguuugccagcagaaauaaauagaaugaaaaguaaauauuuucuguuuuacauaauacauaaauuugaaguuggugcaacuuacauuuagaaaguaauuuuuaauauaguuacagagaacuaaaguaguagauuuuuauagugguaaaugcaaacaauagcaacuagucagauuuucuccagaccauuauuauguaucaacugucuaaagaaauaccaucauaaagauacuuaggcauaugaaaaagaagaaaauaugauuauucguuguaguaggauuauauaccuaagcuauacugucuuucauucauucauucaacauucauaaagagguuaguccccucuuacuggugaaucuaccuaugauauuuaguuguauuauagcuguagccuccucaugguccauaaguaauaaugucgagaaauaagucuuguuuugucugaggucccagguugucaaucuuuuuuaaaagaaccaaaaugucaaaauuuauugguucuguuaaaauuugccaucaaaccauaauaucugaaguauuguagaacuaacauuaagggauuaaaaaagucaagguacauuuuaguaccuuuuaaauuaguauacuucaauauaaaauucuuaagagucuaaaaucauuagugauuuuuuuguuuguuuguuuaaagaaacuguuauuaccaggcacuguggcuugugucuguagucccaguuacccagguggcugaggcaggaggaucgcuugagccuagggaguucugggcuguagugcgcuaugccaaucggguauccacauaaguucagcagcaucauggugaccucccauagugggggaccaccagguugccuaaggaggggugaaccaacccaggucagaaacagagcaggucaaaacucccaucugaucaauagugggauugccccuuugaauauccacuacacugaagccugggcaacauagugagaccucuucucucucucucaaaaaauaaaauaaaauaaauuaauaaaaaaacuguuauuuuguaacuauuucuugguugaugguuagccuuuuuuuuuucugaucauuuguaagccuucuucaauuuuaaaaccucccuuuuguuuggcaagucauagaaaugauugccugcauucaauugcagauaguuuugagguaaauuucuaaaauuguguuguuuugcuuuagauuaauaguuauuuguuguuuaaaauuggaguuuuaaaauaaguuaaaucugcccuaaaucaaauugacauuuuaggggagucuuuaccugggauaccaauaguuaagauuuugcuguauuugucauuuuuuucaauaaggauauuauaaagagcagcuaaauguaaaauauaucuagaacgaagacauaagcagcauggacuuuuuucauaaauugaguggaaauaucuugagagauaggaacaucucaacuuaaguugauaaaucaacuuaaaaauacauuugaguuuauaguaauuuuucuaauauccaguguuauuaaugaccagaugcuuuuguuucucagccaugacaaugauacuuuuaagcuguuacacagaguacauuuaguuguacuuuaacagaguaccagaacuuuauuuuuaaauguauuacaaaaaugaccgggacuguuguuaaauugcccaggcuggggugcaaugacaugaucauagcucagugcagccucgaucucccagacucaagcauucuuccugccucaaccucccaaguagcugggacuacaggcaugcaccaccaugcccagcuaauuuuuuuuuaauuuuuaguagagacgauguuucacuauauguugcccaggcuggucuugaacuccagaacucaagugauccgcccaccucgggccucccaaagugcuggcauuacagcacaacuggccuaaguaauaauuuuuauguuacuauuucucuuuaauuauaauuaaauguagaaaaauuuacauuuauuuaauucagugguguuugaauauucuugauuauauggcacagguucauaaguccucauagcgauuucuuacacauucuuuaaaguuguauacgaucagaaacuaauuuuuuuuucucuauuuuuguuuuuuacugaauauauauuacaggguugaagcauuuggauuguaauucaaaucucuuggaaacuauaccuccugaauuggcuggcauggaaucacuagaauugcuuuauuugcggaggaauaaauuacguuuucuaccagaauuuccuucuuguagucuauugaagguacuauuuaguugauuauuaaauaacuauauuuuccaaaaguuaauuauuaaaaugcauuuuuaaaggagcuaaucuuguuuuacauugggaguguguauuaguuauaaguacuguguuuuuccuauguuaauacuuuucagaauuuuaauaugauuacuuacauuaaugguauuuuuaguaauacauuuuuuaaaagaaauaauuuaaaaaauagagauuuguccauuucaucugacaaguaguucauaacuggagaaguaguagauaaagaggcuaaaauuguaaguaggagaccuggaauaccaaccaggauuauguaccuaauucuauaaagugucaccucucaccuuuaccuaaucauaaucaaguauguuugaaaugaauuacauucuuuuggcuuuaaguguguagaauuaauggugucuuguaaauuugccaugauuugccuuuuuuauauauaccuuuaagcucuaguguuaaaagaguuuauuuuaaacagagugaugauauauaaaaugaacugaaaaaguuuuccuuuaauaagaauaauuuuccaucugauaauuauaguuucuauuaauggcaaaucaguauauaaaauaaucacuaaugaaaauguuagguaacaaacugauuacaguugauccuugaacaaugcaaagguuauaggcauugacccccauggaguugaaaaucuguguguagcuuuugacuccccaaaaacuuaacuaguaguagucuccuguugaccagaagccuuaccaauaacaugaacaaaugguuaacacauaauuuguaugccauauguauuauguacuauguucuuacaauaaaguaagcuagagaaaagaaucuuauuaagaaaaucauaaggaagagaaaauguguuuacuauuaauuaaauggaagucagucaucauaaaggucuucaucuucauuguccucguguugaguaggcugaggaggaggaagagaagggguuggucuugcugucucagagauggcagagguggaaggaaauccacauauaaguggaccugugcaguucaaaccuaaaacccauugucauucaaggaucaacuguguuuauaguaccaugcuguauugauaccauaaguuuauaucaucugcuuacaggaugaaucaucugucugaaauggugagcaacuuaaaucuaugguauaugucaggcaauucaacuuuucuuguaaugucaugacuuuucucugcuucuugggagaacuuucagcaucacuaguggcacuucauauuagucccaugauguuauuugaaauuuaugguuuugcacuaaacaguaugagaaacacaugagaacugcaagagaucauuuuuuacugugacaugcaauuuacuggagagcugaacugcucaccuggaaaugauuagcuucauacagguuuuaaguggauacucacaacauaggcucaccacaguaccaacaagaaguggcaacaaaauuauuauaguaguacaguguguacuacaguuaauuuuauguaguuaugauuuuucuuuuuuugaggcagaaucuuugauuuauuuauuuuuuuugaggcagagucucgcucugucauccaggcuggagugcaguggugcaaucucagcucacugcaaccuccgccucacgaguucaagugauucuccugccucagccucccgaguagcugggauuacaggugcccaccaccacgccaagcuaauuucuguauauuuaauagagaugggguuucgccauguuggccaggcuggucucgaacuccugaccucaggugauccgccugucuccaccucccagagugcugggauuacaggcgugagccaccgugccuggccuaguuuuauguaguuaugacugcaucuucacauuuguuuacauuucucuguaaguuguauguaaguuuugauacauuuuaacuuuuuauaauagauuuguauauauuuugugguagucagugauaaacuaguaucuacauauauuaaaugcauucaugacauauguaacuuuuuuuuauuuuuuaaauguuuuuaggcuacacaguugguuugcaaguguuuucaaauugucacaaaucuccaaauaaaauuucaauauauuuucugaaaaaaauuuauauaaaaguggacccucacaguuuaaacacuuguuguucaaggaccaacugcauaauaucaauaacuuuuuaaaaaacugauauuacuuuguuuugcaaguaguuuuuggauuuauauuuuuauuauuuaaauguaacuacuaaauuauuucucuacuuugguuuuuuuuuuuuuuuuuuuuuugagauggauucuuggucugucauccaggcuagagugcaauggugugaucucugcucacugcaaccuccgccuccuggguucaagcgauucuccugccgcagccuccugaguagcugggacuacaggcacgcuccaccacgccuggcuaauuuuuuguauuuuuaguagagacgggguuucaccauguuggccaggcuggucucaaacuccugaacuugugaucugccugccucagccucccaaagagcugggauuacaggcgugagccacugcacccagccuacuuugguuuuauaaacuugauguuucugccagauucaaaguuuaauuauuuuuaaauugccaaaaaauuuucucauuugccauucuucuuuagcugaaagauagccuaaauauaauugaaaauuuaaacaucuugauauuuauaaaguugcauuuuuucuauguguuuuucaaucacuugaaauuaagaguaccuacaauuuuauuuucauuaucuacuauaaaauugaauacagagauacacauaacucaucuuugauuuuguaggaauugcacguaggugaaaaccagauugaaauguuagaggcagaacaucuuaaacaucugaauucaauucuugugcuagaccugagggauaacaaguuaaaaucuguuccagaugaaauuauacuacuacgguccuuggaaaggcuugaccuaagcaacaaugauauuaguagguaaguuuaaauaucaaaugaauagaaauuguguuuguauuugguuauaauucauaauuugaaauauuuguuaaaaaaccaagagguuccuuuuuucuaaauugaauucacuaaauauugauugagcaguaguuauguacagauaaagauuaauuagguuuugucuuuaacagcaagcuugauaugauaauagaagcagacauauuuaugacuuacucuaacuagauuaucauuaguauuaguauuauuacucuuacuagaguaaaauuuaguucuaguuacccccuagaacuaaauucuaagaacgcuggaaugaauuuacuuuaaaagccuugccauagcacuguuucccaaauauggguacguuuuagaaucauuugagaaacauuaagaaaaaauacugauucugggacgcuaaugaaucagaaucucugaugacgggacccuagaauuuuuguucuuuguuuucuuuaaaacaguuccuagaauuugaugcuucuggucuuccaaccagcaauuaauugggaaccaccauauuguaagauaaacucuagacuuuuuagccugacauucaagggugccuuacaaucagacuuaauuuaucauuugucaucuuucgcucaugcaggugucuugcucucugacuacauugagcuauaaauauaccaacccuuucuuuguuuuauuccuuuacccuagaaugcuuuuuuuuugccuaauaguauuugauuuuucacuuuaagcccaaauccgguuuuugcuacucccuucuccccuguaaagccccaccagugucuauauuucuacucucauagcaacaugacuuguuuagcauuugucuuauuauauaugcuuuuuauaucauauucauuuguuaauauguaacuuauauacaauaaaauuuaccaaucaagcauacaacuugaugauuuuuggcaaagguauauauuuguguaaccguaaucacagccauguagaacauuucuaucucccuaaaaaguuuccucauaccuuuugcagucaauucccuuuccauaccccaaccccuggcaaccacuaaugugcuauguuacuauaguuuuguccuuuuuagaaugucacauaaauggaauuacauagaauguaguuuuugugucuggcuucuuucauguaacauaaaguuuuugugauucaugugguuguauguaucaguaguuuuauuuuuauugcugaguguuauucuguuguacagagauagauauaccgcaguucaugugucuuuucaguaguuaguugauggacauuugaguuguuuuugauuuuuugcuauuguaaacaucugugugcaaguuucuguguggacauuauuuucauuucuccugaguaaacguguagcaguguguuugcuuaguuguauagugaccauauguuuaaaagacuccacuuucgaaagugacuguacuauuuuauauucccaccagcauuguaagauaauacuuauuauauuuuaguuagcuguauguguuuuuuuccuuuguuuaacugaggacuugagaacaagaaucuugauaucgcuauaccagugcccuauauuuuguagaugcuuaauagauuuuauugauauugaauuuuuauguaugaaugguuuuuaaaaugugccagagaugaagaugacuuucuuuauugaauggaaacaugaauuggacauucaaaaauuaucuuuuucuauuugucaucuuuuuucaauuagaauuuuguuuccuugcucuaagugcaaaaucaaaacauuugguaucagugaggaugucuaucuugaaucacugauucauucaaauuuauguuuaacauuuacuuuuuuagcaaauguuauaauuuaacaaauguuuuauagcucacuuuuuuaaaauuaaucucagcaugacaauuuugaaaacaaaucugauuuuuccuuuauauguuuagcauuuaucuugaaaggaaauguuuuaggucugcauuacuuggccuuucuuugagacuauucugugauauguuguuugccauaugauguuuuauaguuaacuaugguuggaguauacuuauauuugaugcuuucccugaaaucaauuuaaucuuuuauagucuucccuauucauuggggaaccuucauuugaaauuuuuggcauuagaaggaaauccuuugagaacaauucgaagagaaauuauaaguguaaguauauuuggaauucagcucuuuguuaaauugaaauucagacauauauguugaucuguaaaacugcaaagcaugucuuggugaaugucuuugucuccacccuucuagaaaggaacacaagaaguccuaaaauaucuacgaagcaagaucaaagguacuuuaaaauguucucuuauauuuugaaggauucauaaaaaguggugaagaauuaauaguacauaaauuuaaaugucuuuuggguauacauauuuggaaguaauagauccuggcauguguggcucuaauucuaaauccauauagucuguaaguaugcugagguuauaaaaauaucuuuaaacucacaauaauaauguacuaucuguaaucccuuugaauuguguuaagucugccaauuaggaaauuuaacaaaaaagauucaguaagcacuuaguacuucaacuuugaaaaaggaguaaaacuugacuuucaggauauauggguucuauugacuagaaaguauauugacaaguauuucauuaucuauuuuucgugcacagcuuugcuaaacucugacaaaauuuaagacaaaacauacuuuucaggguauguuaauuuagcaagaacauguaccaaaagugaaaauaauacaauaaacuuaauuuuuaauaauucacuaaacaugucauauacccaauuuuuguuucaugucuaucauuauagaauaaacuaaaacauuuugaaaaaaaaaaguaguuguacgagugcuaugcuaagaaacaaaccacuccaaaacauaauggcuaaaugcaguagcuguuaauuuaccucacaacucuguugguuaugcauagcuuagcuuagcacuauguugccagucaacauauauuaaaugaguaagauaauuguguaguuuagcuauuuuuucuacuuuauccuucaagugaauuauuaaaauaauuuucuaagacucuuauuuucuaccaaggaaaguguuuccuucuccaaauaugcuuucucuuccagaacaaauugauuauucugucaugaaucaguuagaggucaugucagacugaucaaaauuuuaugaacagaaagccaagaugaacuuaguggaaguuacaguuauaugcaaacauuucugcuagacagcuucuauccaaagaugggagagugaauccaugcauauaauuuuauucuuuccagaaaccccacaaaaagaaaauugguaauggaaauguuuuaaagguguacuuccauaaagauagggagaaugggggaaaaauaaaauaauaaacauguggacauuggaaagugaguuguuuagucaguuugggcuacuauaauaaaauaucuuagacuguaauuuauaaauaacagaaauuuauugcucaugguucuagagaacugugaucaaagcaccagcagauuuggugucugguaaggaccuguuucucauagauggcaccuucuccaugcuuucagauggcaagaggagguuaaugagcccccaagacuucuuuuauaagggcacuauucccguucaugaggguucugcccucaauaucuaguuacuuuacaaaggcccuaccucuuaauacuguuaccuuggugguuagauuucaacauaggaaauuugggguaacacauacauuuaggccauagcauaagugaacaaauggugacugaguuaguagaucagaaagaccuuuuggcuauuacagauaaugcuguaauaaacauucuuguacagguuucagugugaauguauguuuucauuucucuuggguguauauaccuaggaguaacauauuucucgaucauaugauaacucuauguuuaaucauuugaagaacugccaaacuguuuuccaaagcaacugcaccaauuuacauucucaccaguaguauaugaguguucugauuccccucaucaacauuugucaucauccucaucaacauuugucaucugacucugauucuagccaucuuguugggucugaaauggcaucuuauuguggcuuugauuugcauuuuucugaugaguauuaauguagagcaucuuuuccugugcuuuauuagucauuugugcaucuuuagagaaauggcuauucagauucuuugucuauuuuuuaauuguuuuuuuaaaucauugagcuguaaguguucuuuacauacuuuagauacaaauccuuuguuaaauauaugauuugcagauauuuuauaguucucuguggguugucuuuucauuuucuugauguuguucuuugaaguauaaaaguuuuaauuuugagcaaguccaauuuuucauuuuuuuuuuguucauuuuuuuuuaaaucuaagaaagcuuuacaaaauccuagguuauaaagauuuggccuauacuucuaaacauuuuauaacgccauuguuuuaaaauuuaggucuuugaucaguuuugaauuacuuuuauaugcagugugagguaaggguucaauuucauuguuuuguacauggauauucaguuucucagcaccauuuguugaaaagaguauucuuucuacuuugaauggucuuggcauucuuguaaaaaaucaacugacuauaaauguauugguuuauuuuucuaccaucaguuuuauucuguugaucuauaugucugaccuuugccaguuccacacugucuugauuaccauuguuuuguaguaaguuuugaaaucaaaucaggaagauugagggcuccuacuuuaggagggcuccucuuguuucucaggauugcuuuggcuauuauggauuucuugcaauuccauaugaauuuuagaauuaacuugugaauuucuacaaagauaaaguuuaugcauuucuguagaucaguuuggggaauauuauccuaacaauauuaagucuuccauucaugagcauggaauguuuuuccauuuuagaucuuuaaucucuuuaaacaauguuuuauaguuuucagacuguaaguuuuauacuuguuuauuucuaagcauuuuauuccuuuugaugcuauuaggcauauaauuguuuucuuaauuccauuuuugugcuguucuuugcaacuguauaggaauacaaugauuuuugaaugcugaucuuguauccugaaaccuugaugaaacuauuaguuccaauaauuuuuugauguauuccuuuggauuuucuauauacaagacuauguuguuugcaaauagagauaguuuuacuucuuccuuuccaaucuggaugccuuuuauuccuuuucuugccuaauuccuuuggcuagacccuccaggacaguacugaauagaaggacugagacuggacaucuuugggggaaagcuucuaguuuuucauuguuaaguaacauuagguuagcuguggauuuuuuguagaugcccuuuaucauguuaaggaauuucccuucucuuucugguuuuugaguguguuuguccuaaaagaguuguugaguuuuugucaauuuuuuuucugcaucuguugagauggucgugugauuuaaaaaauucuguuaauaugcuguauuaccuuaauugauuuucagaugguaaaucagcuugcauccaugguuaaaucccacuuaguaaugguguauaauucuuuguaaauguugcuagauuuguuuuuuaguguuuuguugagaauuugagaguuauucaucuguuguuuucuugugauuuuuuuuuguuucugguuugggugauagccuaauaauggcaucauaaaaugaauugggaaauguucccuccuauuuuguuuuuugggugaauuuaugaagaguuguuauuaauuuuuugaauguuugguagaauucagcagugaagccauuuaggcaugggcuucucuuuguggcuagguuuuuuuuauuacucuucacguguuauagauauacucagauugucuguuucuucuugagucaguuuugguaguuuuuaucuuucuaggaauguguccauuuuaucugaguuguuuaauuuguuggcauauaguugccauaguuuauccuuuucauuuuuguaagguuaguaauaauguccucucuuucauuucugauucuaguaaugugagucuucucucuuuuuuucuaggccacacuagcuggauauuagucaguuuuguugacuuuccaaaggaugagcguuuaguuucauugaucuucucuauuguuuuucuguucucuauuucauuaauuaacacucuaauuauuuauuuccuucuaauugguuuagguuucuauugcaguugugacugacuggggccagcguucugggugguuaaagaauuuaccaagacaguuguaguaaagaaaggcagauuuauuagagaaaguacaaagauauguugcaagggugcaacaaguagcacagcagagaaggggcugucugccaagaggcaggugcuggaggggaguuuuauagguucaugcuuggagugggcuauguggaacgaggucuugcugcuggggcuguguacagagcgagguauuugggaacaggauguugugccagcaaguugucugugauuagaguugucuaugauuagcugucucuuggaacaauuguucucccccaccugggaccccuuuucauuguugcuuacuuaucucaucaggacuccagaguuuaguuuguucuuuuuuucuaguaucuuaggguggaaaguuagguuauugauuuugggaucuuguuucuugacauaggcauuuauagcuaaaauuucccucuaagcauggcuuuaucuacagcucauacguuuugguauguugugucauuuucauuuaucucaaaguauuuuaugauuucucuuuugauaccuucuuuggcccauugguuguuuaaggauauguuguuaaauuuccauuauaaugugccccugacauaaaaaaauguuuugagucuguuuugccugauacuguuauagacacucagcuuuucuguaguugucuuauuccuugguucucuccugugagcuagcuuguguacagucugcuuguauacagucuaggcuguaucuucaguagauccaggaauuucaucccaacugccuuuuaccauaaccuucauuguuuuugagagcuuucaugcuuuguugugagugaagucaguucccuugggaagagauuaggaacuguuuuuaugaccuguuucucccccaggcaaaaucuuugagcacaggcugugaagcugggaauauggaagauggcaagcuucucuaagaguaacacucuccucuaggagcugaacacucaguagaaggagucagcaauagacuuagguucucuugguuugccucuccuuucuuugaaccagcaacuuaugagccaggggaagagcagucagggccccaguauucucaucaugccaagcucaagguagagccuccuuucugugcaugugaccagaguggaagaagggaguccucacccuacucaucagggauuuagcauuagcaacaggaagcugguggcaggaugagaaaugcugacacuccucucaggaagaaagcccucuggcugggagauaggguuuggggcuggaggguugggggagagggaacccuguguucucaguuguagccuucuggaguggaguuucugccucucugaccuagaagaggggagagagggagcagucuagguucaaauaccacagacucaccucuuacaaaauuuccauagauuuucuugaacagcuauuucuucauuugcuguuugcuauuagaaucauuuccaaggccaggcgugguggcucacgccuauaaucccagcacuuugggaggcugaggcagguggauuacuugaggucaggaguucgagaccagccuggccaacauagugaaaccccaucucuacuaaaaacacaaaaauuagccgggagugguggcacacaccuguagucccagcuacucaggaggcugagacaggagaaucacuagaaccuggaagguggaggcuacagugagccgagauugugccacugcacuccagccugggcaacucagagcaagacuccaucucaaaauaaauagaaauagaauccuuuucagaggccuuaaauuauuauuauuuuuuguuuuuguuuuuguuuucagacagagucucauucugucacccagccuggagugcaguggugcaaucucagcucacugcauccuccgccucccagguucaaggaauucugccucagccuccugaguagcugggacuacaggcaccugccaccaugcccagcuaauuuuuuuuguauuuuuaguauagauggguuuuugccauguuggccaggcuggucuugaacuccugaccucagaugauuugccugccuuagccucucaaagugcugggauuauaggcaugagccaccacgcucagcucaguauucuccuugaccuuuuucuuuuuucuuuuuuuuuuuuuuuuuaacacuuuuuaaccagcuuuucugcggagcagauuaacagagcuccucuugcugucaugauggaaguugaucucugggaaguauauuuucuaugugaaaucuacacaaaaggagaacaaaaauugggcaaaacuagcagucugccacaauaagcaauaauugaaagcccauuggccaaaugucaguagaaucuuuuacugagaacuucuccauauauguaucuuugccuucuucucaguuuuucauagcucuuuuaucuuucaucccuuuauguugucucuuucccuguuucuuucuuuucuuuuuucuuuuuuuuccuuuuuucuccuuucuuuuggggauggggaaaauuuuuuuagaacaggauuguaaagcaagggaaaaccaagccaaaaacaaaugcauguaaggaauggccuuauuguuuaagaaguucagaaguagaaaauauccagcucagcuacuuuaaaaaauaauaaaaagaggaauaucucaauauaaauauucaaagccugagagaguaauuuacuuaaaaagaauuucuuuaauuuuugauuuuuuuuuuuuuuauuuagaagcgaggucuugcucuguuucuugggcuaaaguacuguggcacuauacuaguucucugcagccucaaacuucugggcucaagcaauccuugugccucagccuuccaaguagcuaggauuacaggugugcaccacuacaccaggcuauuuuuauuuuuuuguagagacagagucuuguuauuugcucauucuggucuugaacucugagacucaaaugauccuccugccucaccucccaaaguguugggauuuacaggcaugagucaccaugcccaggccauauuuauuuauuauuuauuuguugcucugcuucuugccaauaauuggucauauuauuaacaucuuaccacucuuccuucucucccugguuguucaaucacauuuaaauaaucccuugguauuuccugacauuuguaguuucugggguuuaauuaucucuuccauuuuucuugguauuuguacagguauacauacuuagaaaauacauacuuagaaaaucccuuuggacuucaaaauagguugaauuauucaaagcauauauuggcaagacucuuaaaauugugauaaucauauggagaacaauuaugugugugcauaaucuaaggggaauuucaaauagaacugaaacauuuauuuugaauuaauacuuaacuuugcacauacauacaaaggcccaagacuuuuuccuuaucaaagcauaacuuuauuauuuauagguaauaaguauuuucucugugaaaagaugcucagugaaagagcaaucuacauacguaucuagaggcacauaagaaucaccuguggagcuuuuuaaaaacuacgugcccaggccagacuuuagcccaauuaaaucuggauuuugggguaauggggccuaaguauuuaaacaguaguuagaguggaauugcauuuaauuaucucuaaauuuucuggagcucuuugaggaaaaaguugggacacuucauugcuucauauuuuuuuuuuuccuucagcuuuucuucucugcuuuuuaacuacucuuuucucaguuuuagagguagaaaagggauuggugaaaauugaaaacagugccgaucauuugauucaaaggaugcugguaaaaugagauaaaaacuuuggcugaagugaguagagacugcuaacuuuaaagaaacugaacaauccagaagcaugaaguuauguaccaguuuaaaauaaacuuucauuaaaaggcacuugucugugaugcuucaaauguagaaaugugguccacagauuccucagacuccacugugucaaagaaaaaucuuguucucuuuuaaagcuuauuaaguuuugguugugauuaauuuauauucuucccagugucuagcagaagugcaguaauucauguaggauuuagauaaacuuucugcaauguacuguuauuuaccuuuuccuaggaagaguacauauacaagucccagauauccuacaaauauaacucugaaauuguuauuauuuuugaaaaauuaaucuuuuucuagaguacuuaaaucauucuccacagaugaucauuauuauaauuuuuacauuuuaauugauguguuguuauguugagccuacacaucucuaucuguagaaugcagauaauaccuuuuugaaagguguguuuugaggaucacaauuucaugagguagcauuguguggaauuacccuacaauguccuugauucaucuaaauaguauuaaaccuucuuauuugguuaucacagacuuucaaauaauccugauaguuauuuacuuguucucuguucuacaucaauaggcuagguaaauaucaauggacuauaauuuaaaaauuuguuuuuauuguuuauaaaauaucuuuuuaaggacuggguuugagguuugcaaguuagcaaucugacaugcaaaucuuacacucauuacaguuugugauaagcucaaaggaucgauuuuagauuuaaaaaaaagacccuuguaagaagagcaucucaaguuggaauguuaagugagugcagauucuaaagccuccccaguuuauuggcgggagauauguuccaguggugaugauacugugccugccaagggugagguccugccagauugguaaaauuccccagugggugcugcugugguuucagugaugguuuccccucuacaauuuuguugagacuuaauccccagugcaacaguacugagaauuguggucuuugggaggagauuugaaucuuaagggcuccacucucaugaauaggauuggcacucuuuuuuucuuuuuucuuuugauauggaguuucgcucucguugcccagguuggagugcaaugucgcgaucucggcucacugcaaccuuugccuccuggguucaagugauucuccugccucagccucaugaguagcugggauuacaggcaugugcaaccacgcccggcuaauuuuguauuuuuaguagagauaggguuucuccauguuggucaggcuggucucaaacucccgaccucaggugauccgcccgccucggccucccaaagugcugggauuacgugugugaucccagccacugcaccuggccggauuggcacucuuauaaaaaaaggguuugagguugaaggcaguguucucuagcacuucugccuuaugccauaugaggacacagcaagagcgcccccaccagagaccaaaugcugggccuugaucuuagacuucucagccuucacaauugugagaaauaaaugucuauuguuuauaaguuacccaguuugugguaucuuguuauaguagcacaaauggacuaagacaggugccaaccccaauuaugccaucguggcauuaagcuuaauuacuuuauuugauugcaaacauugccuuuauucaagcucuaucaccugauucugaucuguguucugaguuuaauuucuugcuccgucaccaggaucaucuagcuaugcuaccuuugauagacauaauaaugacccuucaaugauggccacacccuaaucccugaaaccugugaauggguuaccuuacauggcaaagggcaauuaagauugcuaauugacugacuuuaaaauaaggauauuauuaugaauuguguuggcccaauauaaucacaaggauucuuaaaaguagaagagagaagcagaagaggaggucagcguaauaggaugugagaagaaccacuguugcuggcuuaacuuggaggaggaaggccaugaagcaaggaauaugagguggcuacuagaaguuggaaagggcaaggaaucagauucuuuuuagaaaaaggaaugcaggcugggggugguggcuuacgacuguaaucccagcacuuugggaggccgaggugggcggaucagaaggucaggagauugagaccauacuggccaagaugaugaaaccccguaucuacuaaaaauacagcaauuagcugggcaugauaaaguuccaugguggcgcgugccuguaaucccagcuacucaagaggcugaggcaggagaaucgcuugaaccagggagucggagguugcagugagccaagauggugccacugcacuccagccuggcaacagagugagacuccgucucaaaaaaaaaaaaaaagaaaaggaaaggaaaaaggaauacagacuugccauugccaaaccccugauuuuagcccaaugagacccauugcagacuugugaacuacaaaacuguaagauaauguuuguguguuuuaagucacuaaguuugugguaauuuguuaaagcaaccauagaaaacucauaaauugggcauaaaauaauuuaugccaguaaauuauauauuaaugaauuggaaucauauuuuuaguuucuuugcaaucuuguacuaaggaauagucuuugggcaauuauugucucuguuaucaggcuuaggauggacucuguacaauagaccuggccauaguuuaucacucacagugucuuacucauuuuuauguccccagcacuuaguacaaugacugccgcagaguagaagcacgguaacaguuugggggauaaaugaauacauuuguaguaauuagaucuagacccagggauugcuacugguuauguauuaucaauuuauguucaucaucuuucaugugauaaaaguggggugcuucacuaaagaaauagguuuggauauuuaguguccauuggccucaccuggagggcuuggugaaccagauugcugggcuccacucucagaauucaugauucauagguuugggguugagccuggaaauuugcauuucuaacaaguucccauguuagggugauguugcuguucuggggaccacacuuuggggcauuuuaugccucugucccucucagaugucuccucaggggacaaacuagcucugcauguucuccaagaacuaucugcuuuuuuuuuuguagccacccacuccauccuuagggguuauacucuacaggccuggcuaacacauuuaguaguuuuccuaagguucguucuuccaacccccagccuguugccucagaaaaugaugguucacuuaguuccucucauuuuaagaguaauacaggauaauaaaaucaaacguuaaaaaaaucuaaaaaaugaaauggagaaguuuaaaagauggcaaauucuuuucaauucuucuacuauugaaaagaacuuguaauuucucacuccauucugaggugguuacucucuugggaauuacccucaacacauacugcucccauaaaaauacauucaacauacauauauuacuguacuuaccauacuauuuuguaauuuuuguuuauuuuguccacuagaucgaguucaucuucugucuucgucucuuacuuauaauaguaccuaccaguuuaugugugauggauaauguuauagaaugaaggaacaaauaaauaaccaaauggacucuaguuuuuuacucuuauuucuaagagacaggaucaacagcuuuuccaaccccuucuaaaccuucuggagaggcagagugaucagugccuauuugcuucaaagggauaaguugaagcucugaagacuucguucuaggugacacucguucaacuaaaucacccaucaugcccuccaaacucaccaaaugaauacauuugaaaauuucuuucuuucuuucuuuuuuuuuuuuuuugagagggagccuugcucugucgcccaggcuggagugcaguggcgcgaucuugcacugcaagcuccgccucccggcuucacaccauucuccugccucagccucccuaguagcugggacuacaggcguccgccaccggccaaaaauuucuuaaaaagguaucuccauggcugggcgugguggcucacgccuguaaucccagcacuuugggaggccaaggcaggcggaucacgagaucaggagaucgagaucauccuggcuaacacggugaaaccccgucucuacuaaaaauacaaaaaauuagcugggcgugguggcgggcaccaguagccccagcuacucgggaggcugaggcaggagaauggcgugaacucgggagguggagcuugccgugcgagaucgcgccacugcacuccagccugggcaacagagcgagacucccucucagaaaaaaaaaaaaaauaaugagauaucugcguucuugcuuaugugauugaccucuuauuuggcuguguucuugucagucacuuguacaauuacaacuuuuuuuuuucucucucucuggaaaccuauaggaucuucuauucguugccauuguuugaaauuuuaugguaauuaacuuuggugugguucuacuuuuauuuauuguguuuggcacuuacauggcccuuucaauuugaaauuuugauguuuuuaaaaauuauguuuuuuuaaugaaaaagacaguaaaugcacaugguuaaaaaaaacaacaauacgcaaagauauauaaugaaaggaaaucucucucgcaacagucuucuccccagagacaauagacucucuccuuauauucuccuugaugcuaauuauuaaaaggagcucuuuggaaauuguuaagaauacccuaccucauuauacgaucaugguaguauacauagauauuuuaaaaacaaugcuggauuuuguugcugguuuaauagugucucucugcuuauuuaauuuuggcacuguauuacauauuauuuaaaguaacuuaaccaaacugcuaggggaguaguacuacuacuagagcauuaacuugauguuaauacuuuccuugaugucuuucauuucuguuugauauucugucauuuauucugugcuacuucugugaauaaaguauucauaugauacuugccugggaagcaauaauagcuuaaucauuauugacuaaugaauaacugaugagcucaaugcaagagaaauauacuuaguaauauucaacaaauguuuauugaaugccuacugggcugaagcaagaucagguauacuacuaauuuuuuuuguuuucuuuuggcgugccuucugcucuuaugugcuaaugcugggacuguuucaucguuuucacauuguugaaaagugauagucuuauuuuacuucucuaucguucaagucuuuuuugcaaaaauaacacaaagccauuucuuuuaaaauguguauuuaaaaaaauauguauaccauaugaugacaguguuaaacagucucuggagauuaguaaggugguugauggugcgugaaugugugaguaugcaagcauguuaggaaaauaucuauaaaaaauaaagucuugcauuuguuaagaaaaaaaucuuaacauauaaaauguaccagagacuuacucaguuaugcagauugucaaauuucaagugauugaggauaaucaauuuuguugucuccuaaauuaaaaagcauaugcuuauuugguagacauuugagggaaauaaugguuuucuuucauuaacaaauuucuucuaguggaccauauuauuuuacuuaagaggaaggauuacuuguuauuuguuucuucuuauacaucauaguuauucuaugaagguucuuucuuacugcuaaauuuccuuucaguaggauucauuaaacaguuuugaagccaugcuacaguaauuuuauuuucuauuaauuaaauauuaaauuccagauugagauuugagucauuggaaauaaagcauaugacuaaaggcauucucaccaauaauaucuagaaaucacguacacuguuuuaauauauuaucaagaauuuuaacaaugacuuuguaguauaaauauuggcuucauauaaguuuucuuuugccagaugauggaccuagccaaagugagucugcuacugagacugccaugacacuaccaagugaauccagagucaauauacaugccaucauuacauuaaaaauauuagacuauagguauguaauuuauuauuauuuuuauuuuuauagagauagggucuuacuguguugcccaggcuggucuugagcuucuugggcucaagccauccuccugcuuuggccucucaaagugcuaggauuauaggcuugagcuaccaugcuuggccuaauuuauuuuuuuuuaaacauuaccaaacacauaggaaacuuuucagaaagaaacccuucaguaaaaaggacaauugaugaggaaaaauucaucagaguacuugacuuagaguaauaauaauugcaaaaaaccaugaugaaauagaaggauauuaaaaguauaauaaaaauagaaggauauuaaaaauauaaaugaccuucaguguccauuccuucugcaguuuguguuuuacuaugcuugagagagagaugguuuuguuaauagugauauuuuuauaaugggaacauuuuauuguuauaaaaaaaaagaaugacaguauugauaauaaaguucuuugacucaguaaucagcauccaaagagaauuucauauuggugggugucuauguuaguaaauaagaaacuaguauuuuaguuaaugaaaaccuugaccagcaggcaaagcuugagagguuguacccugcuaauuuaucugaacacaagucaaauaauguaucauaguaauaaugugcugugguagcaaauauuccaaaacugaaaaaauuacaauguuaguauauaaauugagacaaagccaaaaaauuuuaaauauuuuuuauggaaguauaugaaauugggaaaagaagauaccuaugcagagauugaagguaguuguaaaguauccuuucaguacugucuaaggcaacaacaacaaaaacauaagcaauacugucaaaauuuuuguagcaauugguucauuuauggguauuguagugaaaauacaaaagaauauagacugaagucagauaggugacuagauuuauucaagaaucuacacagccaacaucaguguauggucuuuuauccuuaauguaucaguaggaacuaucuucuuagcagucaggauacagucuccauuucacauuuguuguguuucauucauauuguucucaccucuugccugccacucuuagaaaucacuacucuaagcuaaguuucuuuugccacgcuaacacagguagcacucuucuguacuuacauuugacucuuucuuacagagcauggcaacuuagcuuuuuuuuuuuuuuuuuuuuuuuuuuuugaggcagggucuugcucuguugcccagguuggaguacaguggcguuaucucggcucacuguaaccucaaccuccuggcucaagcgauucccccaccucagccucccaaguagcuggaacugcugcacgcuauccugcccagcuaauuuuuuuauuuuuuguagagauggggccucucuguguuacccaggcuguucuugaacucuugagcucaagugauccuccugccucagcuucucaaagugcugggauuacaggcauaagccaccaugccuggccaacuuagcauaucuuaucuuccaaauaauauacccauuuauucaguagauauuuuuggagucuacuaaguaucacauucugugcuagguaucauaaauaaacugauugaugagacagacuucauuccugccuuaggcuuuuuuuagcuuagaauuucuuuuaugccugacuucuggcuuccauucccucauauacagauaccauuuauugagucucuauucuaaggggaucuaggguguuguacuagguacauaugcuguugcuuuuaaucaugcagacaaucuauaaaguaguauugguccaauuuuauuugggauaaccauuucuacuucuuaaaggcacagauaucacaaaagcauaaucuuagauuacuuugauucuaaauuuauucggauuuguuuuucuuaaagacuuuaacuggaaaggagugucuuauuuaaaauauaaauuaucaaucucaaggcauaaaugcuuucaacuaaaauuuuuaaauagcaugaaucuuuuaagucugacuagcaugagucaguuccccaugaacuugagcauuugugauugaagagaugaaaaugcugcaucuacacagaagaaaaugggaugcuaaagcagaaguagaagguauaauaacugugaaauguaggcugucuuuacauauuuguauuacaaugcauuucuuauacaguucuuccauauuauacauuauauguaauguuuuucuguucauagucauucauuuggcauuccguugaaguuucuugaagguagaugacauuguauuaagcacuaauaauuuuaaaagaagaauguaaggauaauggcuaauuauuacauuaaaaaaacaguuaaaucugcaaauguuagaguucuauauaguagucccgcuuauccacaguuucacuuucugcaauuuggguuacuugugaucaggugcaguccgaaaauauuaaacggaaaauuccagauguaaacaauuuauaaguuuuaaauugugcacauucugaguagcaucauggaauuuuaugcuaucccucucugaccugcccucugugaccugucaugucucaugaccugggacaugaaucaucccuuugucagcauaucuaugcuguauaugcugcccauccuuagucacuuaguagucaucuuguuaucagauugaaaaaauaugguguauacuauauaggauucaguccucucagaagauucuggcauccccggggggucuggauaaaggggaacuacuguauuuucauuuaagauuaaauuuauauuuuauugaaaaccuuacugaaaauuuuaauaaagaggaaauuuauuuauauuuacauuugaaaacauguggcauaaauaacaauaaauaguccuucagauucuaaugucacagaacugagauucaggggagguaaguuauaaagcucauuaaugguagaaauaggaauaguuuaaucucaguccacugcucugucuaccuugucacauacuaaaggagagagaaauugguccagguuacuaaauuaaaauuaaacuaauuuuaaauuaauuaaacuaauuuuaguuaguuuaguauaauguugaacuuuuuaaaaaaguuauuaucuuguagaaauuauauacccaaacaaauuugacagaaaacuccucuuauagauuuuuaagauggggcaacaacuagcuuuuaaaauuauagauuuaauucuacucagagguaaaggaaugggcuccauuugcuauaugacuuguagauaucuuagacuccaaagauaaauaucuauuuuuauucacauugaguauaugaaugcccagaaaauguagcacaauauguuauaacacaauauguugucugaauuccuaacagugaaccuuuuauggcuugguagauuauguggcauuuguuacaaaauuuuauaaucaauggcuuugaaaaauuucauaaaaucuuuaaacaccuuuaaaaaugaagaguaauaaucauaucuuuuuggacugcuaagaaugguucguuuuuuaaaaccauuuuucauuuagugauaaacaagcaacuuugauuccugaugagguguuugaugcaguaaaaagcaacaucgucacuucuauuaacuucaguaagaaucaacuaugugaaauuccaaaaagguaagaacuaugaugccaugucuauagguugugacucauucuguuguuuuuccaucuugguuuuuaaauugguuuuuccauauugguuuuuaaauuuaaaacuauauguaaaaauuuuuacauuauuaauauuagagggauuuagcaaaaugucauuaaguauuuacugacacaauuuuaucauuuguucugagagguauagagguuuuaaaaaaauuuguuucuuuuucuuuuauguuuaaacuuggaaaauggguauaagaauuauuaaaaacauuauuuuucccauauaaugaaauauagggaauuauauauacucucacauaaugaaauauuagggaaaauuguuaagagacugucuaacaucagguccauguggauuaauaggaauuuccauuuggggcuuuauguuaaugaauugccaagccacuaauuuuuccacugauaggaaaagcaaaauuaacugaagccuguuaauauuuuucuccuagaaaaggauucuucacaugcagucauuugcuuuauacauuguacuguuaaauacauuuuuuguuguuaauuacagcaaaaucuuuagauuaugaguguuaauuuaguauauuguugaacuuuaaaaaacauuuguuaucuagcaguaaacuauauacccaaagaaagcugacagauaaucuagcaauuaaaacaacccaaugugagacaggauaggguacugauaaggaacuugagcaauauagucaauugcuuauaccauaucccagaccugcuguauaguuuuuggacagguuaacuagcuguucuuaguuuucucaccugugaaauagggauaauaauagugccuguuuauaagaauuaaacuaaaugacauaauccacacaaagcauuuaacuagagccuaaugcuuuuaugcacguaaauacuuaagaggaaaaaaaaaggugaugucguggaggagagugaugugaugaauugagaaaguugaaugacuuucaucugacuaucaaaaauuuuuuagauguuuaaagcuuuuaaaaagugagacaaaauauaauuugcuuucuauuucucagagcauaguuuagggaauguagaucuuaaaagacgacaaauuuaagauaguccauugcaaaagggaucucuaauccaucuucugguucucucuuguuuuaaaggacugagaggauauuugauagaauugagcauuuagauuugcucucagauaggacaaguuugcuuugggcgggggguccuggaucaaauaaguuaauugggaauaaagauauacuuaagagacauuacuuauuauuuacugccucauuuuaucucacuaucuggcucuucuuuugcaaaauaaugucauucuguugacacagcuauuauaucacauuuugagcaacuuagaaugucaagaaaauaaucaagacaugccuuauuacauggacauguugcauuaaaaaagccaugcuuuucucuagaaaguucccaaaccacuuucccuuuuuaaaaaaauuuuaaugaacaauucaugcuuuucaccaaagauuauaaaaauaauacauauucauaaaauuuuggaauaaauaaaggaauauaucaguuguaguuucaucacugauuuacucgguuaacuuuguggcauacugcauauuuuauuucaagcuauucuccauuuggaguuauacaugcaauuugugucuuuuuuuuuuuuuuuuuuuuuuugagacaggaucucacucuguugccccuacuggaguucacuggcacaaucgcggcucagugcacccuuaaccucucagguugaagugauccucccaccuuagccucccuaguggcugggacuacaggcauaugccaccacaccccacuaauuuuuguagagaccagguuuugccauguugcccaggcuggucucaaacucuugagcucaacugauccacuugccuuggccuuccaaagugcugggauuacaggugugagccaccaugcuuggccauaauuuguaucuugacugguuuauuugucauaaguauuuuucuguuuauaaaccauacuuuaaaaauguaauuuaacuguauacuuuaagguugauuaugacaauaaaggaaacauauuguuucucuaggccagauuucuagaaaaauuauuaagucagaguuugacucgauauaucaaaaaaaguuuuaucaaguuuuaucaguuacacauugaaacucauuuucuuuuacuacaucuuuuucagcacagcauuuuauauccuuucuuuuuuuuuucuuugcuaaugagauagacuaaguuguaauuuaacuuucauuugguugucuuuuuuuuugagacagaguuuugcucuuguugcccaggcuggagugcaguggcaugaucucaguucgcuacaaccuccgccucccaggcucaagcaauucucuugcuucagccucccgaguagcugggauuacaggugcccgccaccaugccuggcuaauuuuuuguguuuuuaguagaggcggaguuucaccauguuggccaagcuggucuugaacuccugaccucaaguaauccaccugccucagccuccuaaagugcugagauuauaggugugagccaccgugcccagccaacuuucauuuguuaguaaaucauauuaauaacaggaauaaaacuauaaaccuugauuaggcuuacuuagaaauguuuaauucuuccucuuuaaguuuuaaacuaaagcuccuuagugguaauacacuacuuauguaguagaaaacuacuauguuacaggaugucuguuuaacaauuuguuuuauggauucaaguuauuaauagaauaaaguauaaaaauuuucuagguuugauuuuucuccuucgugccauaguugguuuaaauauaaaauaaauaguuuuuuaagugaaacuuuaauguauauauaaagccaaauagaaacuuuuggacagauaagagugagccuuuuuugaaaaauuauuuuuauuaguuacauauccaaacucauuaauguuccugugaaaaaguaaaagguacaaaaagucauaauuagcagaaguuaaauauaggaauuucccccuuugaucugcuuacaguuuugaaguucuggcagugaauucaagugcuaacauuuuaaaauuauuuuuguuucaggaugguagaacugaaggaaaugguuucugaugucgaucucaguuuuaauaaacuuuccuuuauauccuuggaguuaugugugcuucagaaauugacuuuuuuagaucucagguauuuauugauacuauugcuugacuuuuuaaaaaguuauaacuugucuuugaguuuugucuaacuuauucuuuuuaccucauauuuuccuagguauguauggaaacuggccuuuauuuauuaacaauaguuuaggagaauccaaaaauaguguuuaggaaacccgagacagaauucaggaaaaauacuguaaucagacauuuauaauuuguaagcaauuuacaaguuacgucauaagacaaaauuacugaaaauauuaacccauucuaagcaaaauuacaaauaagacauggaaaguauuuuuuucacauuguuuauuuucugaaaguaaauaguauaaaaccagcugaguggguuauucaacacaacuuaaugcagacaauaacuggagaaaaguacagagaauguagauauagaaaaagaauauagcuuguacuguagaaaguaugacuuuacauauuaggcuugacuucugaacacaaagaaauagguuagagaaaaauauuuauuuguaauagguagucaucuaguugggaauaauuuucucacagguauuuucauuauuaguaguuauauuggcuccuaaaauccuuuuaccuuuuuguuaacuuuucuucuaacauugcucccagaucuuuccaacaguaaaugagauuuuguuuauugccauguuucauuguaagagcuaaaaaaaaaaaauagucauuguguaaauuuaaauucuaaacuuagaguaggaauagauuugcuuuauaccuauggaguagaaaacuccaaaucucuuaauagaaucuuuuuaacuucuugguucauuuuuaaaauaauuuuuaaauuccucuuagaguagaauuucaugucugugucauauauauuaacaccaauggaauauuuaugugguauuauagacaugggggaaauauuaaauaccccacuuugaaggagcuaauuaguuuacaguguuuacccuguaaucacuauuaaaccuguaaagaauucauugcauuaucaauugguugcauauugguauuauuaggauuuggcauacuaaccgaauaacugcgguaggugacugauucagaauucucagaacucagccuuuauaaagucagaucaaggauugacaaacugaucuacauauuuuuuuuuccugcucaauauuuuaauuauaaauuaaacuuguaaaauuuuucaaacuuuguaaaucuucuguuuugauuuccaauuuaggaacaauuuuuuaaauucuuugccagaagaaauggaaucacugguaagacugcaaacgaucaaucuuuccuuuaauagguaagagaacagacaauucuaauuguuauucuguggaaauauguagaucuuucucauuggagaaaacaaaagccaaaaaaacaaaaaggccccuucuacuuuauuucaauauccagauuuuauuuucacuuaguucuucuuagaguuaaaaauauuauuuucuuagaauucucauaguugaugucuaacauauuuuucauuccuuuuuaccauuuugagaaaccuguggccuaaaaagacaaaauaaauaauuacaauugcucuaauggaaggauagugcacaggaaaaugucuucugagauuacuuuaagguagaggagauagcauugaaacugagguuugaaaaauagacauuugccagccauucagguagagagcauucuaguuagagcuaauagcauaugccaaggcacaaagaugugagaacauauggggugucugggaaacuucaagaaguucaaugugcuuuggacaauaaagcaaacagguagaggaguagaaggaacagauaaagucuggcaaguaagcaguagccagaccuugagcuuuuugugcucaacgaaacuuagauuuuguucugcaaacacuaucaagauacugcagauaauuaagagcaacuaauauuuauugggagcuuauuauucugcuggugcuguacuaaguacuuuacauguaauagcucaggcuuacaagaacccuacaugguagguucuguuacuguguucauuuaaaaaucaaggauuagaagcuaaauaacucaucuaagguaugcauaaauaguaaauuauacagcugagauuugaguccaggugguuuggcuccagaaguugggcucuuaacaacuaugucacauuguuucuuaugaugaaaauggauucuaaaaacaauuuaauuaaaauaugaauaacuggccaggugcagugacugacaccuguaaucccagcacuuuggaaggccgaggugggcggaucaccugaggucaggaguuugagaccagccuggccgauauggugaaacuccaucucuacuaaaaauacaaaaauuagccaggcguggugguggccuguaaacccagcuacucaggaggcugaggcaggagaaucgcuugaaccccaggaggcagagguugcagugauccaggauugcgucacugcacuccagccuaggcgacagagcaagacucugucucaaaaaauaaauaaaauuuaaaaaauaaaauauuagcagcuaauguuuaaugcaaccuagauaauguccuaaggucuucaaauacauucauuuaauccuuauaacaaguguauauguuuaguacuauuauuauuccucauuuauagaugaggaagcuaaugcauagugauguuaaaauauugcucauuuuaauuuuucuucugucugcuccauuacuuguccuuucuaguauauagauugcaccauuauugucauuauuuuaaaauaugugcacuucucacaucucuccuaauuuuuacuugugaauugagcuaucaguuuuauauuguguugucaauugagcuaacaauugccuugcaaguaaugucuuuggggaagugccaaaagcuagccuaaacuuccguguuaucaggugauuaucuuguucauggguugcagggagggaagagaagagccuauuaaggggucauuugguccaucuguacucuuggcuauugcuucucuagucuuacuggaacuucagcacugccuugaguuuacacuucacuauugcuuuuuuucaucaaggcagcaaaggaagggggcaguaugcggaaaugaaaaggccaaagcucucguuccugcccauucuucuauuuucuagucaaggcugcaguucaccucaugcuaaaacugugcuagccuuugugcccugcgggguccucagccauuuuacguuaauugcaaguauugcuuugagagcuauuagccuucccauaucuuguggcaucuucaggguugcuuggacaagaaagccagcagucuaugcuaauuuguuaucuuuuuaagaacccaaaguguacucauuuuagaagccucagucaaagcaaaauauaaaucuugaauuuuacuuaauauauugggagugauuauguuucauaagaaguaaaagugaaaggaagaauaccuacauggauacauuuagagaagauuuccucuugaaugugaacagaaaaauuuacugggagaauuuacucugaaguuuugcugauuuuauacaauaaauagcaacuguuacaagucugucuguuuaacauguauuucaagguuuucaaaauuagcccuuucucuuuauuuuuuguaaaauucaaauacaggacuuaaugccaauuacagaauaacauacacuaaagaaaaaacugucaugucaaauuuaagauaauauguuuuaaggaaugauuuuggucugauuccaguauauuuagguguucuguucauguauuaauagguuuaaaaugcuaccugaaguucuauaucguaucuucacacuugaaacaauucugauuaguaauaaucagguuggaucuguggacccucagaaaaugaagaugauggaaaaucugaccacguuggaccuucaaaauaaugaccucuuacaaauuccaccagagcucgguaauuguguaaacuuaagguaacuacaccauucuacugcauuguuucauuuauuuuauugauuuguugaagugauuuguuuuucuuuuucagauaaauuugcaagaaguuaaaguaacagauuuaauauccuguuaaaaauaacaaguaacaaaacccagagucccaauucuguuuuucaaauuuuaccaaauguauauuuuuaguuuugcuuauaugguauaugugugaauauaauaacuaauuauuucuaguggcuuuucgcuaucacuguguauguuuauaaccugaaucucuacugcauaaaaaugucggggaaauauuaacuccuuagcuuugaauacaggguuuuuuuuuuuuuuuuuuuugaaauugauugcagauuaccaccauucuauuuugagcccaguacagucuuucucacucuuuacaucugcuguucccucagcaucagguacuuuuacccuguuuucaucaauaauuggccuauugaaugucaccuuugaaagccuucccuguccuccaagcagaauuagucccugauuucccaucaugcuucauuuggacuuauuuguacgauuuuugggucuuucuuuggaaaagaguugucccagugccuaaaacauaguaaacacccaguaagugcuuauuaagugaauauaaaggagguuugagguaucgacagaaagccaagugguuaagcagaaugugucagaaguaauuuaauugcugaaaacugcauaugaaugauuugguauauuuuacuucacuggagcaacacugguaucugcucuaguaccucauguuaguaaguuauaggagacuauaaauacaguugauucuuauucuuuguggcaguuauguucuauagacacucugaacacccaguuagugaauacugaccuauugcuucugggggaaauacagggguuagguucuugcaagagucuagucacaacauuuucagcaaccagucaauauauaacuuuguuauauguguguuucuguaguaagauacuucauuuaauauuacuguugugucauuaacauugaaaucauggccaacagcacuauaauucaugccugaacaaagcuuaccugacacauguauuuuuuucguaauccacauuuguccuuaggaagacuagacaguacuuuagcauuauacuuggugaccauuuaacacagugaaaucaccaacaaagguaugaaaauuugaaaagcguggcacuaaaugaaccaccaaaaugacccguuuacaguauaagagcugaaacaagaagacaaagcaucaccuuguucagucucaccugggaacaugcccguggggugacuccaauuuuuugcuccucugugccuguuuaugaaugaccucggaagugccacacauugauuuggggguauaaacuuuagugaguaggcaaguuugcaaauauagcacccaugaauaaugaggaucaacuguaaucaacuuuuuuucuagaaauuaagaaaauaagucuuuaaaagaauucccaagaaacagaaauauuugaagauauaauuuagaucaacaauaugguugaguccuuugauuuuuguuuacauaaacacuuaacuguuaaaaauaauaaaaaagccucucuuaauugaagauauuuuauuauauaaugaaacaaaacaagcucuuaaaucuuaaguugaacucucagaacauguaaauagauuuauauauguguaucugcucaaaggagggagagggcagaauguguuaauguuuugggaggcaggggguggagcagugguggugauacauugauuacauuacaguccuuggcuuggaugacucaugcugauauuuguuuaaaucuuacuugaccauuuaguauacagucacuuaauaagguugagaaggcuggauaaaagggugguucaaaucacagcuccaucauuuaguagcuguuugaucuuagacaauauuucuuaccccccuaaauuuguauuuccucaucuauuaaaacagaacuauuaaugguacuuacaucauaggauuguugagaaaauaggauuguuaagagugacugaauauaaauuacuuggcucaguaccuuucacaaaguaaguauucaauuaauauguuuuggguuauuaauuaguuauaauucuaauguuuaaauguucagauaugaaaaggggcaaauagcucaagcauggugguucacuccuguaaucccaguacuuugggaggcugaggcgggcagauuacuugaggccaggaguuugagaccagccuggccaaaauggcaaaacccccucacuacugaaaauacaaaaauuagccgggugugguggaacacaccuguaaucccagcuacccgggaggcugaggcaugagaauuacuugaaccugggagguggagguugcaauaagcugagauugcaccucugcacuucaggcugggcaacagagugagacucugucucaaaaaaagaaauaaaaauaaaaaggggcaaauagaaaaaaaauacagaaauuuuauuuauaaaauugcaaaugaaauuagaugaaaaaccuuguuaauggaaaauguuuacauucucaauuucucucuuuuguuuagaacauuacuacuggauggaaauccauuccgaguuccucgagcagccauauuaaugaaaggaacagcugcuauacuugaauauuugagagaccgaauuccuacuuaacauggaguugcuuuauaacccuugucauguauuauuaacccugguuaauucuaaggaggauguaacauuuguuuuaguaucaucuuaaaaggugauuauuguaauugaucuuguaguuucccaguaucaccuaccuguugguauaauuagccugggccauauucacugccaguaaauauuuuuacauuuuuauuuaagauuuuuguaagguguuguauacauuuguaauggugauaaccacaauguguucauacauuuguucuaaauguuuugcuuaugauuuauccugcuaacuuucauuuucuuauagcaagcaguuuuuucaaaaaugaauuuuuauuuaaugugguucaguauuauaauaacaaagcauuuuuguagaacugguuuuuuuucucauuuauuuuuguauuccauacaaugugaccaauugacuugaauaugacuagccaguuucuauguuuuuguuagauauaaaauuaaaucgaauuuuguugaauacuguucuuuggcauuuaaaaaauaagaccuucuuaucuugggccacaugucaaaagaaaaaggaaacaaaaauauauuaaaaauaagacuuuucauuacccaugauaggacuuuugugauauggcuaaucucaguacacauuucaacuuaaaaccuuuuuauuuacagcaccauaauuuuaaaauuuacuugcaaucuugguaagacuaaacuugcaguguuuuucuaaaagggaauuugauagguaaacuugauuuaauaaaaauuaaauaucauuuuuguuuacaccaaaauuaucagaaguagguugauuagucauuauaacacuuaccauaugauucuauuaagaagucaauucaguagcauguauaucaauuuauauagauagguagauagcuuuuggaugauugaggcaugcuuauauuaugaaaaaaauugcuaauaaagauaaauacuacauguucagaauaaaaguuacauuuuucaaauauugauuacaauguuuauguuuucauuuuaaaaaaaacaugccuuuuuggcugggggcaguggcuuacgccuguaaucccaacacuucgggaggcugaggcgggcagaucacuugaggucaggaguucaagaccagccuggcuaacauggugaaacccccgucucuacuaaaaauacaaaaaacaaaaccaaaaaaaacuauccgggcauggugcaugugccuguaaucucagcaucuugggaggcugaggcaggagaaucacuugaacccaggaggcagaggaugacagagugcugagaucgcgccacucuguacuccagccuuggguaagagugaaacuccuccaucucaaaaaaauaaaaaauaaaaacaaaaacaugccuuuuucuuauuacaucucuguugcugacuacgaggucugcuuugauaguaaacaaaagacacuuuacaauaaggugacauuuuauuauuuauacaauaaggagacuuuuauguuauucaaaacacuuuuuuaaauacugaaaaaguugaguacaccaaagccgaaaaauggcucugcuauacacugcacagcauuauuuuagucccuguauuuuguaucuguacagaaagcaucuucaaaaugcauucuaaucacauuguacaccuuuaccaauuagugucaguacauaaaauaaaacuggagaauacagcuugcauuugcaaauuaacugacaguaauuaauuucacugguucaguaaauuuaaaauauagauucauaggacuucuuugcacauaaaaugaagcagcuuucaagguuguuauggucucauacugcaaaaaaaccaguaaguacauucacgaucuauguuaauaaaguaguaaauaugucuucauucaguuuuauuuacaucaauauguaguucaacuaaaaaguacuuuuaauugugauauaguagucuuuuuaacacauacaaaaaugacaauuuuuuauauauaauuuaagcucaaaaucacaauuaucucaaaauauuaauuacaauacagccauuucaguuaaacauguugugauuugauuuuuuuuauaaaaugguaaaauuguauuauuaaaguaagcaauuuguuuugaauuggcuagaguacacccaaguagaaaaccuuaaaugugaagagguguuuccugcccccucccacccgaauuuguauacagccaccuaggcuagcaaagagacagaaaaggccccaauuuauaaagauuaagccucuuuugcuauacugcuguggcuuguugguucuuccauaaaagcuuuacaaggguagugucaauaaacuaugcagugaaaugcaugcauuaauauacaauaugucuauguaaaaugucaauguuuacuauugcacauuaaaagguucacaaagacugcaaaagaagucauaaagaagcacuuucuuuaccagucgaauauuguaaauuugaaaacgacuugauaauauaaugggauuucuuugaaaucagaucccaauucaaguucuuucucuggcuaaaggagcucugguuacuuggccuuaagaugucacuguugugcugcacauaugguagugaagucagagaucauuaaaaaaaaaaaaaaagucuagagacucuucauuuuacuaaaauagcgacccaaaguuguaucacugcuuaggaauuuuucuuaaacuuacagaagagugaaauauuucacuaacugaauuauaugagcugaaaugagaaaaagaaaauuuauguguguguguuuggcauaugggaaaauacaaauucauauagguagaaguagaacuucuuuauagaguaguaaaaggauuaugccccaaaauaacugaggucaaaaguaaucaauuaugaaaucguuuaggaaaaaauaauuuucauagauacuuagaaaacauccaaaacauaauaucuaguauccuuuuacauauaauucuuaacaaaccaucugaaaaccuaccacugucuuccuucagaauugcuuauguuaguuuaauauuucuuuuuugaauagaaagacccuaguucauguuaugguuuucuuauauauagcugguugggggagcccuugggcaguuauaaaguggaaaaaauaaaacuguauuauuacuuucaauaagcaacaguaaucuugcaguaguuucacuuuuuucaaggucuuuugugguggucuuuaaaauuuacaaacagaauuugguagauuuacuucuaauuuuccacuaguaaaaaauuucuucuucauaugaagacaaugucauuauccuuaagcuuccuuuagucccuacugaguacaaagagaaacuugauuggcucuucaaacaaaaacuaucuguuuaucugucaauuaccuuucucuucauuucaaacagaaaauaggcuuguguuuucaaggaugaaaguguauuugaggauguuaaagagaaaugcccaaacauuauaaagccgaaguauuaagcauucauugcauuccacugacgcuaggugucaucaaagcuaaaaccaaauuuucuagaguaaaacuuacauacaacaguccuuacugaccugaaccagaugccuuuuccacauucaagccaaauaagaguccucugaguggaaagacuacaaguauugaaaauaaaaauuauuucaacaauauauucugaaaauuaaugaccuuucuagcagauaugggagcugcuuuauguugucugccugagaguuucaucuugcuuuuccuauggaccguccaaaaauauuacauaagauuuccugacuaaauaagaaauauucuuuaguagaggguuggggaaggguaagaggaauggagagauacaaagaaauacaaugugauuucuuuuguccauuugucaaaugcuuucguuaagcuauuaaaaaggucaauugaccugcauaccugggcauuauuuaaccucauuauuuuagcugugcaaaacaaaugugcaaagaaaaacaccuccuauuuaugugugccuauacauagacacaaaaccugagucaccauaaaaguuuucaauauaagaaaccuuuucuuaauauaggaaaauaaccuuuaaagagccaaaaauaucuuuguacaauauaagcagcuaacuuuaaaacuucaguguacuuaaguaucacauauuuuauaagauccagcaaaaaagggaucauuuacauuugauaauuuucuuaacuauagcugagauaaccacauuuuaauuucuaacauguauuuucauuccccugaauucauugauuuuuuuuuuaaagcacauucaaauaaguccuguuuaauuucugacaaacaguuccugcuuguuucuagauauugaggacauaggagauuuaggauugcuaggccuauaauuuagugccaagccacaauggaauuccaaaguucaaaacaaaauauaucauuuuauuaagagaaacauuauuugcaaaaguauuuguagacagaguugggccaaagucugcaugaagcuauugucucauuugcaggcucccuuucuacugacuuaacucuuaaaaacccuuucuuucuccaugcuccauuuccuuauuuuucaguaggcuucauacccuuuucguaccugaacccugaauugucccaacugaaugaagcucccuugcucauuugcagccaccaguuaacaauguccucuuaucuacaucuuuuguuaucucuuccucuuuaugagcuuagaacucugggaugacuccuuggccucuccuccugugccacuuaacuacucauuagaggaaaaucugcuugaguguuccauugccuuauuagucacugauuuaaggcucaauucaggacauacuuauucccugggcuacaccucaguugcgaacugaggaaaguuguuuauagaaaaaugacugaaaguugcuucucgaugcugcucccagugguccuugucauuaauuaugcauuuaugucaguuaagucacugacacuuagggagaagggaaagccaucugaaccaaaauauucagucuuuguggcugugauuggauaggagggccuuugaauacuuguaucaguaaagagauacugggcagggcccuugaaugcuuuuuuucucaagccugguuugggaauaagguggaaaaugcaugcaagagaguaaaggauuagaggcauuagccaagggaacuguagucaauuccugacuuuuuauauuauacuugccugaggaucaccagaaggauuuugucuugugcagaaggcuaaaagcagagucauacuuucucugccaacagacuuguugccaugggaaccagugcagaaaaaugaaaauaugacaagaagccaaggauuaaauguagaaaauugauagggaguugauuucuacauggcaauuuaagcauugaggauuuaaagaaacaggauguuccuuauguggccagaucaaugaaaauggacaaaaugacuuaccaguagcugguccuagggggcugagguguggaaaauggaaggagaaaguaguaagcgugcuguaguuuggauaaggggaacuuuguaaaaucuaauuccacuccugaugagguuaagcuugcagcccaauguuaaaauuaacuguaggaucaaauauacccuuuggaaaggcaugcccaugcuuagcuugauaaaagcagccugauguaacaauuuucuuuucaccuuuccaaaaccagcacauacuacucgacaagauuauugcacaucuaguuuauuauugcuugauguaucuuuucaauuacuccaacacacaaaaaaacgaaaaaacccaccauuugcaaaucuaugccucccuucccccaauaaggcagcuauuguaaguacccuagaauuaaguuucucauuaaggaaauaauuauuuuacuucaugugauacaaguccucccuguguacccuucucugucauucaguacuuaauaauaaacugaucaaaccagacuguaggaguccaggaaaaccuuuaacaaggauuuggaguuucagcauaaucugagaaggaccuacauguuguauuuucaaaggcucuaaggagacuguaccugccgugucuccgaagcuuuccugaaaaccuacaauuaaugucucauuccuaugacuucagcuuuggccuauuuugaaaugcaguugcucuaaggagauguaggaaggucacccuguaaaggauuugauuuaacccuuccugcagagcuaguuuucaaauaguaauggcacacuucaccugauguccucuucuucccucacccacaaaggaaaaacuaaaaacauaacguccaccugggcaauggguagggcuagaggccaggaaguaggagacaagccauuauagcauaguugucuuuaggguacaucugaauccaaauggucugaauaaaauaugcucuuugugcaguguuacguacacuggacagauuucacuagacaugcuuguuuucuuucucacuuaugacuucuggaucuauuuguuagaguucauuacugaagccuuugacaaucucaaugaguucuugaaaugucaaaagcucguuaauuuccuuuaucccaagaguacuuaauucugaaucugaauucugaaauccaauaaaacgccugaauguucuaucacuugcuguuugauaguacaugcaggacccuaaacagagguuugaauacugagauacugcugacacagaauuccuuauaucaauauucuagugacuuuuaggauuggagacuugugggcuugguuuuugcaguaggaagcauuagaauaaccugaugcaggacuaauugaagcuacauaaagcauugc

SEQ ID NO: 13884 - RNA, 4696 nt, Homo sapiens
ccuuaaaaauuuugaaacaauuugauuaauccucucaacuuucuaugagguuguacaaaugauuauuugcuauaucauguaccuuaaagaguuaauagacauaacuucuguaguuuuccuuaguuuaucauauagcucagucacaaaaggaccaauaucccucauuuuagaauauuuauugcuuucuacuaccacaaguauuuggaauuuuaaaaaaagacuuuuaaguagaauaaugaugucuguguaguaggcauuaugcuuuacagaacugaucuuuuuuaaaagguggcuucuccauguugacaacugaauauacaaagauacagagcuuuuuuuucaauaccuuucaaccuggaucuccaguaauaugcccaaacugguacuugaaggucaggaguccuuugauuaaguauuuaaaggcacaaucuccauuuucaaauguaagcaugcugcacaauccaucacauauuuuuaaucaauucacauuuucuaaguugaugcgcaaugacacuaaguuucuacaaggaaaaaccaaacacuucaucacaaaauggcagcuaauuuuccagaccauaacugaauucauacacuuuuugaacucaacuuuauuauacagucgcuguucuacaucuaggcuaauccugagugaaaaaucuuugauuuuaaccucaaagagcaagcaaaaacucugggauuuuguuggaaauaaagccauauggacuauuaauauucucuugcugguguaauguaaucucuaaagagauucuucccuuagaauaaguuguaaggauuuagauggcuauacuucuuagugcuuagagaggcugcuagggcagcugaaauugucaacauuggagaacucuuaauugaaggcucuggcuggauaggccaugucagcauuucagcugucugucuaaaugacaugcaugagacuugaucuaugucugcauaguuccaggcauucuuuaguuuuuauacuuccuagaaaauuuuaucucaggggcuguucaaguugcauuucuuacugaacucuggugggucuauuagguacuuaaacacaaagcaacccccagugguggaguguuugcuaacaguaaagacuaauguuuuccuuguauguagguacaugauaaguguuaaagauaugcaaguccaccagauguacguacauuuuucuuaggugucuaaaacacaaaagaauuauuuuaaagcuuucaagggucacuaaagguuaacuucucuucuucccucagauugaucccuuuaaguggaacaguaagccuuuguuaucaagccuuaagaugaaguuccuuccuccagaaaggaggagcugcccuugauuccagcaagcccccucugacuuugacccaaaaggguuacuccuuggaaagacagagucaagaaaagugaaaagcuggagcuuagcuaaccugugacuaucucuccgugauaugauuuauucaggaugauacugcaguuauuuacguccccacugucaccugagccuuguccuuuuugacaagauacauauauacaagggacaagaacuuuccuuccugagauaacagaaaacguuccuugggucauauuauaaaagcaauagagccgaggaugguggcucaugccuaucaucccagcacuuugggaggcugaggugggaggaucacuugagcucaggaguucgagaccagccugggcaacauagcaagacucugucucugcaaaaaauaaaaaauuagccaggagugguggugcaugccuauagucccagcuacucaggaggcugagguggaucacuugagcccagguggucaaggcugcagugggccaugaucaugccacugcacuccaaccugggugacagagcaagacccugucucagaaaaaaaaaaaaaaaaaaaaaaaaggcauuaaaaaagcaauaaagcagaaagaaagcauuugccauuuuauuaaacugugagagaaggugacaauacaguguucuuuccucauauuuuguaccuacacgauagcauuuauuagacuuuuugugugucuccccacuagacuguguuucuugagggguaggaccauggcuuauuuauaucuuccauuguucuuauaauagaauuuugaacauaaccccuuguucauuaacauuuguugauuaaauugaaugcacagugagaaaaaggcaaauuguuuuaacaguuaaauaauuuuuuaaaaaaggauaaacauauagauuggcuagaggacaaaccuuagaaugguccggaggcagacuuacaagagaauuacuuaaacaucucucgauucaaaccuacaggucuggaugaauacucaaaauauaaguauauauuuugggguauaggugaaccugcggggcauauuuauggcaagaccaagcaaaagaagaaaauauagucccuucacuuugaguaguuuaugaugaccuagggcccuaggugacagggauaguaacuaucauuuuuugggaaacguggaaaugcaaaaaaaaaaaaaauugccugauaagauauauagacacacacacacacacacacacagacacacacacagacacacacagagagagagagauauuaauucccaaguuugaauuucucugggaaauggccacaaagaaaugccugaacuguuugcuagcaacauucaugguuuuauaaagaauauagcagugauguccugcuagaauaucugucuugaucauaaugagacugugagaaccuaucaagugcaagauacccguugcuuagucaaacgauucuacaaguauggcugaagauuuauaucccaaaacuggcuaucaaagauggcugguuuaaaacaaucaagacaguauagacaaauauuacagggcaagaauaguuuggaugaugauauccuagagaaaaaaucacuuuuagagaaugggacuuguucacuaucuaacaacuuucucuuuuacagauucuagcuuaaugaucaucaauaaaagugaagucuugaauaugauggauauucacuuauuugucagggaggugacacaguuggacaagcagcacccuuggagucgggguuggggaggagugcgugagauguuucaaaaggaucucagugcauuuuaagugacagcuucuccugcucucuucucuucccacagcugcuggggguccugcaccccaacccagccuagaugauauuuccauuuguuguaccuaaaagcagagcuuuuuacaucuuuacaucuuuaccucaugacagaacuaaaaaaaugauguuuguucuacaguauggcacggagauggguaaaaaagugaaaagaauaagccacaagcccccgugcuuugaggagaugaucauagccugcuccuggggaacuaugcuaguggcuggauagcaagcacugaccuagagguugcuccuaggaauaaaaaauuaagauuauccauagaagacaaagaaaaaaauacuucgcuaauaguggauaccaaaaaucugagguagugcaaaagaaaagaaaggaaaaaagaaauaaaaagcgcaacuggaauacauacauacaaacuuucaagacguuuucucuuauacucuucaguaaaauucuauguaauuuucauucuaguauuuaaauaguucuggauuuuacaacuaaaccuaucauuaaaagguuauggaaaauagaaggaauaaaaaagaugaaauagaacaucaggcaaaucaaaaacucaaaagcuguauccaaaacaaugguggacaccugccguauuugcuuuaaaauggguggcacuguuguguacaauuuaaauuuguuaaggagauauuuaacuucucugaaaagagaggaagaacacuugguaaacaaacccaaaauggugcacuaaaauuggcaggcuugaggucagaaagaacuuacaaaauauuaacccccaaagaagguuaaauugaauuugcuaagaaagaguauucuguauuaguaucuggugaucauguggcuagaaggaaauuguuuuuuuuggaggaaaacaccagaggauauaaauggcuucacauaaacuuugggaaagaacaccuugucuucccucuaccuuugcuccggguuggaagaaaaaaagauuaaaugguuggcaggggaacaccugaaacccauauaaguagggcuuugauggaauuagcaaagaagaagcucagaccaggaggcuggcuaagcugugagggugaggauauaauuagcuuagaggaaguaaacaaaaacauuuggccuuuuuagcaaugauccagccaucagaggcccuggaauuucaaaugacuaagaagaaccaaaauagcuugaggacacaugucaccaaggccgccagggguucucugccuucagcacccagauauucccacugaaaggagagaggcuggggagauugcaaacuaccuugggaauccaaugaucacuuugugagagacauuuugaaauacauuucgaaauacauuucuuauucacuucauaauaaaauaaaaucugauugucauauuaugcugauuacucauacacauaaauaaaaugaaaaauuaggcguuuauuguagaugccuaguuauugccagauggaaauaaagcuauacccagaugcacacauauucagauuggacuaguuuuagaauuacauaaagaaggcuaggcaaacuuaaccacaguuccugauguuuaaguuuug

SEQ ID NO: 13885 - RNA, 47940 nt, Homo sapiens
cggcggcggcggcggcggcggcggcagcugcaaguugggcugcaggggcagcgcauacacuacaauggcugcuggaaagaggcguaaggaaacaauuuccaggcccgccgcguccagcccgaaauaugagaaaaaaauuauuagaaauuccgcgggcgguguagaggcggcggacgggccggagggaggauguuaaagccccgcggugaguucuccggggguccggggcggcggcgaggcguuuagcgggagaaauaucaggguuauuuaaauuaugggacuagccgagggggcagaggagcagcggcggcggcaggaggaggaaaaguuugugcuacucucagccccugcucaggaccccagagagaaaaauaauaauaaaaaauaaaauaaaauaauuacgcggggcugcgaggacucccgaagucgcuucugacagggcagggggcgaugcggcuggggacccgaaggugaggucggugggaaaaaaaaaaaaaccuuuauucagggucuggaaaguuugaaaaguuuuccuccuccuccuccuccuccuccucucuggugcugugaauauugugacagcggcagcggcagcagcgagagcggaagacauuagagacccgaaaaauaagggaaaaauuaauauaaauucaguuuugagaguaaacucuccgcauuuuccaccaaaacaucccgggggaaggucgcuucccaaagggccuggcggaaacccgcagucggcaauauuuggggggcacuuugagugacuugggguaacuuugccccuuuuucaaaagagguuuuucuuuucuggagaaaugaauuuguuuuugcccuuuccucaggugggcaagccggggucggggugcggggucugcagggaggugugagcccgggguguguggcugcgaggggggguagggggagggggugcuaaaugaaagcaggagaucggcacagagcagggacagcuuguugucaguaucauaaacaaccaaaauggagggagaacucaggcauauaaccaaauaaaaauuuuuaaaaaaucgcaaaaaaucccuaaaaauccgggaugcucccccuuuucucgcuaaagguaaaaguauguaccgccuuuccccugaaguccauuuugacuuugcagggaccaaggaguuaauauuuauuuauuuuuuaaaacuuucgaagggcaaaagccuuuuauaacucaaccgacaaugagaaaacgugaaaauccgaugcaagagaagcagggggagcgaggggggaggugguagugcagaaacugcuaaacuuauugguaauguggacugaucucagauaagauaaacacuauauuugcuauuuuauaacucucuuuuaaugaucuuugcgggguuuuuuuggguggaaaaaaaagugaugccauuuucuuaauagaguuaauaugugugauuggaagaaugaaccuuuccggcuuuagauugcauuuucgucgcauuuaugcuucagguuuuguuaguggcucccuccuuucuuuaaacugggcucugcagaggagggauagagaggugauggugcucagagaggcuggagugcaaggcuggaguaccuuuuggggagggauguggaguugcuugguuucccccuuccugacauguuugcuucaccuguucauccuuccuaaagaauguuaagcugagguuuucugguuuuauguguauaaaaggaugaugucucuugcaucacauugauguuaaugggaaagugcugcugauguugguuccacgugggauaugggacagagcagggcauuuuaaagggacagcuucucuuuucuuaugguuuucaucaccuacacagaaucacugucugaggaccaaaagcagaggugcugggaggguguggugauggaagagccuucccuuucuguuacuccagugcacccacccauaggagugauggagggacaggagggauaaacagccucaaccgaagauggauauguguauaguuuguauccaaacuguuccuuuguguaacaagcccucccaggaacuuuucauguuacauugcuuugcuuuggaagcugauuuuggaaggaauuguggaaaaauggaaauaguuuaaggugugugguguaaugguauagcauuauugaacaguuaugaauucugugcagugagaucaaagagcuguguaugcccauaaugugauuuuacagccauuuuguaaaaacuguaaaauaccuuaauauucaauuuggcuuaagguacauugaggacuucugguugaaaauuacagaguggugaagauucuuuaaaauuguaagcaguaggcauuucuuuagggggaaggaaagcacacacaccaacaccauggaaaaguuuacacauccauuuuuaaaguccauccuaugcauggguuguaacuuugcgccuuugaaaugaaaagauuuuuaaaauccugagcccugugaguuuucauuuucuaaguugaauuuauuuguguuauuuaacagaaaguguuuacugaccauaaacuacuaucggcucuuauguuuuagauuuccacgauauuuucaaaauuuaaaauguguaaauuguuagcuguacuauaauggggauuaagguuaaucuucaguagaaauuacuuguguuccauuuuccacagguauauggaguuucugaaauaaauccuuauuuccucuuguuuuuauuauuuauagacauggauuaaaauuagagcugaauuuuuagacuucuuauauagaauguuuuuucuugcccuacuguauaaacaaguuauuauuuuuguagucuauuguauguuaacuuguguuuacaacugaguucuuccaacuuucuguaaauaccucuauacaacaucacaucaguaacguguuugaguacaucaucuugugguuucugauuuuggaagcaauuacaacuuucuaagaacucauuaaaagauuaaucucaucacccacaguuaaaucaaaauugauuggaaaaggauuaagcuaucaauagagaagggaaacuccuccaugcccaaugaucuucuguccagagguuucagaaugccauuaagacuuacaaagccuuuucauuuuaucuuacguuuucauuguauuuuggcucaagacaguuacauugacuauaaguagucagaauuaugcugugcauuuaaaauaaaugagacuuagaucuugaauaauugccacuuugacaaaccagauacuaauaucaauaaauucaaucucuauaaaaaaaugaaggaauucaaguuauauuagauuaucguguuauucagguuguuuggacacuaugacugguuuauugucaaucuaaauaaaagugcugguauugugauuuuuuuucuuccucucauauagggugguguaaaacuuucuucauguuuguauuuuaugcaacuagcuacuugucuguucagaaaacgcacucagagugcaccaaucuaaaaucuguaaucgcuuagagagucuuauuuagauggggcacagcacaauauuuaauuugaagugauuguacugagcuuuugugaugccuuagaaauacuaccuguugaacauccuuuucugaagcuauuaaauuauaccaguauacagaaauaaugucaugauauuguguagucaaaaucuuuauuucaguuggaaucggagaaaccucauauauugauagucuuauuugaaauuuauaugccuacuuuugcuacuugaaauucuauaaagaauuuaucugcuguggaagauuuauaagugugggcuaauauugacacauucuauaucuguauauuauuaccaaaauauuuuaguaaauaguaaauagauauuuauagcaaaauaaauuagugaauuugcuuuaucaguauaguuuuaaaauuugaagggugcuguuuguguuuuaauaacaugcacagguggggguuauuccuucauuuuuaauguaauccugauugucacuauguacauuuugguuugauauucugcaaauuuuccuuucuaaggauuaaauuuguuguuuccuaaauuaaaugugaugcuccugucuuaagugagauuuggaaagccagauaacuaaaacauauaucuauagcuaucuuugaaguuuuguuucaguaaucauuugccucuugagcuguguagucaaaauaauuuuaucuaagaauguuuuaauauuuuuucuuuagaauccuguucuuuggaaaauuaagauauauaaaaaauuaccaguuacacacauccccaaggaaaaaaaaguuuuacugaagaaacuuacuuacauugcuuggaauacauauucuuuuugguguguuugcaaguguauaagaaauaaauauuaauuuuuucucuuuauauugauaacaucuuagauucuuuaauuauuugaguaagggaagaguuucaaaaggaggaaacugaaucuguucaacaaaauccaagguagugaauaugaucaagguaaaagggcuauaaaucaucccuugagccauuuuuaaaugucuuaagaaccugauaaacaccuuuucugaaacauugaauacuuugaaacuauaucagucacuucugaaaaacaaagguagaccuuuaguuucuuuaguucuaccaggaauuaauauagguagcauauuuaaccaauuaguaaguguuuagguagucauggaaaaguauuuacaaguaaguaaaauaugaaugcaggguaaaucagauugauuagcuguaaaguuaaccugauuuuagaauucaugcaugggaauucuuuucuauuuuaccguaagacuacuuuggagguaacuaauuuuugcuuuuuguauuuuauugccuaaauuuuuugaaaugcucaaaccuaaaauccacuguuacuacuuuucauuuauguuagauuaacuuuuauaucuuauuugcaaauuucauuguaaaauuugagaaauuaaauuaagauuuuuagauuauaacauuuuauaaaaguauugagcuauuaacauuugaaguuguaagaaauguauguguaugaaagccuaguagaaauuauuacagggacauaauuugauuuuuacuuuuaaaucgauuagucugcuguccagagguuugcauuauacucacuguuuauagcuaucccugccuccucuuuacagggugguacugacaaggauauggugguguggaaccuccaagggcacuuggguauuuuuguuuucugauuuuguguauguauugguguuuguuguuaagaauuuugcucuuaaaaaaaaaugcuuaucagaacauuuaaaaauuuuauaaaacagaaauaucuuauuuuuuuaaaaagguaguguuaugcugcauuaaaauuguuaguauuuaaaagucccuggaugucuuauaaacagaguuacuacaggaucaugguauuaaaacuaaccacagugugugcugggaauuugagaugacuaccuaaaaaaugugugugcauguguagaaugaaugaacuuaugcaguauguccuagguuaauaggacaagaaauuugcuuaaaauauuuccuuacauuuaaaaguggaaucuucuuaaucuaaaaacauagaaaaccuagcaaugugaagguguuaggaagcaaaaauuuuuuuuggugccuuuuaaaaauaagaauuuuaaacaaugaaaguauguaacaauaaguauggacuaaaauguccaaaauucaugguaaagaauuugguagauaagaauuucagaguaaaauaacaauugugguaaauuaaaaauucaucuuaugugaauaaauaauaaccaacuacaaggcaaaaguuguaauuuugccuuaaaaauuagauaauuggggagaucuaccaaagaauauuuuuaauaccaauugcugguuucauaaugaccuuuuuaaaauagauccccaaagccugccuuccuucucuucuuagauuugaauuaaacuaaauuaaauucuaagaauaauuuguaaugguuauucagaauuuuuuuuaaauaagaaaaauuacuuuuugcuauuuuuauaaaauauuuugaagauuguuuugaaugugugucuucgugaaguguccugagaaaguuagaaauuauugaaaaucauuuucuucauuguucaucagaaaguuuaaaacuuuaaguuaaugaaauaaauuuuaaaaccucagucuaagaauaguuugcuucauggacuuuuuuagagcaauuuaaauaauuuguuacagacuuagucacauuuaaaaagccuuucacaagauaaugauaacauuucaccaacaaagcuccuaauuucugguauguuuuuaggucuaugcugccgauuaaaggaauuuuuucuuucccguuuauuaauuagcaagugcuuuucugaaagaguaucuaaacuuuugguauaaucuucugggauagaaguugccuuuacuauuagaaaauauuuugagagaggagggggcaucuuuucuuaaaaggcaacagaauccuuuacagauugugaaggaugugccauuagagagucuugaacucuucuuuuuugagaaugagagcccccuuuuagccuuucacucauuaaauauuugaauuauuauugcagaccaauauuggaauugcacauauauauauugauugugauuuccuaucuuuuuguuucugaaugugauaauauucucagaauaagugcuauauguuaaaggcugccauaucaguuuuuaaaaaauuaucucucuuuaaccagugguuagacauuagagcccuuuaacuuuaaaauacauuuuuggagacuguuaaacuagaaaucaauuagcaaauaaggaauuuagccccuuuggcucaaaggcaaaauuggaaggugucauaaucaauuuuauuccuuugaagauacauuaguaaauauuuauugaauuguucuugaucaugagaauuuuaagaaauuaaaccuggaaacuuaagauaguucaaguguacaguuucaaaauaacaccgguuggauuuuagucuaccagauuuucucgguaacuugauuuuuucuuguauugucuuaaugcuggaguuacauagagcucacgucacuuuucuucauacccugagagaguuacaauaaguagguuuuauuuuuaucaacuuuggacaaugaagggaaaaugcuguuuuauuauauaugagcacuuuccuuuucuuaagcuaucuucuguauuuccuaaacauaauucauuuaagcacugcauuccauugaagagaaauuagcuccauuauucuguguuacacaacugcaacuuauggaacaguugucacuuuauauauuuggauuguuaugaccuuauaaccuauuauaagccuaaaaacaaauauuaauauaaccagcauauccuauuauaaauaagcuacaccucaaacaugaauuuguuuuccuugcaccuuuaaaauuguuucuaaauaaaucugagaaaauguucuucauauguuuugcuaauuugucauagacugagguaauuuaauuguauaaauuucaaucuagauuuuucucuucuaauguugguagcauuuuacuugauguuuacuauucaauuucauaggauuuuagcauuagaauagaaauagauguauaauaaaauagguuaauuacaccaagagugguggaagcagcccuacuaguuauuuggaagauuuuuaaaauguuuccaagaaggaaaguuucugugaugaucaggcacaccaaacaggaguuagugacauuuuauguuuuucuuuaucuugcuucauaaaacgugagcauucucagggcuacugucauacaaacaaauaacugauuuaacuaugcuguauguuaagcacaucuaucaggucuagcuuuuaauguaauuugcucaguuuauuuuuaagaaaaagguguaagacauuuuuucagcaauaauuuggcauauauuacguuuugaaagaugcuguauuaaaauauauugucauauuugcuuacccaaaucaaaaugaaaguaaacuaucaaguaacaggcuuaauuagacauagaaugaaagcuuuaaauauuaaacugaauaacuugauuuacugcugaaauauacauaauuuuaauucagauaguuguuuuuguaucugaaucuacuuuuuaugccuagaaauuuguaaacaaaguacaaaauacacauauaaaauucuguagacguuccuaagcagcuagccuuuaacaguuaauaaauuuauuaguuuuuuuucaaauauguggucaaaauuacuuaaagaucgugauauauucaauuauuuucauuauucuucaaagaaaaguagugacaaauaggucaguacuugguugaaugucuguuguauuuaaauucuuaauuaucaagcauuuaauacuuuuaaugguauuucaauuuuuuaaguacaguuacagauguuuuucuuaaaagcccuucuuuugggaaaguauaaacuaaugucuguacuuccuaucucacaauauugcugcugagagauuggugacagacaguuauuuuaaaacuuuacuucuguaacugcuuuuauuuaauauguucucaagaucauguuauucuuaaauuccuaucuaggagcacuuuuaaucauagccuggguuaucuuuucagcuguauaccagagauacaguugcucuacuuaaacauuagaucucauguggugcuugaauuuaauuauucuuaguucaccuuuuaucccucagugcagggaaaaguagagaaagcaguuuguugugggagaagugcaauugaucacauucagaggcugacucauaauagcuuuuguacaaugcaugauacucuuccagaauuaaaagaaauuuuuuaauugaagccaaaauacccgcaugucuaaguuuguccuaaucagauuucaggcacacuugugugcuuccauuggcccuuccaaguguucuugcuguuugcauguguuugguucucagugcugccacccuguguauggcagugccuuacguagacuaguuuucugugcuuuuuaaaaucaagcaauaacauccaaaaucacuucuggaaaaugagcauauguauuaaaauuaauauaaaagucauugugguauacucugguucuguguuuaaugcuguacuaaaaucuagaucuuuuucaaguugcacaguucagaaguguggucuucaacugcuaaguauaaaauucagaaaauuuuaaagauaaguaacuuuaucucauccaucauuucacugaaauaaaguagaauuagacuaguauuuuaaaucuagcuugaaauugaucaaauaagaaagcagagguucugauccuuuaaagaugagauguuacaaaauuuuuuauuucagccaaguuuuaguuaaagguuuuuccuaguaaaaacaaaaaaaaaaaaaaagagcccaaaaagaaacuguuuauguuuaaaagaaaaagaaacucaacuugauugguugaauuauucccugaaucguuagcaacaugacuuuuauaacucucaaaauauuuugaguauuaaugcuaugcuucagccauaaaauacuuuggcuaccuaucagucuuugcuuuuaccuauauuaucucauuuaguuuucacagcaaucucaugagauaggaauugcagggauaauguguaugcaagaagcaauaaugauuucagaaggaauucuguuacuuuuuguaaguaaaucuuuagaauggacagaccuauagcagcuaauuauuauauguuauuuggguaguauaaaccuaaauuauguccauauugaaguucauauauuuaagaaaauuguacauucuuacaaaaugaagauuucaggcauagaguugacagaguaauucgaguuagaaagugcuaaaugucaacuuaucuuuaagcuguacauaaggaauuggggaaauuuaucaacuuauuaagcuaaaggagauuuuucuaaagauauaaguauaaacuuugucucauaauaaggaucuuaaauagguaauuuuauuaauuuuggccuuaaauuuguugcaaagcugucugauuucagaauaaugaauaaacauuuuuccccaaauuuuugaauggucuuauuucauuaaacaauguaauucuacaugaugacaauugaaaauauugcuuagcuugguuaauuuuagauguuaggcuuccaagcuaaaaaugccacugaugaucuucccacccaggagaguuaaaagaauuuaauacaguauaugguauugucccaauuacuaaagaauuccaaguuucacaucuccauuuuguuauucauguaaucuccauggguuugggggauuuggggauuucucucuuccuuugugucuccccuauaauaaacacauaaauauuccuuaaauuuauuuuaaaauaaaaaugugauugucacgggaaauguggcuaaauguugaauugggcgaaaaagaaaaauuuuuuaaacuucucugcuuuuaugccuuuggaugaugaguuaauguauaaagagaucccagagcauuguuuuuuaaaaugcuaaaugaaugguaaagacaguaaaaacuauaggugcucaagggagggagagguggaacuugagaugggcuuugaaaaaggcaugaguuaggaauuggcaagaagaagcagggcuguucaggugagaggaaugguuuuggcagagguuaggagacagagaagaccagucugacuggagaggaugguuugcaaggguacaguucaggagccgcuagaaaggugugcugagaucugauugugaaaagccuuuauuaccagccugaggaaugugcacuaugugcugcggaaggcauuguagcuuuuugagcagaggaggaugaauuaggaaaguuaaguugauccagaguccagaauaaacugaccccauggauguaagacuagcguuacagaaaugugaauauguuccacauuggaagcggggcccgcugcacgcagaggucuccggucuuuaccacuagguccauucugcuagcaauucagacuucagcuauucugugaauggcucuaccauuuuuuaguuccuuagucauggaaccaccuuuuucuauauucaguuggaacuuccgucauggguuuaauacuuguguuauagagacauuaacgaaauggacacauagaagaaguuaauaccacuugggggaauuagacucacagaggagguagcuguagagccaagaauggcgggggaaggccggggaauccagggaaggaugcuugggcccgcauaugcagcacgugccccauucuucugcaguugagugucagggugucaggggugagcagaaugaugguggagaaagcuagaaagggagacaggccaggaggcaucaggucccgaaggccacacagaagggguuuuauuccguugagaggguacccacugagguucagagcugggucuuucaugguauaaacccacucuuuuaccugcauccccauucucucuccuuuugcucauuccucucaccagugauucucaacaucuaauguucuccuauaacccucucaccagaugucuagcuuagcucccagagaagacugggacugucagugcccucuuuaccucuggauuccucuguaaugaugcccagcccuccuguaggggaggaucggggggggugguggagacguacugccuagugccaggaaggguuggucuagcuggggaggcugggccccagggcuguauaccggggcuucuggagccagccgguuacuccagccccucguagguccuuguauugucacucaccccucccaucuuggaauuucccaucucuuccucuccacuugcaaaauaugcucagaucuucccaaaucaaaaaaauaaaauacaccuuuggcuucaucaucccccuucccuaaguaccuuuccccucaucagugccagacuuucuggaagagugguccaugugcuguuucuuucaucuccccuuacucuuuagcuauccugccccuucauuuugagucugcauuugaaggcaacauccaucaacagccucccaggcaccaaagcugguggcaucauuuccauuuuauccccacuugccuuucugcaggauuccacauguuuggcaaacuccugcaucucugacuuuucuggcuuugcuguuccuucucuggcaccuccuuugcacuuuguuuggguggcaccuuuuuuccaccuguccccccaaccaccagcauuuuggcauuccccaggguucgcagcauuccccaguccacuucucaguguacacuuuuccugagcacccguucccacuccugcgguaccuuuagcuugcagcuucuugcuaaugaagccuuagucucuaccucucucuagggccuccaugucucuuuucuguuuacacuaacaucuccacaucuaugugcaagacaccuuuccuuuuauaucuuauucauuccacaaauuuuacaaagugccugccacacaggucaaguaccaugcuggguacuaagccaggccccacccacaaugagcaaaggacacaguaguuaguagagcucccucggggugcaguaggcagcaugaaggaauuaagaaggaguucagaggugaggaguccugggggccagggaagagggacccuaagagacagugaucaggggagaccucuugauaaaaggcccuuuguauagaggccugaaugaugagaaggggugggccaggagugaccugaagggacgcuccagacagaggcccugaggucuggaggaggagcucuacgugcuggaggcagagggagcgagauaggggaccgggcagaaagccaucuugcuggacugucuuguaacgucuaugaggaccgcuggcccugagugcaguagaacuccggagcagagcggggguuguccuuugcaggguggcugucacuuccagccucauccucaucugugcugcccucugcacauggcuauaggaccugggugcucccgucaccuccuuccuccccugccccuuugagaggcguguugcuggggcacccacagccugccugccucagcuguggugaccccucugugccugcacagccacguccuucucaccggcccuggagcacugcuccauaccaugcguggguaugcagcuuccucucggggcugagccuuggagggcaaggaccacgugcuguccuccaccccacuuucucugucucagaaccggcacaggguaaauuccuggagaggaguacucuguuuucaggggcaguccagagguuugauuguggugaagggaagcuagaggaagcccugagcagcgguuagaggcugugugaugcgggccauccauuccagagggugucugggacgacaugaguuccagggagaagucaguaggaggaggccugggaucacuucuuuggagucacccagccccuuguuaauugugaaguguggaacagcaagguugggagagagaaggugguuaaguuugucucugcugcucccuacccacccuguucccugcucccuccauagcuaagcccugcgcaacaaguacagacagaccuccugaccgccacaaggccagcccucaccugcagcaagcccuguuaccauggggguggcagagacaacuacacaugcuccaaagaaagacagacacagaugcaugagggaaaaggaugcacaccccccagaauacccagagcaggggagacccacaaucccagacagagaaacacguagaccuaagcacagugggcgugggaggcuguaucugucugugcagguauguguaaauuauguuuauauuuauauuucaggagaaagccagugggagaaagacaaacacagagaaagaagagagaaauacacccaguucacacccacagaggggaaagagaugcaccagcaacucugacucugucuuuucccugcuugaggggagaccccaaaguggggaaagacacugcacguucaccaggauaggcugggaaaagacacugaggacaccuggacugggggagagagugacacauccagaagguggaggugggagagacagauuccaggaugggcaggagaaagaguuacacucacgccaggaugugagcggagacgcacucacucccacggcagagggagacacacagccccggaugugagggcaggacaccagucccaccaggauuuggggagagaggcacacaugcucagauggggguacacacacagaagcaugcagaggugggagagagacacagacaccuggucugcagcagggagagaaagacccccagcgaggaagagagagacagacccccagaguuggggggagagacagaaauacacgccagagugggagggccccagagauccacaaacauacacagcccuggaggggagagaggagcacacacacacacacacacacacacacacacacacacgcacacuagggagggagagggugccugcaccccaugugggaacacaagacagagcaacuccaaagggaggcggcacaugugugcacacacaugcacacccccacgcaucuggauggggugaggggagagagagagacacaugcauagaggaggacacacacacauguauuaugcacggcaggaggcaggagggaggcccacacccuugcagaggaguuaagacaggccaggugaaggacagcacaccaagggcagugacaggagacacgcggggucaagagaugugcacacgcugcucgucuaugcgugugguacuugcaccauccccgagacuuggggcaggaaacgcucgcggugccacccaguucugacugacguguccucacaccccacugggugugcccauagagccaggucugaauggcagucagcgcuuggccccugaaaguaccugaacucuuccuauccuccucaggucacccauauccagacagaaggucacaccaaguuccuuuacccuaauuaaaaugcuggaaguauacagcggaggcaucacacacucauauauccgguucuauccucugagcgugauguacacacuugagaguacaacaguagagugaagaaccccuugguuaaaccaauacaguaaaugcugguguaucaccagguucaacaguuagugccuccacagccaggcuuguuucuucuaucccuuacccaugcccauccccauucccucgggcuuguuuauuuuccugcgggugugaaguuauuucaugccauuuauauauuuaugaucaugugccuuuggcuccccagcucguucuacuagggguucucuuuuccucugcucccuagacagcaccuuucuggccaacucugguuccauggcacuucugugcuccccaaauuccccuguggugcccauguuauagcagugagcacgcagcuggcuugccuugcaguuugguguguccucccacacccgcgagacuaggucugucaucuugauaucacugcucaccugcacacagcaggcacuugggagguuuugugagacaagugccccgagcuguaacagcucaaaggagagacuuguguugcccaucuugggcucugucuucucaccaacccaggguucccugggcgcuggcccccucccggcuugcaccgucaccuguucucccacacgaagccaggcgccuugagcuucaggaccuccugucuccuuagauuugggcugagguggccucaggcaagggaaccugcucggugaucucuccagcugcuggcuaugaacuuugggccuccucacaucugucucacccccugcagucuucaccagcccuggacgcuggcuuucugggucguggcuccaccaccacccuaccccagccucucuggcaccugcccucugcauguucuccccugcuggcccaagaaggcugguuagcuuccaugaagagugcagguggugggccagcuagcucuguaacagaccccgugaacugggaagugacucccuuaucuggaauaauagugcugucugacugcagugcuugcccugugcugacuguucagggcaccuacacauagugaugccauuuauccugguaauggcucccuaacauggguauugucuugauucccaguuauagaggaagaaaaugagcagagagaauuuaagucacuaaguauuaaaugagauaaugcaugaaaaaaauucucagcaaaacaccugguuccauucaaguggucaaaugguuuuugguugguuguucuaaacaagcuuauucacucuauuucaugaaauuuuggcuaauaauuaugauaauaauagucucuaauagaacuagaaaucucugauagucauuagguaacuuuaccccccaaguucacuaagaaaauugagucugucagauaugcacccucagcagcuucuucgcucaccacccaccuuauuugcuuucuaaccccuccuuuucuuggcugcagaggagcucugcucuucugcccaaggcucauccacucuuucacugucccauugaauaugggauuguguuuggucccacugacuucuucccuucagccagaggagguguucaagauucuccagaccaaaacgguucagagucuucacuugucucugccaucuccauucucuuucuccuacaggccuucacgucuuucucaaaccacacccggcagacuccugccucaccacucccccgaagcaacuuuggcaaagguuucaugauggccuccugccccacacgcaugcugcacccacauacacacaugccacacacacacaaacacacacacgccacacacacacaaacacacauacauucacacacacacacacacacccagugcugaguccagcagaugcucuuccgguuccuccaccugccugcuccaugaccgaagucucucccacuguagugcacccacugcaugcaugagccaccauuuucugccaccucagccugacacagcuccuugaucuugcuacgcucauuuauucuccaccuuuauuaguuaaaaaauaacuagucaucauaugcugaauaguuacuugauagccuaacugcaauauuucuuuuuccuuuuuuuuuuuuuuuuuuuugagacagaguugugcccucucacccaggcugcagugcaguugcaugaucucagcuuacugcaaccuccgcauccuggguucaagugauucucuugccucagccuccugaguagcugagacuacaggcaugugccaccauacccagcacauuuuuuguauuuuuuuaguagagaugggguuucgcuauguuggccaggcuggucucaaacugcuagccuaaagugauccaacagucuuagcuuaucaaagugcugagauuacaggaauauuucuuucuaaaaaauaguuuaccuaaugaaggccgggcgugguggcucacgccuguaaucccagcacuuuggaaggccgaggcgaguggaucacggggucgagagaucgagaccauccuggcuaacauggugaaaccccaucucuacuaaaaauacaaaaaauuacccaggugugguagcaggugccuguaguaccugcuaccgaauagcaggugccagcuauuugggaggcugaggcaggagaauggcgugaacccgggaggcggagcuugcagugagccgggaucgugccacugcacuccagccugggcgacagagugagacuccgucucaaaaaaaaaaaaaaaaaaaaguuuaccuaaugaaagaucugacuguuaaacauuuguuacugugucacuuguacaucagucucgaaugcuuagaaauaaccguuuagccucaguagaguagaauuaucaguugauuggucuguggccuuuguagcagggucaaggguacaaaaaugaucaugugcauuccuuagguuggagaagauguaaacaucauaaacuguauaaauaauuucugacuuugucauugucaaccagcuuuuuuuauguacccagagcuugugguacauguacauguagguuuacuguguagggugaaguguagugcugccuuuagguguuuucaaaaaacuuuuuauuguagaauauuuuaaagauauacagaaguacagagaacaauagaaugaauccucacacccaucgccaguuucaagucaccacaccucagcagccagucuuguuuccuucguccccuacccauacccauugccucuccugcagacucuuuugaugcaguuauuucauaucauuuguauauuucuugguguuuccaaaaaguacagacucuuuuuaaagguauaauuacaauacaauuaucacacaccaaaagaacaauaauuccuuaauaucuagugaguuuucaaaucugccuacuuaucuuuuguuuuuaaagauuuccaugauccaaauccaguaagguccauaccugcuguuagcuguuauauuucuuaaagucuuuuuugacccacaguuacucauuuuuuuuucuuccuuaaaacgcauuuguuaaagaaacggguuuuuugucuuuuguguuugugucugucugucuguccuguaguguuucccccaagucugaguucugcggauugcaucccuguuguauucuuuacacgcucuguaagguucagguucugcuuuuugccuccaaacacguuauagucucuuaaaaaggaaagcuggaaagauugaauguggaagaaauacauauugaauuaagugccauaagcaaucaugauaacauugcuaccaauauagugaauauagcuauuuaucauagcuguaguguuaugguguagaauuaguguucccaucauuuuaaaaaaugcauuaaaaacuaacagauauuuccuucuggaauguucuucuauaaaacuauguaacacuuuaaaaaauugaauugggaucuuuguuuuguaucuugcuuuuuaaaaauguaacauuguauaaagauuguuucccauguacuuguauguuacuucuuuguauuccucaaaagcuauaccacuugagaaugaaugaccacaguuuauuuagccuucccuaguuguuggcgaguagguaguuuccaguccagucuuuaaauaaugcaguaaugaaugaccucaugcaugaaucuuuaugggugucucagguuauuucuuaaguuaaaugcuuagguguaaaaugagugggcgaaaagauaagugcccacuuuucuuuggcuuggcaauugcauggcagcuuugaccuccagggaagacuuacagucgcugucgcugguaguacacaggagugcccauuuccuucacuuuccccaccaugggccacagccacuuacagcaaccuucccucucucuacacuuguugauuucuuuuguuuuaauuuguccuucguguuuuccauucuuagccaucaccaccugccgucauugcauuucccuuugauaccuggggcugcuaaucuucccuguaccaaaaaucccaguuaaccccaacuuguuaucguuuugccuaaaagauugacacugagugagggugcauaguacauuccucaauaugaaaugcuugauauguguagauuuguagugucuacuuuggcaguucagaaccuguguuccuccuuucuggguuuuuuuuuuuuuuuuccuguguuuuagauuauugauguugccagauaaaugaaagaucacccuauguuaauaccacagguucuguuaagguggggagaaaaacacaccugccaaacucugaauuaaauggaauuuguaaagcagauaaauuaagggaguaauuauucacauuacccaacaauuugccuuuaaaaaaaaaaggauugaaauuggcaccucuuuugguaccuuuaguuauuaucuaucugagcaaugucaauugagaaucuaaaguauuagaacuccaaaagucaucaucgaagugcucugaaauuacagugcauacuaaaaauaccucacauuugcauaaugcuuguaaagucgcaucauugucuggaacaccccaccccugugaauuugaacccuaaaauggccauugcugaccacaggcucgcguccucugccuccacuuccuuccuugcuccugcugacuuugucucugcugcuacaguuuaugcuucugggccuccuucucucuagcucaggucucacauacucccugcugccaccgcuggcuccugcuagugcucuagaauguucugcuucuccacugcucucuacuucaucuuccugcucccagcccugggagaauccucuccuccugccuuuuccagaugacucaggacagugacauuacugggugaucuaaaagcagcgcguguaaagcaggccugcagugauggcaugaguccagggccuguggucguuuggcccuccuuggucacucuccagcccugucaugggaacauacccccauucccuuuaaauuccguagcgccgggcucccacguuccuccagcacgucaagccacauuucccaugccugcccuugcacgugcuauuuccucugcuggaauguucuuaccccuuuaguucacuggaccaauaccuacucauccuugaaaacugcucaugugucaccuacucuaugaagcaaaauuaauuacuguguccucccccugugccuugauggucuuugguuuggcaucugcacacacccuguccuccucuaucucuucuuaugcccuggguacugcccccucuaauucauuauccuuucucucccuuucccucuccaccugauccuuccugucagcauuauaaacaugacaaaucucugccaucuuuuaaaaaauaaaacagugacagcucacuguccucucuguaccuuccccuucagcugauagcauuucuccaaagaggaauguggacuuagugcccccaguuccucaugcagcacuccuuccucaccccaggccuccauucugguuccccaaaguauaauaguucuuuucaauuuuacuaaaaaccugcaugucacacaaccaggaggaaguaggguuuaguccuuaccuuggcucuaccucccugaaacauucucuucccuuggcuucugugaccuuagagcauccuggcuuucccugcuacucaguggcauaccuucgaccuguugcuggcuuccccacucuguccauucuccagauagucccuccuuuccccucuccgugccccuuuccacaccuugcagugccauggucucugcuguaugccaucuucccccuaguccuuacccugcucuucaaauccuuugccacucacuguguuaugugccuuacaugcaguaucauuuauuccucacaacaacucuguagggcuucauuaucucacuucauagcugaggaaacugaaacugaagaaagauaagucauuuacccaaggccgagagcuaguccacuugacuugcugucaccaggugagauugcuuccacaccacuggcugagugaccuguccugcagcccuuccaucuccaguuacacuuguuaaagcaguggcucucagccuucagucgacuccagccuugccuuucugcagccucccuucccaccacuuuccuuaagacaccaucagcuccagucacaggaggaauaagcauuucuacccuagucugcccuuuucuucuucucccccgacugggacgcacuccccaccucuccagccucaccugugcaggcccacaucuuaccucaccccaaucucaguucaguuggcucuuuugucccaaauucccaucuccaaagcuuggaaagaucuuuucuuucugugaauucccacuguaccuaaucuauacuuaccuuguggcaucuucuaccuucuguuuugcauuaucaauaauuauaaauuaugaguauccuuuugggauaccuccuuacuagaccccaagcuccuugaugguagaacuggugacugauuaaucuuuguguucaccaugauaccuugauaguuaaauuaaaugauaaggauuuguuuaucuguaaguuuguucuuauaucccuuacccggagcucugugcagauagggggucuauacuggucuguuggggaagacgaacuuucuggacaugaccacaagauggcaacagugacugcagcguccugauaucuguagagggugggccaagucaagaaagagaacaaugucuucuugauugcaggagacucaagggaaauccaagagaauuuucaaauuuaaagcauugugucaaugcccaguuauucacagaggugagcaaauagauuggacaacuguuuucuuccguggguucauuuggccaacagcauggaaagcucuccuccugcccuuccucucaucuuccuuuuauucauucagcacauacuugaguuuccccugugugcauccacuguucuagguacuagacauacagaacuggucaguaaaaggcaggauccuguucugauagagcuuacauuuuguggccuucacugggacccaguggaagauauugcagacagaaccaagaguuuccuugcuguuuuuuguuacuucuggagucaucuuuuccccuuugccccagcauggauugauccauaguuuuauauuauccccacacguuucauuucaacaagcaaaggcaccacuggucagcgaaucacagugacuaauuuuguuuuagccaugauuauugguggccuucuccccugcuucccaguuacccaguuaaucaagaaucgacuguguucuucuuacaguugaagauauggaaguuaaagaaagguaaaaaaucaugucuaauguugcacagguggauacaugagaaaguacauacucaggucuugguaucauucauuccuuucugaucauugucaguaaaguuuuuuaaagcaaaagaaagcaaacaaguccagcauugugauaggugccuauagacaaauuugacauacacugugucugugcuaaaggugacuuauaagguggaccuaauguaaguuuacuuaaaguugcauguaguguuuagaaacauuucuucaagggguaaacaagaguguaagaaaaauauacacguaauaauuuagaagcaucagcuaucacacauugcuuguuuuaagacuaagaaguuacuaucuguuagagcagccuccuuugcgguaugaaucuuaguugaguauucauuuuuuuucccguaucagaucccuguccccucccugcaucuuccccgcauaccaaauggcucugcaagaugggauucaguuccaugcaaccucuugccaaacuugccuucauuucaggaggacgagagaagggguuuaauuugaaaggcuaugugaaagaggcauccuguguuguagaacucacaguguggaaucuuggcuccuaugugcuucagucgaguagauuuuuuucugacauguagcuauuuucucugauuuuuagcuauuauaauauuuucauaggugcauuaucaucuuuuaccaaccaaaguuaagccauaaacaggggucaguccauugcuggauagucaauaauuacauauuacccaaguuacuuuucaauuuaacaugcaaacugacugcuggcuuccgguggaucaguuuuacuuuagcugugauuuggguuuauguaugaccauggccaccauaaaauuuaagguacacccugccuaugccacagagaugaguaagaucagaaguaugcuacuucaccaaauaucacuuuuaauacaaaucucauuauauaugagccuuguucucaggaacuauucccauuguuuguccuucaaagauuccauugacugugauuccguauaagagccugugcccaaaaaaaacaaacccuuauuuuuuaaauccauaucaggccagggcagcacuuacuucugaguaacacucugaauauaacagcuuugcauuuugagcccucagaacuaugcuagagacuuuacauacaucacuuuaauucacacacuacugcaagguagauguuuuucccauccuacagaggaaaaugcugaagagagacuaaauacaucauugaaaguaguuacacagauagugaaggucagacaggauucaagccuaguucugauucuugccuuugucucucugcugcuauuccccugcacugcuuuagguucugaaucagggcaaggauucauguuuucgggcccucuccaagucagaguuuuaaaguagcauugcaaaggugauuuccagaacuauacugccugagaugauggaaagaccuucucucuguaacacaucuguguaucgcaguagggaaggagaccaggggaaugggggcaaacugaggaguguaucaucaugcaguguaggggccaccccagauccuggugcugaagcuucaagaaggaggaggcugggacuuugcauugauggguuuuaaccccauuuuguuaauuaacugucagcaaacacugcaaaggcuuaagugaguuuauaguuuaggaaggucaggccaggcacaguggcuuaugccuguaaucccaacacuuugggaggcugaggcagguggauuaccugaggucaggaguucgagaccagccugaccaacauggugaaaccccaucucuauuaaaaauacaaaauuagccaggcgugguagagcaugccuguaaucccagcuacucaggaggcugaggcaggagaaucacuugaauacgggaggcggagguugcaaugagcuaagaucgcgccauugcacuccagccugagcaacaagagcgaaacucggucucaaaauaauguaauaauaguaauuuaagaaggucacuuuuuuuuuuuuuuuuaaugcuaaccagcuggacaugguggcucacgccuauaaucccaacacuuuaagaggccaaggcuggcagaucaguuguggucaggaguucaagaccagccugggcaacauggcaaaaccccgucucuaccaaaaauacaaaaaauuaguugggcguggugacaugcaccugugguccuaccuacucaggaggcugagguaggaggaucacuugagcccaggaggcggagguugcagugagccaagauugcaccacugcacuccagccuggaugacagagugagaucccaucucaaaaaaaauaaaaauaaauaaaaaugaauaaaauaaccuaauuagaaacugaaaggagaaugaccacuuaauuguuucggagaccaacaaaggcacacaaagauugguugcuuucugaagaaucuaaaaauggcauuggguauaggaguuggggaagcaaguuguauaggcaccuacacuuaagauaauuugucaauuauacaaauaauuuuuaaaguuuaagccccuucugacaugacacguccauggcuccuucacccuucuugucuccugcagagcuccagucugccucucuugcucuuagcuccaaaaacagugaauccccugaaguuaccuagacccaccauacaguuugugacucccucuaccuggaguaccugcccaugccuggcuaauacuuguucuuuuguuaccuuggcuucuguguuacuucauuuguuuuauugaauuaaucaaaggcaagccuaucaauuagcauggcacuucuuucuuuuaaagcaacugcuaaugaacauuuuuuaaaaggcuaugcagaggcugaauugaaacacuucaggggguacuuccuuugguauuugauaaauggaacguaucccagaacuauuuaucauccguaggucucaguuccaguuagauguauucuuggagacuuuaaaucauguagugugauaugccagcccauaaagcaacaggugaaccgaacuggcuuccuccaaguuugacagcugagaauguggcucuaaaaccugccuagauauauauccuuuucuaguaaggucugagugcaacucacauuuaagccaauauuccuuuccucuuuuuucccucccucugaaugggaaggagagauuuuagucauuuugagucauugcacuuaaaggauuuuaguuuaucaguuugcagaaaguuuuauuuucguacuucuguaaauuuaugugaugaugaguuucucaucauuuuguuuuuuauaauacaaaaacucugccauuuuauuguuuuuuaacaguuuugggggguauaauugauauuguauaaacugcccauaugugaagggugcuugcaguuuucacauauauaugcauacgucccugaaaccaucaccauugucaacauagugagcauauccgucauuucuaaaaguuugcucauggccuuuugugauggaucccucccuauccuaccuucugucccuagacaaccucugaucugcuuccuguccucuauggauaagcuugcauuuccuagacauuuguauagauggaaucgugcaguauguacucuuuguuuugcccaacuucuuucauucagccugcuuauuuugagguucauccauguuacuguauguaucaauagcuuauuccuuuuugcugcugauuaguagcccauuauaggaauauacuacaacuuguucauuuguuuugggguuuuuguuuuuguuuuucugagacacagucauacucugucacccagacuggagugcaguggcaugaucuuggcucacugcaaccuccgacucucagguucaagcaucccagguucaagccucccaaguucaagugauucucuugccucagccucuggaguagcugagauuacaggcgccugccaccacaaccggcuaauuuuuguauuuucaguagggaugggguuucaccauguugcccaggcuggacucgaacuccugaccucaaaugauccauucaccuuggccacucacucaccuuggccucccagagugcugggauuacagacaugagcuaccgugcccggcuaaaaccugauuuuauccauucacacaaggauagaccuucggguugcaucuaguuuugacuauuauaaacaaagcuacuaugaauagucaugaacaagucuuugugaagaccuauguuuucagaucucuugguaaauagcuagaugugaaaugcugugucauaugguagacacauguucaacuuuuaaauaaauugccaaacuguuuuucaaaacaauuguaccauuuuuaccuuccuguccaugguagauaggaauucuauuuguuucacauucucagcagcucuugauacuguccaguguuuuuaauuuuggucauucuaauggguagauagcauuaucucacugugguauuaauuugcauuucccuaaugaucagugaucuuuucgugugcuccuuuaccauucauauauuuucauuggugaaaugucugaucagaucuuuugcucauuuguuaauugaguuguuuuuuauuguugaguuuuagaaguucuuuauauauucugggugcaaguaguuuaucaacuuacaguugaucucugcuuugcagagauguuguucuaaucuucuaauggcuuguccuuuuuauucucuuaacauugucuuuugaggggaaguuuuacauuuugaugaaauccgacuuaucaguguguuuauuuuauggguugugcuuuugguguugugaccaaggacuuuuugacuaaaugaaugccacagaaauuuuucugcuuucuuccagaaguuuuauaguuuuagguuuuauauuuagguucaugauccauuuagaguuaaguuuucuauauggugugagaugugauuccaauuucauuuucuugauguguagauaucaaacuuuuccagcagcauuuguuaaaaaaacauuauuuuuggugaaauaauuuuuucugauuauaaagacauuuguaaagauuguaaagacauuguaaagauuauaaagacauuuguauaauguagaaaaguauaaagcuuauaucuuccuaaucuucuguuuguaauuuaccuagguacauuuaacaguauugggagaaggagagcuaguuuuaagugcauacuuuuaaaaaauuggaauaauaguguaaaugcuuacuguauguccugcuuuuuacaauuuuaacauuguaacuuuccccacauaacuuaguauucuuuaacugcucuuucccauaggauuuaauauucuuuaacugcaugguuuuuaauggcugcauagcuguucugucacaugcauaucacacuucaccucuucugacauuaucaauuuuuaaucuuaaaauauacuuugaacaucuuuauacuuaaauauuuuuuauuuuugcuuaaauuuuucuaaaugaauuaucaggucaacauauauuaacuuuuauauggcuuugauuacauaguugcacaauacauuccagaaagguuucaacaauuuacacucccaucagcaguaacuaagcaauuuaauccuuuauugcaaguuuuguuuguuuguuuuuguaaaacccucaaggauacccuggacacuccugugcuucucuuaaaggcaaauauuuuuccccuagccaagugccauucuccuuucucauucuucccagacauaggacccuucuacucagcacuggccaaggugagcaaacuccaugcauuucuugccuuugcuaccaaaaaacuuagcaggaugaacauaccucccuccuaagucuaguuugauaaagaagccccuuuucuuauccagggcaaaagccucuccaucuucucuagaucccauucuacccugauucuuccaagaaugccccacuuucuuccccgccucuuuguccucagcauggaagcauucucuagucucucccccugggaucuugaguuucccccuaccuuguuuuucucuucucuuuaggugcgaagcuccuagaaagaaaacauccucuuguugaauaucauuugcuuaucacccaaugagcuauccuuauuuacacauucucauucucccuccucccauucucucacucccucccgccccacccaauaacuucucuugcugaaguuugguguccucaugccuaaguggugaaccuaugggccaguucuguagcucuuagcauuuuuaucuuugugguuuccgccacauuuuucuuccuucuccuugaaguucuaucucuggucuuucuccccuuaaauuagcugauuuugccucauagaggugaucuuuaggcucuaucagcaauuaaccaguaacuuggcuugaaucugucucuguaagaguuggcuguacaacuaucauugucuuucuuccucauaucucuuuuuguuaauacuauuaggcacauaaguggacuuucuucuaguaaaucuuauuuuugcugguuuucaucuccgcuuuggauaacuccaacacauaucuucugugucucauucaaacaagcacuuccuuuccucccucucccguccuaccuccccaagcauuugcuguucucagugcuuucaauccaucucauaaugaguacaagagugugaacaguccagcccauugggcacuuuucucaucugaauccguacagcauguauaaauuacacuucacgguagccagaaggucaucuuagaaucuaaucaucugugguucuaaucucugacuucuuuuuuggcagucaugcccuccccuacaaccacacacacacuuuuuucuuugucuuucuuaauuguacauuuuuuaaggcaaaaaucaccaaauauccauaguacucuuuuccuuuucugaccuucugugguacuuuuuuauaccauauaauauuguuuuuaaauguugauuugucacucugauaccacguuauggcagaucuuauuuaacauuuauauuucuuaacuugacaaaagguauauauucuuuuuuuauauacauacuuuaaguucugggauacaugugcagaacgugcagguuuguuacauagguauacacgugcuauggugguuuguugcacccaucaacccgucaucuauauuagguauuucuccuaaugcuaucccucccccacccccacccccugccaaugacaggccccggugugugauguuccccucccuguguccauguguucuuauuguucaacucccacuuaugagugagaacauguaguauuugguuuuccguucuugugguaguuugcugagaaugaugguuuccggcuucauccaugucucugcaaaggacaugaacucauccuuuuuuauggcggcauaguauuccaugguguauaugugccacauuuucuuaauccagucuaucauugauggacauuugggcugguuccaagucuuugcuauugugaacagugccacaauaaacauacaugugcaugugucuuuauaguagaaugauuuauaauccuuuggguauauacccaguaaugggauugcugggucaaaugguauuucuaguucaagauccuugaggaaucaccaaacugucuuccacaaugguugaacuaaguuacacucccaccaacaguguaaaagcauuccuauuucuccacauccucuccagcaucuguuguuuccugacuauuuaaugauugccauucuaacuggcgugagaugguaucuuauuguaguuuugauuugcauuucucuaaugaccagugaugaugagcuuuuuuucauauguuuguuugaaacauuucauauguuucaaaugucuucuuuugagaagugucuguucauauccuucgcccacuuuuugacuggguuuuuucuuguaaauuuguuuaaguuccuuguagauucuggauauuaucccuuugucagauggauagauugcagaaauuuucugccguucuauagguugccuguucacucuuugauaaaccugacaaaaauaagcaauggggaaaggauucccuauuuaauaaaugguguugggaaaacugucuagccauaugcagaauacugaaacuggacaccuuccuuacaccuuauacaaaaauuaacucaagauggauuuaagacuuaaacguaagaccuaaaaccauaaaaacccuagaagaaaaccuaggcaauaccauucaggacacaggcaugggcaaagacuugaugacugaaacaccaaaagcaauggcaacaaaagccaaaauugacaaaugggaucuaauuaaacuaaagagcuucuccacgacaaaagguauauauucugcagccacaacuaaccugugugcuccuacggaacagggaucaugucagucuauacccacaguaacucagacuggaaccauacauaauagguguugguaauguuuauuccaucagugucagauauucgucuuaggagagugguaaccauguauaauugagccuugacccucuguuguagggaaaugaagcaggugauuuucugcauagaacuuguggcuucuuuuucucucuuaguuaauaucccuagagaucagucuucauaaccugcaccaacagacggaugcaaacauugaauacuucagaauacauuuugcauuuucuuuguaugucguugaggauggacaugaccugggaauuuaauugaaaacaagcaauaaucgcaucauaaagacuaauucaagagcucagaaauugucccuggcuccuuauucugccucugcuugagggugcucaguggcuugcacccuucucuguggacagguggccuggucucugacugaggaaagcacucauggggcaagauuucucccauagcaauuguuaaggacaagauagacaccacaaaagguuuuucugaaaacuguguugcagagaagauaauggguguguuuagaacauaaauaaaauaagcagcaguuuugagaaaugacaguaaacuugaaauaauuuaucaaaaaugugaauaaucuagauaacugugauucgggaggaaauauauaaaucuagggauauuaauuuguguacuuuucauuuuuccauguacuauacauuuuuaacaggauuuaagauacauuuuucaauaaagugcaaagaaugugaauaaaugauaaugaauuaaaagcaguuugguucauaugccauuaaccagauuggccugacuuuuggaauuuaaaacuaacucuucuuuucuuuuuagguugccucuuggugcugccuuggccguauuuggcacccagaaugcuucauucugugacggucuauuaauaagguugccuugcuagaguuuggagcagggccucagguagguggcuuuuaucauuauauggcaugacuuucaaagugauuaauuauuccaguuccuaaauacuauaagauauaauauuaaaagcuuugaaaagcaugccacauaauaagcaugccacuuacaaucuuagggucuaucaguauguacugugauggggacuucaguaauaauuauggucgaaugggaggcuugaaauacuagcaaggagcagucuuccucacucuuugcacaaaacacauagcugcuguaaaaacuuaauuuguuccuguuccccagauagcccacagauguacucuuaagcucuucuuucucuaaaucuugcacagugauacaguaucccauguugcccuuauaucuuuuuuuuuuuuuuuuuuuuuuuuuugucuccugggcgggauccuauuaccuaugggcagguggagagggggauuagacuugcucacagggauggggcagaugcuagaauaaggaacccaaugcaacaauagcaauuugccagcauuguugggaagaggacacacacaagcuaucuagauuucccagccuguaggcgcagcucagugucacagaaucaagguguagcaauacuuggaaauccaggcacacguggauuugguaccagguaagucugucaguacgaccuucaagauaggguagagguugagaggccaggacccccagcccuaggacggggagacuggaaaaaaaaacaaugguggcugugacagauaccaggggaugggcuccugaacucuucacugauggcagaugggggaaaggaggccuugggcaggguuucacaagauacaucaacagagcuugaucaaaucaaagguacacgaauuaaucgggcuaaaauuuucuauaagaacaacauucuauggguuuaagcaucaacaccguuagcauuaaaauuuuagcuaucaguauacuguaaauauuuuagcuaucuguauacuauaaaaauuuuagcuaucuauaugcuauaaaaaucuuuaguguuagggguuauggauuuuuuuuuucuuuuucuacuuuacuguaguuuuuaaacuuguuuucaaugaaguuguuuuuuaguagcuagaaaaaggaaaaaugacuaguuuuacuuagccaaacuaaauuuaugcagguuuucuccuuuuuuauucuccuauaucuguaaucaguugaaaauuuccucugauauuuuaaacaugauccucacauuuuauuuucacaugaaggauacccucuuuuaaagauuuugaauuuuacuuuguuccuuuuuccuucccauagaacuucacuggcuauuucuaaaugauaaaucaugaucaaccuguaguuccaugugcuuaaggagcuauggaacaggacauuuaaagcagaaguguucuaaacguccaggcuggcugagugcuacccagguuuguauccgugcuuggcgggcucuggguagcacgugccugagacucccuggcuuuugaggucugccgaagcaggugacgccucuccuggggacacagaagcaguacggacucccagguggcgguggugcuuucccuaaguuccuaccucucugccaaaacaaacuaaccauguauuucucuggggcuugucuucugagcuugcuuuauaaccaauuugaaauuucaggagaccugaaacauaguuaccugcuagcuuugauuccugaaauuuccuuaaagggaccacaguucuguucagcaaaugucuaucaaaugucugcuacaugcuagggugcugaccaggugcuagggauacgaggaugaauaauaguaucccugcagaugaauuuacugucgcugggggagagacaggucagacaggucauuucaagaagagcuuuccaguccauauuaagggugaaagguucagagagguaagguuuucaaggucauucuugaucaaauagaauuggucaaggaauauagauaacaaaccucuucuaauuguuccagccaggagaguacaugggguccucuggaggcagaggagagagcggcuacccuugacaugaugguuuugccuagaacugauccuguuuacccuuaacugugugggaauaaauagaaauaguuguuucuagaagugauuuuauccuggacaugcacaugagcauaacuuagggaggacagauggaugguaugugcagaccugaaccaggccaugaauucuguuuucauuacauuuuuuaguacuacuaaagcaucagcacauacacaacauuuaugccauagcacaagccugucuuuaaaguacacuuuacuuugagauggcuuaaaacuaauuucugcuugagcuuuuauagauaaguacaacuuauauuuauagcuaaguaaaacuuucuuuagcacuuuucuuauaaagugucugaugucugccuuuuuguuugaauuuauaggcagauucaguaugggugcuugacaguucagacaugaaaucuggauuauucuguauuugcgauuuuaauagcauuaggcaauuuacuauacaugaauggaggcauguucucuagauauuuagguuccuucauugugaacauuuuuauaguuggugucaaacauuuuuguuguacccccagaaacuuaaucaguuacugguaauaagaucaauaacuuaccacaauuugggauacauacaguuuucagauugagcugaccugugggcuaccuacuuuguaaucagaccaagaucaccaauauuuugggacuguuuuauagaaaaaaaaaaaagcacaggaaauuaucuaaaaauagaguauugauuaagcagucuuacuuugcauucagauauaauuguccuucuuugcucucugaggcaucauugcuucccuuuugcacaauuucuuuuucauuuccucuuugaaaauacuaauggccccaugugaaaaaaaugaaaauaucucaguguuguaccacccauuguauuuuuaagucuuuuuauuuugauaaaaauacacaaucauagggaaccccccacccccaccccaaauagcaguugaaaugaagugcuucuaaguuguggaucauuagaagggagcuuucaguugggcaugguggcucacgccuguaaucccagcacuuugagaggccaagacggguggaucacuugaggccagcaguucgagaccagccuggccaacauagcaaaacccccaucucuacuaaagauaacaaaaaauuagccggguaugaugguacaugccuguaaucccagcugcugcggaggcugaggcaugagaaucgcuuacaccugggaguuggagguuucagugagccgagauugcaccacuguacuccauccagccuaggugacagagugaaacccugucucaaaaaaaaaaaaaaaaagaaaaggaaaagggaguuuucaaaagagaaaaaaaacuuuuaacuuaacguggcauuuuugcucuauaaaauaaacaaccaaggaaaauaugucugaauugggagauaaaauuuacuugauacuccuucuucauuggguuaucuguucauucucucuggcuacucuagaaaaugaguggccugaaaaggaacauccugcuuguacagauaagagaacugauauugggguuuucugauuccacuuuggaauucauugacuuuuuccuguugguucuuacagacaaaaaguuaugccauuuuuccccucacuucucacuucucaauuaguuuuuauuaucuguauacuaaauauaagacauuucuaaacaucaguaaggcuaauuuuuaugguaaauuucaaaaagauguccuagaacuauauuuuaaugaauugcucaaaaugaguuaaaaauauaaaacgcaguaauucaaaaagggcauccuuauuuuugauuaacuuuaguuaacuaugacaucuaauuuaggaaaguaaauaguguaguuuuccacaauccaguuauaaaaugcauuuuuggggaccugcuguaaacucaggcgaguuaggugcaugucuuggcuaugucuccugcuucacaguaguugcuccagcuccuuucuguuccccucuguagggaccagcagccccaacugagagucucguccuuccugccccauaccaaggacuaaugcaggcaucaggcguguuuucacuuuggaaauuuuuauuacgaaugggagccagacugauguuaucuacuuguauuaguugauuucuuaguauuaagauuagagaaugcuuguuuucugaggcaaaauaaguauuuuuagauaaccuuuuauuacaauugcuauuguuuuaaucuaagacuuuucaaauagcugcuuaguuucaaaaaaaauacuguucuauuagcuuauucaauuuguuggaccaaauuguguucauacuacauuaucuuugacuugaauauagauacacaguugucccuugcuauccaugagggauuaguuucaggacuucccugggauaccaaaauucacagaugcucaaguaccugauauaaaauggcauaguauuugcauguaaccuaugcacauccugccaugaacucuucacaucaucucuaaauuacuuauaauacuuaacacaauguaaauacuauguaaauaguuguuauacuguacugcauaugaaauaaugaccaaaaaagucugugcauguucaauacaaaugcaguuuuuaaaaaauauuuucaauccaugguuggcugaguccauggaugcaaaacccacaaauacagagggucaacuguaaauucuaucuuaugucuauuaugaugacuaagcaagccuguaggucauugugaugcugguaagcacuuggcccuguuuuaauuuuuuucauucauucaacaguuacuuuaacugccuuuuaugggaaacaacagugaauaaaacuggcacaaccucucugccccuguaccgucugcaguugauuuuucauucuuagguuuuuauaagauaguuuuuuuccuguuauuuuucacuaauaagugauuuuacagacuauggaaagugaaugcuguaaaaauuuacaaauuaugcagaaacaccgaaguuauuucuuaaaaauguucuaaguauacuguugcccuuacuucaaaacugacugccuucaguuggguuaucuuaguaauagauucuuucauauuauucagaacucucuuguguuucauacauguaaauuacaauauuaagaacugguaaguuucuuuuugcaaccuacuuuauuuacucuauauggaaaaaccuguuuuaaggaaauuuuuugacaucuucugaauuacuuacuaaaggcaucuuguaagcauacaggagaauaaagcuuugaugcuugaugguauuugcccuuaauuagcaaaaucuguuugacuuuuaaauaugaaauaauuauugaugcagguaagugaaaaaauucacagcucuuagcaaaaugauuaucagaacuauggaauuuaaaauaagcaguuuuaauacaggccuguucuuuugcuggcaucucauaggaacugauuuuaguagacccucugauguaugacucauuuuggcuuguuaguuuuuuauaugagucacuguuuuagaauaauguaaaacaucggaagauaaaucugggugugugugcacaaacacgccauacucucucuauuguuucuguaugcaaaguugcccuggaaaaaauugcuucuucugguaccaacaaaaacuagaaggguauucugaacugcuguucaucuuagagugauuugaaauggguguauguauuuucuacuuugguucacaguucaucagaccaaggcaaaggagaauuuucgucacuugaaaagcacaauaaccaaucuuugugaguuuuuuuuuuuuaaguagaaaagaaaaacaugaguaccaaaccaaguuuuguugcacuuuucagaauaguacuccuggugcuuuuuaaguuuuucuuaauccuauacaagagaauauacagauaauuuuaucuaacuuuucaguuaggauuacauaaauacaaacuguauauuuuuuauuauaucaauccaaagaauaauuucuaaccaguccugcuuucuuuuuuggggggagauauuuaguagaacuuugaaauuauuuggcaacucauaagaacucaaaauagguucaauuuagggaaauuaagaaauucaagauuauguuuugggauaaaauaaaaugauuggcuguguuauuuuagacuguaaaauacauagaaugggugauuucuagacuauuggaauaugucacaauauacauaauuuuaaacuguguugaaauacuuagaugcuaaagguuuuuauuguaaaaugucauugaacaauaagcauaaauaaagauuuuaugaauguauuugagaaugcaauaaaauuuauauggauuggagaauaaaggaaaaaauacauaaacuuauuguuuacuaguuaacuuggguuuucaauuuguuucuacccaaaucguuuuccacucagacagauguauuagcuauuacuuuacauuaacaguuguuuaaauuauuuaaaacugccuuuauaaacugucuuuuaaacuuuuuaagucuuaaauuuauuuccuuuuggauauuuggcagcucuaaaagagaaaauaggcacuauccccucuuuugaucuuuuaaggauagugacaggauuuauccacuugcaaauugguuugcuaaccugccuugucauagaaaacaguagaauaaaagugaagucacaguuuuagggcauucaucccuucuuuaucacacauaugcugucaaguuguucaucuucugugggccucucaccuuaaaauggcaaugaugguaaacacauccaccucucagauucauugaauuccagggagauaauagagaugaaaacacuccacacgugucagguauuuauauucuuaaaauaacauaauacacaaaauggucuuucauauucguaauuacccuacaaaaaacucaguaugugcccugggcaaguaaguauuugcaaaguuaauguuauuauuuuguaauuuugaugugcagaauuccguucuuccauuuaugcauguccugugcuuuacaaaagaauggagcuuuugcuuuaauguuuaaaauaccuuuauaggucuaaauuuuugcuuuucuugucuuuuaaacuauaaaaaaaugcugcuuucagauauacccuuggcauuuuuauaaugaugcuugaaugccuucuauuaaauacuuuauuuagacaucaucaaauucuucaaguaugaaaguuuuauuacaggggauauuuuuagauuuguguuaagaaucugaaaguuauuuuuauuuaaccugucauuaacauaucuguuauuuuaacuguuugauuuaauuaucccuuuauaaucaugauuucugaauguucaucuuuaaaauacucugaguuuacugaucucucaugccuugugcucucuacaauaggugauucuauucugccuuuugaccguuauucuuuucauguuuacuuguacgaucaagaauuaacagauuguuuucugugugugaucucagucuacuaaugaucauacuacugauaaacauuauaagcuacuuuaagaguuuucaacaaugaccucuuaaaccaaaugaugcucucuuccuaacaccccuuucuucuguagcaaaucuauauuuaacuucucuugcaugcuuuugaaaucuaaagagugcagaguuguugcuacauuucaaccauccuugcagcauccugaaaaauaaauuggcagguguugcagauagcaaaaguguagcucugagaggcccccguugugcuagugugcacaguaugggcugagugcuuucaccgggagccuguuguucuuuggguggcuccagauguacccuccgaaaggggccuaaaauugucacuuccauaauauuaauaaacuuaauaaaauuuugaucauuugguuuauaaacaguagcccuaauauccauuucaguagguaagucagauuuuagaaauaaauaaauuugggaaagaaguggggagucauucagcaucacaaauugcuauuuaucuagguaauacuuuuuauuuaugcauuuauuuggucacguaaaugugcuuagaccuaauaaacauauguaguuggugaaaauuaaugcaugacucguaagcagaguauggaauguaagcaugugccaugaaacugcaauucuuuuauccuguauuuuccaucauuuacauaccgguuccauuuagaggauaguccauuuucacuuuuuuuucauagauuggccaaaaugggaaggauuggauuccacucucuuccacgaagagucaaugggacuggcuaagaucaaagucugaggcuuuuuccaucaguaaucagguaugcauugaacuaaaaaucacuauaauucuaugcaugcaccuuuaaaguauuugacugauaugcauauuaugaauguggucuuuuauuagauuuugagcucacaaccuuauccuauaguuugaaaugcaccuaugauaauuaauuugaguuuuguaauauacuaaaauaaaaagguauuaucagccaugaaaaaauuucagcuggucuuagaaaaguguaauauuugaaaucagugcaaucuucauugcucaguauguacauccaaagauaacagaauucauuuguuacuccauauugauuaucaccaauuuuaguaacaaucaaauguuuguauauugcauauuggugcacuucuaauaauuuuuuuuaauaacuuagaaguuguuuuucuuaacuggaauucuuugcccauuaugguuggauuuuauaacacaauggcaaauaugaccagucuuugaaguauuuucagauauuaguuauauacagggauuuagauacuugcauuccauguagauucugcaauugggaaauguucaauuuguuucccacgauguucuaaauaggugcauaaaaguaucagguuaggaaaucaaauaaugaaaauuaagguuuguuuccugccuugguagaaugcuuuauaccaguuuauagugucauuacuggucacagcagaguagcuguuuagauauuuccaagggaagcagaggagcuagcuuuugaaugagaauauaacagaaauagagcaagaagcccuugagauccagaaaaucuaaaacaaaaagaacauauguuaccauugguaaugucaguugcauuguguuaaugucacuuuuaaacagcaaggcggauuuuuagaccguuugaauagcacaaaggccuugccuguaucuaccuaauaaagaaagacaccugaagcaaguacugaugaacuuacccauaugccuuacuauguuaauaaagugaguggauaauugcuguauuuugccuguuuagaaacagccuuuacauuaaaauaaaguuagaccuauuguaacauagaguuaauuuuacaaaaauguagguauuuagagcuccugcgaaaguauaacuggaauccgugaaagucagucuaauaguaacuugguaguagcuugggacagcaagugucagugucagucuggugccaaaacacaggugauauaaggaaguugguuuuaaaagagguugcagguauuauuucuauggucucuuaaaaguacaucacaggccagguguggcggcucacgccuauaaucccagcauguugagaggcugagacuggaggacugcuugagcccuggaguucaagaccagccugggcaacauauugagacccugugucuacaaaagauaaaaaauaauuagccaggcauaauggcauguaccugcagucccagcuacucgggaggcugaggcacuugaagauagcuugagcccagggaagucaaggcugcagugagccaugauugccccacugcacuccagccugggugacagagugagacucugucucaaaagaaaauaaguacaucacucaacuagccuuuauaaacguugaggaauuggaacuuugaggaguugguuuucuuacccuagaaacagagucgauaauauuuacuauguuuugucgaugaauuuuuaaagguuuuaauucauuuuuaaauuuuuuguuuaaaaagauauacuccuugcuguacaauauguacauuucauucuuuuuugcagcaccaauaacacauugaaacucugacacaccuuuuuaccaaccuuaaacaccucuuugaugauguguugugugccaugucagaaguccacacaggucugcugcacacagguugcagguguguccaaaggccaaugcccucagcucuuggggaugccugcugacucguuuaccuacuaaccucagugugccuaaaauuuuugugaugugaaaaacgaugaggaaaauuacauuaaccaugucuuucucccaaaaugacaaagagccaugcucuucaccuaauaaaacaucaaaagguuuuacuauuugaagaauuuguauuuguuaggaagaugaaucauuucuacucuugacucaggaaucccucagaguaugaugacacugguauaaugcaucacuucggguggugcauucaacucuuucaggccucuagugucucuccgugaaguaccucuuccacagacucaaugguucacaaggugccuaaaagaguuuucaguugcuuaucucuguuuuccuauagugcagucugacuagagcugacaugcacaaaucaaacugauuuuuagagacugaaauauuugcugaaacguuuuuagucagauuuuauguucucugaucuuuuguaaaaauugaagcuuaauaaugccacuuuuuagagucauguuuugauucuucaugagaguuccugaaaucacuacugcuaugccuaaguaaaacaugugucaaguggaauuucaggguauguaugaacuguucauucugagcaaugcauuucuauguauuuugacaaauauaaagaaaccuaugggguuucuaauguaaugugaugauauuacauuagaccagcugaauccauuuuauugguuucuuuuuuaauucaaaagcaucacauagcaaauaaaauuuuuaaaaauugaguuuaguuacaaacuaguuguuucuuauuuuuuuuuccagucccuuuuugcuuucuuuuacgaccacaugaaacuugagaagccaccuaaagcuauaucauuuaguggaguugggcaguucccaaguguccaacaagaaggccugguuuaggcugcgauggccacugucauuccuggugauuugucagaaguaagagauacccagaaagucccuucagggaaacguaagcguggugaaaccaaaccaagaaaaaacuuuccuugccaacugugugacaaggccuuuaacaguguugagaaauuaaagguucacuccuacucucacacaggagagaggcccuacaagugcauacaacaagacugcaccaaggccuuuguuucuaaguacaaauuacaaagguauuaaacucuauuugucuuucagauuauauuuucucuuauguuggcuguuugaagccauuguaaacguauguauuuguauacacauuuuucagcuaauuugcaaagaggaaauguuaaguagauuagacauugguuuaguuuuuaguauucuaaaucacauacuuuuauguguuagugucuuuggacuuuuuaaaauaaaaugcuuaaugaguagaauuuccauuuguagaaagaaauuacaacaagaaaaggguaaggacguuuacgugaguauauucagucuugcucauuugcuuuuguaaugauagcuggaaaccagcaaaaacuaaaguggcaacuuaaauggcucaaguuuugcaguaauuagguauauuaacuauccucgugguauauauuaaguuaaacaguuuccauuacuaagggaauucuguguuagcauaguaguuuagcuuccauuugaaaagugaauacaugccauuuuugucauaauaacuacuuauagauuauaucuguguuuaaaggcacauggcuacucauucuccugagaaaacccacaaguguaauuauugugagaaaauguuucaccggaaagaucaucugaagaaucaccuccauacacacgacccuaacaaagagacguuuaagugcgaagaauguggcaagaacuacaauaccaagcuuggauuuaaacgucacuuggccuugcaugccgcaacaaguggugaccucaccuguaagguauguuugcaaacuuuugaaagcacgggagugcuucuggagcaccuuaaaucucaugcaggcaagucgucuggugggguuaaagaaaaaaagcaccagugcgaacauugugaucgccgguucuacacccgaaaggauguccggagacacaugguggugcacacuggaagaaaggacuuccucugucaguauugugcacagagauuugggcgaaaggaucaccugacucgacauaugaagaagagucacaaucaagagcuucugaaggucaaaacagaaccaguggauuuccuugacccauuuaccugcaaugugucugugccuauaaaagacgagcuccuuccggugauguccuuaccuuccagugaacuguuaucaaagccauucacaaacacuuugcaguuaaaccucuacaacacuccauuucaguccaugcagagcucgggaucugcccaccaaaugaucacaacuuuaccuuugggaaugacaugcccaauagauauggacacuguucaucccucucaccaccuuucuuucaaauauccguucaguucuaccucauaugcaauuucuauuccugaaaaagaacagccauuaaagggggaaauugagaguuaccugauggaguuacaagguggcgugcccucuucaucccaagauucucaagcaucgucaucaucuaagcuaggguuggauccucagauugggucccuagaugauggugcaggagaccucucccuauccaaaagcucuaucuccaucagugacccccuaaacacaccagcauuggauuuuucucaguuguuuaauuucauaccuuuaaaugguccucccuauaauccucuaucaguggggagccuuggaaugagcuauucccaggaagaagcacauucuucuguuucccagcuccccccacaaacacaggaucuucaggauccugcaaacacuauagggcuugggucucugcacucacugucagcagcuuucaccagcaguuuaagcacaaguaccacccucccacguuuccaucaagcuuuucaguaggauucugggacauggauucauuacagaaauguauguguagcugugcccuagaugaccauuuuuauuuuagugccuacuuuaaaacaguauaaaaauuucugcuuuuguauaauacaaauuuucauuaagccaguauaaaauagaaacuagcuuuuaaacugagcuuuggaaccauuuguguucaguuaaguuuaccuggguauuuuguccugauucacugccaauugucacauuuuaagacuuuuuuuuuuccauauaggaaagccauuauuaguaguaaacuuuuacaaaucccauuuucaaauuacuuuuagaucuuaaaauuuucauuuuugucuaauaacaguggcucuaccuuuugacaucuggcucauuaaaaaauuuagcaauagaauguaaauuguauaaaaaguuugugaauaacucaaggguuuaaauuuucuuacuagcuucuaaauggauuaauaaucaagugcuucaaaugaauuaagaguccaguuucggaagauaauaaauguuuguuagauacaccauaauuucagaucaguauauucugaagacucccuguugucuggcuaaaauauuugccaucuuuauuaugagccuuuaaggaaaacaaacccuaaacacaaagcaucaguauuuauagcaaaaagagacucuguuaggugacauggcauuucgugucacuuaauaguuggcccuaaauuaguacacaggauauuuugucguguuucauccuucuuaacaugcuaucuuuucauuuaauaauaguaauaguguauggcauuggggucuucagagucgauauauagguagaucucuuuagucuuuuccaccuuucacauccaaggggugggucaagugcagccagcaauuuauuuucauuguuggcccacgguuaguccauaaucuagagccauuguggaacugcagccaugagguguguuuaucccacaguggauugacucagccucugugggugacagacuucuaagcaggaagauagacgugaagcacaugguuacauuugggaacuuguguagggaucauggccccuguagccaggguuaaaaacuggacuuuuuagaaguaaaguaaaagcauaucgcuuauaucauuucuugcugaauuugauauguuuuucuuucccuuaagaaucaaaagcagaaaacaaaaacaacaguccuacuccgauguuaucuuucugauucaaugugaauccaucuuuccuugcaauauuuuggauggagaauuugaaguuaaaugcauuagaaaacuaccugaugaacuaccacaaaguuuuaagugacuagaaauauauacaguaaaaucccacuuucaugcaucucugggaaaugauaggaguauugcaaauaaguugaguuuguagaggguaacaaaguaaaguaaaacaaaccuaucuugguuaacaugaaaauaacaauugagaauauauuauauucacugaauaauuauaggcuuuuccucacauuagacaaccaacauaaucuucuuaaaggucuaauuaauauauuuuucuaagggucaguugggacauuaaccuaagaaacauaucuauuaagcacuuguuaacaccuuauuuuaggacccuuuccguuggggaugggggcaagggugggagguuuuuagaagaguauauaucucuuuaaaaaaaaacagaaagaaaaauauuucugagcacucauuagcccuauauggaaacuucuuuccuuuuuguagggccaguuaucacugcagauugcaauguuuaccaagaauuucuaaaaaugagugcagauuacugaauauaauacauuauuuaaaauauuugggaguaguauaauuuguggagaaauguaaauuguaauaauguaaaugggggcuucaauauauauauauaauacacacacacacacacaugcacacauaccgcacuucauagaaucaaaguugcucucugaaggagcuuuggcuccugauauuuuaucaugcuccuauauuuuuuuaauccuuggagcaguaguuuuuauacuuauguauuuaaauuuuauuaugaaaaauuacauuuauuaaaaaaguguguuccaaaggcauuaaaauuauauauguuaauaaggaaguacauuuuuaaauuuuucaaacugcuccuagcuuuugauuaggagaauauuuuuucugaaaguaggcuuuucgcucugcuucauuacugcuuccuuuaguuucuaugaaacagauugcuuaccuaaaucuuuaguugaaugauuaguguucaauauugcuuuaaucaccauauaaaaggaaaaaaauuggugacagagcacaaauagaaaaccuauuuuuaaauagaaaucacaaauagcaaguguggaagcacuacuuuauucuguuuaaaauguacuuaagaagucaucaaauuagugaacugagacauuggccuuaguaggcuguauucacugcuaauuuaaaaaagggaguaccaggauuuauuaaguaaagcauuuuggaaauggggaauagcgccauauauguauguauguguauguguguguguguguguguauauauacacacacacacacauacuuaaaucuugcccugcaugaaauucaaauacauggaggcacaucuucagggcaccaguguuaaaauuuuggagucuuaauuuucauguguacaccucuuugccuguucccacccccagacuugaaauaacacuucagaguaagagggaauucagcuaauuuguuuuuaaaauugacuguaguggucacuaaacccuuuuugagagaauuucuauuaaagaugaggcagacucgcuuauuugaauugcacaauguucuaacaaggauguaac

SEQ ID NO: 13886 - RNA, 5892 nt, Homo sapiens
cccuguggcccccacccgagcucggcggggggagcggcgcgcgggugcugggggaccgaccccucccgcgaaggcgucggcgcggggcuggcguagggccugcgucagcugcagcccgccggcgauuggggcgcgcgcgccuccuucgguuuggggcuaauuauaaaguggcuccagcagccguuaagccccgggacggcgaggcaggcgcucagagccccgcagccuggcccgugaccccgcagagacgcugaggaccgcgacggugaggcccuacguccgccagcacacccgggcccgcuucuccccgacgcccgcccuccucacacuugccuucuucucuucccucuagagucgugucugaacccggcuuuuccaauuggccugcuccauccgaacagcgucaacgugagugaauuugcccgaagcuugucuuugcugagcggguuuggggacgucugcccgcccucuuucccuucacauuucauugcauggguuccccaacagcguucccugguucuucuuugugaccccagucaauguccugccucccccggcucccgcucucucgccccuggucugcggcguucucuccggaaucuugcccugggccgcggacgcccaggaaaagagccgggugccccaggcagccucgcguugggggcgaccgcgccaucccgggaaccgcgaggcgaucugagucgccuccacgucuaccuaaaagcugucggccgggagggcggggccccagaaaggagcauuccugcgggcuuuugcucgacgauccccugcugaggcugucgcggcgaggguccugccgagggaccccguucugcgcccaggcaggcucgaagcacgcgucccucucuccucgcaguccauggcgcgguuccugacacuuugcacuuggcugcuguugcucggccccgggcuccuggcgaccgugcgggccgaaugcagccaggauugcgcgacgugcagcuaccgccuagugcgcccggccgacaucaacuuccuggugaguguugcgcgcggcgaguguugcgcaccuugugagacagaguuuccgcaacaguacgcggacugccuccggcccaccgcgcggcgcguauggcgguucgcaccgggucggagccgcagcggcgcgagcccguggugaccugggugucucagcuguuccuggaacacugacugaaguccugcccuggcucuuagcuucggggauccgcgacuaucuggggaccgguaaggguagcggugucgccgcacaaaccaaguuuguuuuaacccugggaauucgggaaccccgagaaguccucuguucagcaccucggauagcacuggguucucuccugggcugucagaaggaagauggcugucaccacaacuccuaacauaucccagcuaagggccccuccacacgcagucaucuucccaucuuucccacaaauaauguaauuuuuuguuagugacauuucggugccuuucuuuagauuuauguuccccagcucucuuaaccucaggucccucauucccuacccucaccuguaaauaggagagagcaaagggauggaaaagggguacggggagaggaaggcgaaauaaccguagacaggaaagaguucaaacugucucacuagccagugaugcuggaauucaacuucuguuucaacugcccuuuguaauaguaacuaaaacaacaguuuaauuuggcuaugagaaaggaacaagagaaguggccaguguccaaugggugacaacaguccaaagauacacugcacuacaggggguuggggaaagaaaaagcugaggacaaaauaacuuucauucugaucaugguuccccaugggcugucgaaucaccucuggugcucuacugagucugaaucuccaaccucgagacucagguagcuucacuuuuaccagcuccccugacaauuccuuugcauugcuuuugaaauuuguugaaauuuuauggugacuuaaaaagcucauagagaauaauguauucauccaagcugcuuuggguuccaccuggaauugaggaaauuuuaccuuauguagauguuugaaauggggagaaaaccaaggaacaguuuccaaauaucugugguauauauuucagguuaaauguuuguuucuuugaccugugcuaacuuggcauuaaagagaagacacauaggaagguuguauauuuaaacuaugagaaaaauguuucaucuucaauaggagaaacaauccccuucacccaucuuucuucuuucuccuguagucaugagcuuuuaaccuaugccuaaaaauugagccagugcuacaaauauaaggauagaucuuguggauaaagaauuuuagacacagaaggaggaagaaaaauccaaaacaugccacauagaagacuccacuuucugaccccauaauucccugugcccagucacacauauuuugagcuuugccugcucaacaugucaggggcucagcccccuccccuagcuuucucugccaucugaauaaagguuauauggauucuagucuaauuuuucuaaucacacagacugaccccaaaguaguaucauauuuacuuaaauuaugugaguuagcgaauuaauaugacugacuuuuaaucaugccuauucaaauggguuuuuuucauacuuaaucuauuugauucaccaagcucccaaaaugcuacuaaucuuccuuuugcauuguugaggaacuugagcagagcucacuggguagcagcuagcucuucccuggguaucaccucaaaucuugacuucucucccucucucacccucuucucaucauguaacaggauugugggggaggagaagaggaaggcugcucuuuccagaauuuuccauacugcuuuuuaugcucuuguuguuaucacuuauuacuauuaucauuacuuuaauccaggugauggaauggcacguguaguguuagcaacuugaaaaaaauagauaauaagcaaccaucaauaaaaauagucuuauagaaaggcauuuugcauaauaacugauuugcauuggacccuacauuuaggguuguuauugucucaaugacaaaagguuuacuuagugacugucucgcuagaauuacaacauucugggauuuuggcucggaugcaaaagacaugugagaaacgagguugccuagccaaaauuauguagugaaaucaauguaacaaauauuuacugagcuucuaccaugagaaagacacuuaugauugguacugugguggaugcagagaugagcaggcgugcuauggcugauguccagauagaauuucccaucuaaugugaucuugaccauaccacacaaagugugguaaauaccacaaaacaugcauacaugguuauaggagccaucaguuaacaucgcuaccuuaguacgagugcauuauucugauauuuguuacuauuugguuuugaaggaaucucacaucacauacauuuaaaaaucuuuugguauuaguaugcaaaacauucaacauuaauuuuuaacaacaagaucacuuagauacaacuuuagaauggaaauauuauugcuccuuaaauaucuuaagcuucuaaugguguuuuuauuuguucaucauaugucaggaauaaaauaagacauuuuaauuauuaauggaucaucuuuagauucuuacguaguuauauauuuaaucuucucagacacgaagcuuaaauacucauuaagagcuuacuaaauacgugccuucaagauuuuguugcacuaauaaaaugcuuucuuucauugugaaaauaauauauguguauuuaacaucacuuaauauaccaguauauuuuuaauaauaccaagaaagacuucagagggcuguaaaaaacuccugaaaugcuaagaaauaucaugcauguuuuguaaauguucacauauuaguacucucuuuaucauacccaagugauguguuaaauagaaaaaaacuuaagaucauucgaauguauagacuuacaaugauuuuauauuuaauauuuauauaagaaaaaggaaagaauguaugcugaugauuccuauuuuaccaaacaccaugauuuccauugaaaaauacuuuuucuguacaacagugacuaaaugugaagaaaauaaacaugaauaauuugugcacuugcauuuguauaauuuuauaucugaucucaucauuauagacauuuuguucaaaauaauaaagucuguuguauccagcaaagaaaaaaggaaaaaaacaaaagaucuguacuuacaacaaauuaacaaauuaauaagaaugcaaauaauucaucagauuuaaauugaguuuuuaggauguguuuauaaacuuuuuuuaaauuguuguuuuucuuugaagauugaaaguauuugcaggaauacucgauaccauuuuagguaaaauauuaacacaagaaagcaaaugacccuuagguuauuaauauugauuuuaucucuaagacaagaagauaaaaggaauuuugaggaaauaucccugauuagguaaauaaaaauuucuccuuuuugguuagaaaaaucucaaacaaaauuauaucagaaguggaaaauuauccagugaaauuagauugugaaagcagucaaucuaaguuaaaacugcauggaaaauuuuuuuuuaaauucuuuaaaauuucuauggguuuaaaauccaaaggcagauuccuaacuggauucagugaaccccuccacuuucaccuuuccaaauuuuauuuguuucauuugcaugcucagccuuaugaaaagucgugauaagaaauuggagaugaccuuauuauaauaaggaaguuaugaugucaaagcaagcauauuuugguccacaaaaguucauuugcuuaaugaaaucacagaagcuucuuuuuaucauuacaucaaauuguuuucccaggcuugcguaauggaaugugaagguaaacugccuucucugaaaauuugggaaaccugcaaggagcuccugcagcuguccaaaccagagcuuccucaagauggcaccagcacccucagagaaaauagcaaaccggaagaaagccauuugcuagccaaaagguaugggggcuucaugaaaagguauggaggcuucaugaagaaaauggaugagcuuuaucccauggagccagaagaagaggccaauggaagugagauccucgccaagcgguaugggggcuucaugaagaaggaugcagaggaggacgacucgcuggccaauuccucagaccugcuaaaagagcuucuggaaacaggggacaaccgagagcguagccaccaccaggauggcagugauaaugaggaagaagugagcaagagauaugggggcuucaugagaggcuuaaagagaagcccccaacuggaagaugaagccaaagagcugcagaagcgauaugggggcuucaugagaagaguaggucgcccagagugguggauggacuaccagaaacgguauggagguuuccugaagcgcuuugccgaggcucugcccuccgacgaagaaggcgaaaguuacuccaaagaaguuccugaaauggaaaaaagauacggaggauuuaugagauuuuaauaucuuuucccacuaguggccccaggccccagcaagccucccuccauccuccagugggaaacuguugaugguguuuuauugucauguguugcuugccuuguauaguugacuucauugucuggauaacuauacaaccugaaaacugucauuucagguucugugcucuuuuuggagucuuuaagcucaguauuagucuauugcagcuaucucguuuucaugcuaaaauaguuuuuguuaucuugucucuuauuuuugacaaacaucaauaaaugcuuacuuguauauagagauaauaaaccuauuaccccaagugcauaauauccuuguaag

SEQ ID NO: 13887 - RNA, 218859 nt, Homo sapiens
ccucucggcuuccacguuugccacguuccaaaggaccgagacaaacuggaaagccgaaagaggcucgcgcucacaggcagcugcguagcgcccgaacagcccuaagugagcaggggcggggagcgcggcaggguaccgccgccucguaagggcccuugcgauugggucccaggcgccgucacucagccuuccgggggcggggcgaggccgggaaggggcguggccgucgggcggcgagccgcgcgcucucgccccgggagggagucacagguucguacacgcgaggccgggcgcgcgcagccggcaggcgggugaagucuucccaggugcugcaggcggugcugaggcacagggucugcugcaggagcagcggcccgaacccgcuccagcggcccgccgccgccagcgguucccgcgucgcguguguacccccgcgcacugaaggagguccgccagcccucaccagcccccgcggaccgugcaauggcccagcguaagaaugccaagagcagcggcaacagcagcagcagcggcuccggcagcgguagcacgagugcgggcagcagcagccccggggcccggagaggucagaggcccugcggggcggggaucuggggccucgccucgggguagggagccggcuggcgcggcggacgcugcgggugcaucuccccaggucccaccgcgcgccgccuccaucccccgcgacgcuccuccuuuaggcgcgcggggcggaggccgcauucggcgggccuggcgggcgggcgaggggccaggcggaccgggguccgagcccucgggaugcuagucucggggagccccuucccagcgguuccuucaccugcagggcgcagccgagacagagguugcugaacgacuguuucuuggcuuuccguggaauugaacaugggaguaagagaacaauuuaucguuugccuugcguguuuuggggaguugaaaaugagccaaagucagggaaagugaguuccugccuaaccagcagcguuucagagcaacucaaaggaggugaaaaugggggcgccggggggcagggggagggaagaaguugggagugauuugaaugcucucagaaauuauuuuaaauauuuuugcuuguauguagcuuucuuaauaugcguugcaguugccuuuaaaauagaaugucaugaaauacugaacgagcgucuguauuuuuaccacuuuuacuuaaaauaaaaaucgauuggauauucaccuuucuccucguccgugugcauauccagcagagagaacagauuuuuaaaucuguuucgucucauauuucagugauucuugguuucuuuuauacuuccuuugacucauauuugggauauugaaacugcaauacacauguguauggaaugugagcuguaaacuucacuugaagugauuuagacucuuuguuuucugagaucuucagaucaugcauucauaauauaccaagaaaaugaaucagcuauagucaaagaaguauuuucuuuauagcacuugucacuaucugaacuugucuuauuacuuucauguguguugucuuuggcucauucucucuguauccccagcuccuagaauguuccuuucccauaauaggugcucaauaaauauuugaguagugaaugaaugaauggauuuaaauggggaaaguagugcauuaaauccauugcacaaauuuacauucuaaggacuaauauuuguauucuaaaaguaaagauguagacacaguuugaaguucaaugcaagcauauuaauucaccuuugacauaagugaaaguuuguguuccuuuuucacuuguucuuaaaugucacuuacuuaaaccugcagagggauagauuaauugccucagccgacugaggcuacucuuuuuuaacaucccuaaaugagaauggguucuucucauugugccucuaagggcacuaagcagagaaagcugaugaacaacuuuaauguuaguuguuuucaaaagguuucuguagcuauuugccagagaagcaugucuucguuccauuucauuuuuguguuuaugaggagagggcugauugcaucugagggaagucacuuuauauggccucuuauuggugagaacuaauacugggaaaugugucucacguuucuagaccuaccccauaacuauuugaagcauuuuaacaggcaagagauagguuuagaaaaugcaguaacuuaaauuaacuucuccugacuuucauagucaggcauuuuagaacaaacucugcccauauuugaggaucuacagccuuuuaagcauuuuacacguugauucucuaauagucaugaaacagacauaguauguaaaagaauauguaaaagggaggaaugcccgugauacgaaaacaaaaguugauauuggaacccugcaugugacguaaugaguauucuuuauccgcauauccgcaaccuuuucuuuuuuuucuccaguagauacugaguucuuacugugugccagauagaaggcacuggguauggaaaccauuuccuuccaucacccuaaacaguuaaaguacagugucguguauaguaggcuguacucgaaagauaaagccggcuuuucuuuuaaugcuguuuaccuggucauuaaaguacggacguugugcgaaccauuuccuucuacugggaaaaucaaagacuuuuuagcagugucauacugugagacccauuuaguuuccugcucaaaucauacagaugaggaaauuaaugcccagagaaguugccgaguucauugaagguuguuuaguucauggaaacucaacuaauuacuggaagaaccgagacuaagaacccagguuuuguuauucauuuugccaugcuugaauuuuagguucucuaguauguaauuggaguugaacuagauuaucaaguuuucuucuggcugucuccaugaguacuacauuuaauuauuggagaaaacuaugcuuuuguccuaucaccaauuacauuucccuugacaaaaauucuauuugaaacacuauuugaaauuuuaguuugagaagaaguauauguguucaaauaguacguuuuuugauaugucuuacauugagagucagaaaaugacggcauuggucacauuaaacauuauuauuucuuaaguuguuguguaaacguauggggaaaaaagaacccagucauuugaaacaugcauuuuagggaaaaggugauuucuuuuuuuuuuccuggccaaacuuuaucuuggugguuuuuuugcugaaaagugauguuuggaagcuggaauuuggggaauuuauaucacagauuuuuaaagcaagugucugcuuuuuauuuucuucagcuuaagcugaaaaaugauaaaaugguuuucuacagaguucaauuuuacuuuuuuuucaguuuuacucuuuauaauauaaaagaaacaugaauaaauuagacuuccuaccuuuauuuugcauauagaacuggacuugcauggccaguugggcccaggggaagccuuuuucaaauuuauugauuugaaaauaguuugacaaagaaggaucaugauguccuuuugggcuuauuuuguagacacucguauguguaauguuuucuguuuguuuguuuaguuuuucccuuuugaguaucaccccuuaacucccuguaucuccuagcagcuuuccaucucccuguuuauuuugucuggguguccugcuacuacauuaacuuuugccacuaggugucacuguagaauauaucccccuuuuaguuugaagcuugggguuauguaacagcagguuuuaauuauuauuuaauccgucuguauauacucaaaacuauugauagauaagcacuuaaaaacucuuagcuacuuuuuaacucucucaaggugucucaguagauugagcagccuuuuuguuuaggcuuaauuagaaugaaauauauuccuguacugccuguaaaacauuaacagcuucauuugaugaguauuugucauuuagaaacacacuucugaguuuaguuuagcuuccuuuuucuuucuacuuugagugucucuuagauuacuaaguaacugagggauucaauacacugcugauugcauuguggagcccuugaaugaagaggcccuagcaaaauuuucuuucuuuagccaaagaccaucagagccaauugcuuaauccuccauuacucauucuaagaugaaaacauaggaggaccauaauucuuccacugcaagaaccgucagcuauuuuguguucaguucaacagcauuuuguccauccugaccaaaucauaugaaaccaagcacuaaauaauguucugagggaguuuaugaacacauuuuccagagaccaguuaaccucugguggucuguggaagugaaaguucuauauuuuggacuauauuuuagucuugcuuuaaaauaaucugucucauagagauuauuagaaaaugaauguaugacauuuucauuuucagccaguuaucaacagaggaacuuggauaaaggcucauagggucuauccaucuuguuguuaguuaauaucagauacuuagccccugagcucucugguuccaauagaaaaacccuuuucuccagaaagcuagugcaguuugggagaaggaauaugaugaccuggaucauaucuguguaagaaucagaaccaagaaucgcuaaaaaucucuguucccagccuccuuaaauguaaagaauuauuaucuacuuucuuuucagaguuuugauaucacuaaugcugauuucauauggcuuuguguuucucaguuguuuccguuaaaguacgucuaauaguaggggugagugcaaaacuuuggagacuauaaaaguguagaugucaucaggccauugcaugcuuugacuuuuuugaugauuuauucuuauuuauuuauuuauuuucauguuccauagcaucuuuguguuaaguaaaauguauauucuugagauagaguuuauacuaugcuuugaggacugcucgauacauuucucucagcuucuggagguguaaguauccauuugcacaucaacuuucaaguuggugauuugcccuuaauggcucagaaaucuguaacauuauuuuaucuuacccaggcucagauauauuuagucuuuugagguaacuccagccacuguuuuaauaucaugaaaauaugcagcuuaguuuguggcuuggauacuuccauaucaccucuaaauggcuugacuucauucuguaccaagguacaaaaauguuuuucaaaugaacuucucuuuaauaaacccuguauguacauauaaccuauguacaccccaccuaaaccuccggggaaaagccucagccaucuaucgggaaauguggaggugcaagggcugcuugcuucauuaucugcugccagugucugcucugcacugcacaugugggugugaugaguuucucugguucgguccugcagcucuggccauuuuuauuagaggacuaaggauucaggauguucuuuucuucccuguguaccacugugggaguauagucuggaggccagugcuuuaacuuuuuuuuaauuauacuuucuucugguacugcugggagccaagaugguauuuucuuguuagucauuauuuuuaaaauuuuaguauuuuauuccccugaugugagggaugcuucaggcuuuuguccugcauuugaucuuuguuuuucagggaugugucuugguuaccuuuggcugaugugguuaucuuuuaacggcaaaucacugaauguaauucaguuccuaucaaauuggccacagcugaggacaaauuugguuuagauaaccuauuagacucaaaggaaauguugagcucccuuggugaauaacucuuuuuaaaaagaaaaucaucuuuugaaggaucugggcuauucggcccccugugagauucaggucacuugccuagucaugugacugucaucaucugccguagauacuaugugugcuccagagcggagagcauuggugaauugacuugguugagggguggggggcuggggggugggagugguugcuguccaguuauagucagguuuccaagggcagccacuaucucuguacuuggagaaaugccagcacuucucuccuacaugugugcccacacguugaacccagugacucauccuguacuuaagaccccaaggaucagucuuaaauuuaaaguaggagaauauccuuugauaauuuuauuucacaaccagcauuguuguaacugccuuuucucauauuuuacauagguuugacagccauuucuaccauuccauagugcagagucacuauuauuuuguuguucuauccugucuguaacuucuuuuucuuauuuauuauucuucuaauauacaguuuuugucccuaucuuucacaggcugcuuucaauuucaauuuucuugguauacuggaaagacucuuuuggucuuaguuucacuuguaaauuuuauuuaggacacuuaauuuuuugacuuacauaaaccucaaaaucuguguuguaaauauuuguugaaagaauaucuagcauuuaacuacuuuuccauucuuugaaucaagucaauuuguauaagaugcuugucacugaguuuuuguaaguuguuucauggauuugcuuuuuggcagagagcuaguucucuaaccuuuauaauaaaaauauuucuguguauugcucuuuaaaauuguauguauuugaaauaguacauauuuaagccuauaaauaauuguagagaguaaugcaguggaugcccauguacugaccauauaggcgaagaaaugaaacauuaucagauuccuagauuuuccucuccugugguauuccuuccuaaccauuguuaaacauuuuaugguagucauuaucauaaauacagguauauaugcacaaaauaauauauaacauguagcacauacacauuauguauccacacauguaaacuguaucuauuauuaaaucaauguauuugaaaacugcccaggaaguauaucuauaucccuauguguagaaauauaccuauacacacacacacauauauguauauauacuguauagcacguauuaaaaguuuugugaacaggcuucuacuuggcauacuauuuugacagcauuuguuugaaauuccuccaaacuccaguucuuuauuuucacauauguaguucuacaccauaugaauaugccuugcuuuucauuuagccauccuaucgcaggccacuuuuuuucuuucaaauaaugcugcccuguacauguaugugccuaucucuccccaugcauacaugucugaguguuuuucuagggcauaaucuggaauuggaauugugggucauagaaaguacacacauuagacuuuacuggauauugccauuuuuuaacccccaagugguuguaucaacuuacaguucugccccuaaugaauaagagcuuguucugugccaucaucacauugucaacauuuggugaaguuuaauauuugccaguugaguggcugugaaguaguacuugaggguuuaaacuugcauuuuucuaauuacuagugaaguuacugguaagaguagccuuguguuuccuccuuugaauugccuguucguauaucuugccuauucuucuguuuuuguuuuguauuuguaguauugauagguagauuuuuuuuuuuuaauauccugaaccuuuugauuauuuuugauaaaggacuucuccuagucuguguuuacucacauuuucauuuuuuaugguauacguuguugaacagaauuuuaagauuuuaauauauuaauagaauuuuuccauuuuguacuuugugguucacaccuuuauacuuuuuguaagacacauaacacagauguuaugaauuauucuuguauuuuccucuaaaagaucugaaacguugcuuuuuuacauuuagaucucugaaccaccugguguagcauuuuauuguauauuuuguuauuagggaucuaauucaguauuguuuuuuaaaaagggccaaugagaauguccuguacuguuaguugauuugucaucuuuuuaccguagucugcagcaucaccucuuguguaugaauacgucgggcucuauuuuguuccaggcauguagaagcaacaccaaacugaauugcucacuauagcuuuguaaugaguccacauaucugauagggcauguccuucuacccugccuuuuucacuauuguguuugcugcuuugggaccuuuccucauccauuucucuagauuuuagaaucugcuuaucaaauauguucaugaaaaauauuugagaauuuuuacuggcauuguauugaaucuauagaacaauuugggacaaauacagauguuuauaauacugaaucuucuuauacaugcaccuggccggcuggccugcuuucucuucuuucuucuuucuuuuuucuucuuucuucuuucuucuucuucuuccucuuccuccuucuucuucuucuucuucuucuucuucuuuuuuuuuuuuuuuuuuuuuuuuugagucaugaccucgcucuuucacccaggcugcagugcuguggcagccuugacuucccaggcuccggugauccuccgaccucagccucccugguagcugggacuacaggcaugcaccaccaugccuggcuaauuuucuuauuucuuguacagaugggguuuugccguguuggccugucugcucucaaacuccugggcucaaguggucugcucaucucgacuucccaaagugcugggauuacaggugugagcccugcaccuggccuauaauuucuuauguauuuaagucugacaauuuuuauaaucuuauuugaaagucauauacaucuuuuauuagauuaagucuggguacuuuguauuuuaaaaaacauuuucaauaguauuuuuaaauuaacauuuuuuaaugaaacuuaaaaaauauguauccaaauugaaagaguucuguaaugacuccaccauguagaugcuacagcgguuaacauuuugauagauuugcuuugucaugucuauuagucaaucuuauucuuucaugccuuucgaaguaaguugcagguauuaguauauuucacuuucauaaacauuuacaugugccuguagcuaacuagagcuuagcauuuguuuuuuuuucccucugagguaaaauuuucacguagugaauugcacaaauuuuagugucugaucugaggaguuuuuauauccauuucuaccuuuguaaaacaauaaccuauuaggauagagaauauuuucaucacccuguaaaguucucucaagccccuuucuugcguccaccucugccaccagaggcagccauuguacuacauuuuuugaucauagauuaguguuuucuauucuagaacuucuuuugcaaguacuuuuuuuuguaaagucuccuuucacucagcauaauauuuuuuaguucguuuauguuguguacacggucacuuguuccuuuuuauugucaaauaguauuccagugucugacuauagcacaauuuuuuuuaagcuuuuauuuuagguucagggguacauauacagguuuguuauauggguaaauugcaugucacagggguuugguguacagauaauuuugucacacagguaauaagcuuaauaccugcugaguagcuuuuuugaucugcaccuuccucccacccuccacccucaaguaggccccagugucuguuguucccuucuuuguguccguagguagucaauguuuugcucccacuuauaaauauuaauaagaacaugguucucuguuccugugucaguuugcuuaggauaguggccuccagcuccauucguguuguauagcacaguuuuuuaaccccaucuuuuauugguggacacuugggcuaguuuuggguuauuaugaauaaaauucuaugaauauuauagaagccuuuuuugacauauguuuuuauuucucuugagcaagagagggauuacugggcuauaggguagguguauguuuaguuuuauuaagaaacuguucaacucuuuugcagaguaguuguacaauauauuuuauacucccacuaaccauguguggaauugguuguucuacauauguaccaacauuugguggugucagucuuuuuaauuuuagccauucugguggguaugccguggcuucuuacuguaguuuacauuugcaauucccugaugaauaaugaugucaagcacuuuuucuugugcuuauuggcuacacccauuaucuuuagugaaguuucuuuuuugcccauuucuaauuuuauuguuuuuuguugcugagcgguaauucuuuauguauucuggauagaaguucuuuucagauauauauagcacauauuucucccagucuauaacuuaccuuuuuauuuuuuuauuuuuaaugcugauauuuauuuuuucuuuucuguuuuugcuuucuguguucuaagaaacugcacauucucacgucucaaagcuauccucuuuuauuuucuucuagaaguuuuauaguuucaguuuuuauguuugucuaugagcauuuucacauuaauuuugaauuagauuuauauuuuucuauauggaauuucaguucuagcaccauguguugaaaagacuuugcuuucauuauuggauugcuuuuggugccuuugucaaaaagcaaaugacaguguaaguauaaaucuguuucugagccccucuguuuuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagucccucuguuuuuuuguuaucuguuuguccuuaugccuuuacuuuaucacagaaucuugauuacucuagcuauacaguaaguguuaaaacuagguaguguaaauccuccuacuuuguuguuccuuuuaaaauagcucuaaauaguguagauacuuuguguauccauauacauuuuagaaucaccuugucaacuuccacagaauaaagcaugcuaggguuuaugauuaggauugcauugacuccguagaccaacuuugggagcauuaaucacagugauauugcacauucuaauuuaugauagugguauauuucuucauuuguuagguuuuuaguuucuuucugccuuuuuuuuuguagauuuugcuauggagcucuuuuuacgcauuuuucuguuaaacauuuuucuaaauauuuuguauuuuuugaugcuauuagaaaucguauuuuuaaaauuucauuuucccauuauuugcugcuaggauguagacauagaacuguuacaugcaccuuauaucauguagcuuugcuaaauucauuucuucuaguaguuuuuuuuaagaaaauagauucuuugggauuuucuauguaaauaucaugaagcccauuaauagaaacagucuuacuucuuuuccagucuuuucuugccuuacugcacuaauuaggauuuccaguaucauguugaauaccagugaugagaguagacauccuggcuuuguuucugauuuuaguggcaaaguauuuaguauuuuaccauuaaguaaguaaaauauuaacucaggguguuuuguagaugcuuuucauuggauuggggaaauuuguauuucuagguugagaauuuugucaaauacuuuuucucacucaaagucccacuugguugauuugaauuguccuuuuuauauauugcuuuauuugcuaauauuuugucagcaauuuugcgucuguguuuauguuagaugugggucuguaauuuccuuccuuuuuuccucuccuccucuccuauccucucccccugcuucuccuucuccucuuacuuccuuaagaauugugauuaguacggaauauuuucucugcaccuauugauauuauauauuugguuuuucuccuuccauacuuuagaugguaaaugauaacaauagaugcucuaauuuaaaaccauccuuacauuucugggaagaauccagcguggugguuuuauauauuuucaguauuauuggauuaguuaauagauccaugaguaaaacugacccgacauuuucuuuccugguuuuguuaucaaggucauauucuagcugcauaaaugaauuuaggaagauuucuucuuuuucuguucuuuggcauaguuuguauagaaguaguuauuggggggcugggcgcggugggucaugccuguaaucccagcacuuugggaggccaaggccgguggaucacaaggucaggagauccagaccauccuggcuaacacggugaaaccccgucucuacuaaaaauacaaaaaaaauuagccgggugugguggcgggcaccuguaguaccagcuacucaggagguugaggcaggagaauggcgugaacccgggaggcggagcuugcagugagccaagauugcaccacugcacuccaggcugggcgacagagcgagacucugucaaaaaaaaaaaaaaaaaaaaaaaagaaguagcuauuugguaaaacucauuggaaccuuuuugucauuuuaccccaacacugggugagguguggguagacaugaggggaaacugccuuugcuuuuuaaauguuuacaggacuacuuaaaauuucugugucuucuugaguuagguuugcuauguuauauuuucucuugguagguacauuugaguaaguuauauuuucuaaaacguuuucugucuuugaaguuucaaacuuacuggcaaaaaguuguguaugguuuuagugcuucuuguaaacagaauauagcuauuguaugucuaguauuaccuuguaauaaaauuccauuuaaaaugacuaaauacuaaguuucuuuaaauuguaacuauuucagcuacuaagaauguuuugcuaaguuuauuaaaguaaaaauucuuuauaaaauacaugggauauucuaacaucugugagaagguaagccauuuaauacugguaauuugguuuaauugacuugauaugcugcucauuuuccuccuuaaaugguaauaacuagcaauagguacauugguuuguuaaaaauugaacuuucuucaugacuaaaauauaaugcuuauuuucuugaaucuuaagauuuauuugauuauuuggugguuucuagcugguccaucuguuuaguuguaaccaguaaauauaccuggagaccuagggagccuggcauggauccaaacauagcccaauguuucaaucacauauuugcuuuguaacauuauuaaaaugaaauuaacuuauaugaagguggaaaacucuuaagccccuuguauuuauuuuauaguuuuuuucuagaaguaguacacuauuuguguuaauaaguacccaagcuaauuuuuagaauuaccuuguuaucagugagacauuuaagaugacuggguaggauagaguaacauugaguaagagcacaguucacuagcuuaaguacuuuuacugauuuggaguaaacuugaaauaaacuauguauguucaacaccuuccugcucagcugguccuucaccagugccuuguggucuuagugugcuuuuagcuuaugcuuauucguauuuucaaugccagcuauuucacaucuucaccaacuucagccaauaucuuacuauuuaucuuucaguuguggcagacggcaaacuacagugagaaaaaaagcagaacaguggggccaccucugaggcuggggauggggugcaauggaaauggccaugagggaauuuaagcagaaauauugauguucuagaucuugauagggaucuggguuacauguuguauacacuuguuaaaucucagggaauguauacuuaaaauuuaugcauuucauuuuguguaaauuucacuuuaaauaacuauaaagaaauguguaacuauaguuuaugauacucaugccgaauuauuuaggagaugugugcugaugucuacaguuuacuuugcaaugcauuauacaaacaaggugaugauguaaagggaugaauagguaugcuacaaacaauauaauaccauguuaauauuguagcggaaucuaaguguuaugaauccuuucagcuuuguuguguuuugcaaauuuucauaguaaaacauuggggaaauucuuacguuguuuguuuccugugaaauagccauuuuugugggucagaaacugacaauuuccugugguugagcccgacauauggaagcacauuuuguagccauuuuauugaggcaucuuuaucugccuggaugcuaacaggaaauagcuucauuuuucuccauucguugugcacaguugggauagauuaaucuguuugcucuugguagcagaggaucuugaccaucuuugggacagaacuuaacaucucagucacucuuuuuaaaagucugucuggauuagagcugaucucauuuucggugcuuauguuccugucuccccuuugcagcagggcaggaggggaaggagugagugugcuuuccugugguuugccuuuggggcugugcuggggaggaaaagggggugaggccccucucagucuccucucuaaguugauaagauugacuggcaugguuauucacaagugacaggugcucaaacacugcccaugugaguucuuugaaaggccugguauggacccucccugugacacaugacuugguccacccucaauccccugggccuccacuccuggcagaauacuucauccccccuugcucuugggagcccauugugugucagucagcccuuuugagugaggugcuggcaaaaugguacaaacgcugguacuucccugcugcccucuuggauuugugggaagcugacauuuugccuggagcuugagcucccuuguagccgucaccuuucucuguagccgucauuccccaguucccucugcuguucaacuaggcauagggugggccauggaguccguugcuugaguggacauccacuggggaaugagaagucaaucucccugcaggcacccuuggucucugacaggcauucuccugcagagaacucuugauaucucucuuagaaauuuuuuaaguuuuuauuauaaaauggaauuuuuuuucacagucuugcaaguaaacuaugugccuuccucuauaauacugcuuuuuaaaaauuuuucuuaggauuuucuaggguugauagagugaaacucacaguuaagagaaacuuuuugauuuuuuuuuucucauugcaacugucuggugauuuaauuuaaagagucgagauuuugugaauuagaauaaugaauuuuuagaauuagaagagacaugagauaauauacuucauuuauucauuauuuuucauuuuacugaggcccaugaaacaagaaacuuaccuugcaguaccugcaguaccccucucucauuugucuuauggcgagggauuuuuggaauuuauaaacaaauauuuguaccuuaccaaguagauugaaauaugagauucacuauucuacagaagugugguuauuuagcuuuuggcaaaguugugaaauuuuuacugaucuguauguaggaaaagucagacuucaugcuguuagggugaaggccgcuguuagggcaucaccuguuuauucaguugaucauguuuucugcaagaaguuaggcaaaccauacagucugaaggaauaguucucacaagacugcccucacuucaggcaccagcuauaauuuugggguccccaggguccucuggagaucacaacugauauggcaugucccagcgcccacuugguuaggcuguccaguggccaaagcccccaggcaaagacacuguuaucaggcagaacauuccugggaucuggagaccccacugaaguaaccaagggcaaagaccagacuucucuuuggguaaaguuaauuguuuaugcaauuuuuaguugcagccauuguugguguuuauuacuguuacucacuuuuauuauuaauuuauuuaguaagagcuuguuggccaucugugauauugugaaauauauauuuggucuucuucuuguuuccugacauacaucuccuaaaacccuuguggucucccagagucuuaagagugucuuucgcuaauaauugacuggcggcuaacagccccuagauagcuucaggaugggugccggucacaggaaagacaaaggcaucguuagaagauuggaacuuucagccccacccccaaccucugggaggagagaggggcuaaaaguuaacuugaucacuagugaccauugauguaaucagucauuccuaaguaaugaaguguccauaaaaaacuaaaaagaugguuccuggagcuuccagauagcugacaaagauuaauagaggagacagugugcccaaagagggcaugacauguguuuaaguuuagccuaaagcugccuccuugccuauuucaaguucagccuaaaggcuuuuccauauguaguaaaucguaacguaacuaaaugaauaaacagacuguaaccuacccuuguaucagucacagaauuuuagucagucacagggguacaacuguucaaacuauauucaaauauggcaaacacuaagcuguagccaauccagcuguuucugugccuuuuucuguccauaaguauuaccugaccuuguggcagcccuggagucucugaacugcuucuggguccugcccaauucaacaauuguucuuugcuaaauuaaacucuguaaauuuaauuugucagccaggugugguggcucacaccuguaauccuagcacuuugggaaguggaggugggaggacugcuugaagccaggaggaguucaagaccagcgugggcaacaaagcaagacucugucuuuacaagacauuuuuuuuuuuucuaauuagcugcauauggcggugcaugccuguggucccagcuacucaggaggcugaggugggaggauugcauucaaggcuaggaguucaaggcuacagugaacucugauugcacuacugcacuccagcccgggaaacacagugagacucugucuaaauuaaaaucaaauaaaauaauuuuaauuuggccaaaguuuuucuuuaaacacauggaaacuuggcacuucuucccacauaccuugcccuaugcaucucuuccaucuggcuguucaucugcauccuguguaauauccuuuauaaucaacuaguaaauguguuucucugaguucugugaaccccuuuagcgcauuaaucaaacuggaggaggggguguugggaacuccgauuuauagccaguuggucugaaguauaggugacaaccuacuacuugugacuggccucagaaguagagacagucuugugagacugagcccucaaccugugggaucugacacuaucugcaaguagauagugucagaacugaauugaauuagaggacagccagcuggugucuacugcagaauugauuggcugcagaauugauugcuuacuugcuggugaggagaaauccccacauguuuuagugaccaggggcugcaggaauauucuguguugacuguggggugagaguacagaaggagaaaauauagaguuuucccaauauccuuauaauauccccaagauguauuauaauucauaauuguaucaacuguuuuuugaccuaugguuuucuacuaacucaacuguaagacguguguuuuauaauuuacaggauucuucuguguaugcugugcuaaugaauuuuuguaaucccucacuuuccuccccauuugcaucuguagggcacuuuauuuuaaaugcuggauucuuuugcuccagaaagugggaacugguggggaggagggccauggaucuuuugcugucaaaauagguuaaagucaaagagucuucauggacacagcuguaaaccaguguuaguuguccauauuggcaguguguccuugucucauugccuugaaauuuagaguuaaagcaggauuaagcuuuuuuguuucuuaguuuugaaaaaauaaccuuuuuuauucauuguaauaacuuuucuuucaccaccucagaguuucucaguggacauagcucaucuuccuuuacaccuuuugcuucucucaggccagugagagacugucuuauuuugaacaccaugcuaauaauuaucacccacccauguggacaauugaauagcucagaggaaugcuuuuuuuuuucuaugagaccgucuucucuauugagugcucuguagggagaaauaauuacguuugcagagccgacucauuaggccuggcuugaggaacuagccugugagguuaacuacuauuuauauuguguuuuuaucuucuuaucagugguguuuggguccaucacaaauucguaugacaggcauggguggacccauauuuugauucacauucucugcugcaguaaaucgguauuagcacagaggugugggcuagggcaguagcuccuuagcuggguauucuaaaggauaguaaagguuccaaaaauaccuggaggcugauauaaauggguauugcugauauuucacuuucguuuacuaauacugaugaaaaugcaagcagcuuucucaauuuuguuuuccuaaguucuaaaacucauggcgccccuugucauucuuccagccauggugccuuucuacacagggacagucaagagagcagcaucugguguuugccaggacagguggaggaggcuacagagccuguccuaccuggccccacucauguacagcccaugugacagucauccaagaucaaucagggaggaauucaccugagauagaacugugaaaacuuggugaagggacgaaucugagucugaaaucagagucuagaaaccacugggcugcuuucugaauuucucucucuuagcuauuuguaggucuuuuccucuagugaauuaauuuuaggaucauuaaauucauggagauggggaaaccugaagugacuugacagcccaaacaacuaagcaauaaguugcucccuuauuucuaaaguguuagcagaagaaguuugauuacucauaccauaucaaggauuugggaaggaauguauccacuuauuucacaagugauuauuuuauugaguuccuaguagauagauccaagggaaguguacaguaaugaacguggcagauucaguuccuuguugcaugaaacuuacauucuggagguggaaagagauuaagaaaucaguuguuguauaguugucuaaguagcaguguaauaacgugguaaagaggugcacacugcugugagaguaagggaagugaggaaggcuuccuugaggaggugguuuguaagcagagugagcuggcaauagcugggguguggggguuguaugugauggugcagcuuugacaugggaaaagggaaaagucugggcugagagcccgagacaggaaagaccauggucagguauuuugggcaggugucuaggcagcuaggggggugacacaacacuaagacuggagccacgggcuggggccccaucacauggagccuuccuuguaggccacauggaagauguuguauuuuaucucgaaagcaguauuaagacauuaaaggauuuuuaacaggucagugcuauaaucagauuuaaaaaauauuuugucugcuguauggaguagaaaaguguaugcuaaguuauugaaaucaccuaggagaugaugauaacuuggauuuugaugaucacaguugaaagaacguuggaacuugagacagaguuucucacuuuuuaaugucauggcacacgcaaaugcuuuuaaaaacuaugcugugguaaauggacaagggugacccaggugcugaggagaauccauaucuuggccucguuguaaucacccguuugcaacagccagaugauaaacucaauuuugagaggugaguuuuugggacaaaagucaaggaugaauccugguguuuuugucuaagcaacuggcuucacagaagugcuucugagauuuaggacacugaacaggaaaggggaaagaccaugguuuauuguguauaugcggaauuugagguuuuuguaagucauucaaaugggauauugaguagacacaugguuguggagcucaaaggagagaaaaagguaagucauguagaugauagcugaagugaacuagagagguggcauaggaacaaguauuacagaauuuucacacuuaaaaaucaacuagaugagagugagcuagcaaaggagacugaaaacuacgaaguuuaaagagguguuaggagugccacaagauucugaagucaugagagucgagggaagagaguguggaagaaggagggagaguucugcugagagggucaagucagaugaggacugaaaguuuugcguuggguuuaaugacauggaaaucauugaugugacauuagagccacuaugcuggagccgugugcagaaaccagauggaagccuacagguuguaaggagugagugggagguuagaaaaugaaaacagagaaacagcggcucuguggagaauuucaucugugaugggaagagcaagaugacaugggggcuagcagcgggauggagggaaaccuggcaaaggcagugaggcugggggagaaggggcgagaagagacagugcagagugcgagguagcugaggagaaacucggaauggaugcaggcuagggcagguuugugugcugggcauugggcacucaggauagcuuccugcugaggguucuguuuucucugugaaguaugaggcuauggcaguuugaguaugaggagguaggauacauugggggcagagaaguuugacauagucaucauaaagaauggcaaggugaguuuguagagaauaugggaggguggcaggcagcaccgaggcccagcugaggcuggcucugcuguguucaguuccugaucuugauuccgugagcccagcugcccuugccucuguggcgggggauacuuguguucacccagggaggcagucacggcaguccacgcagugaacugauagaggagcaacaaaggcucaugagucgcuggagugauguaaauggucaacuguggagucuaagauggccacugauggauaugaaggcaggaggugaagaggggauaugcaggaagcagaaauaagagaacuacaggauccaagaagaaaauguugaggaaacaaaguggagauguaggaaguugugaucaaagagugaauguucccauucugugcgucguguggugagagaaccuaaacccuugcauguggagguggccuuccccaguggugguggccgugggagucugucuaagcagguuugacuugugucugcagaguugcauuuuguuauuugguaauacugguuguuuaguguuaguuugaaaauguuauaauucucuccuguuaacuuuggguacgauguguagaugaaaaaaaauuuguuuuuguuuuaaagaaucauauuuucacuaucuugugacacuuuacagucauuaugauggagccaaaaaagcagagccuucuuagcaggguuacggaaucuguuaggauggccgcuugugucauccaacaagaaacaaggugugaagaggaacaugaauuagguugcguuuaugaugagguccaugguaagaauguaagaaugaguguuggauauaaaauggaggcgaacaaggucucuggggaugaagaaaugaagcaaaaagcaccugucuagcuggccacagggauagacauugaaaucacaugguuacggcuggacuugggguguagaagacuucccugagcauggggugggagugggaaagucacuggaggugguggaugacagcaaugaggcacaguggaggguuggauaauuagaugucauagaccacagaggagcagggagcaggguuuuguuguugaugucaucguuuucuuuuuuucuuuuuuuuuuuuccuucugguggguaaggaaaugauggucuggaaauugguaaaagcaagaacuacuucccuuccuugagacccugagaauuagggaccgcugguauaguauucuuuguauguggucccuagaccagcaacaucagaucaucugggacuuagcaaugccaauuccagggucccacuccagaccuacaaaaucagaaacucugggguuaaggucggcaucaugucuuaacaagcccuguuugacucugacgugcucagaguuugagaaccauugcuguaaugauagcugauccggggugaggggaaggaaguauucagugcugacucaugagaaggcugauggauuuucaccuggaagguuuuuggagggagguagaacccucgacucagugggcauauguccuggcuccccugguugcgaguggcauuaggcugauacuaauggucucagaacacacguuggaaguuuggucuuugcuuagacuuggaguugcuauuaguaccaguagcuguuacaaggaauaguuaacuuagugucauuuuaguugcguuugcuaaaguuuuaaaaacaugauuuacuauaugcaaauuaaguuuauuuuuaaacuuuucauaaacauucuccaucauaaaaaugaauugucauuauaagaggcaguuguucagaauucagaauuuauuguucuuuaaaaaguguuaugauagauuaaaugauauuucagaggguuuucuccugaucuccauaucuaaaauaucagguaugucauugucauugugaacugaggaggaaagacauuuuuaucaaaauaacuauucaauuauugcaaaagacaaaagauuaacuagaggacuugugaaagugcuugauaaagauuugucaaggagaaauaauuggagcuguguugaagaagucuugggguaagguauaaucacauuuuaauagcugugauuccuacaguuugacguuuagcuguagacauucuguaauuuggaguggagcugaccuugcacaggccaguaaagagaggagaagaaacccuaccagcuccagcaguugcaggggcagaugggauuaugaaacgagcucuaaauuggggguaagguuauuuaugcacuagucacgauugaaucaauagaaguuuguuucacugaugacuccaacaaauauuugcaugccuaguuugugcggagacccauuuuauaagcaaggaaauucaggccuagaaguuugaugacuucccccaaaucaaauuuaauggagaagccgugaagcaaauccaggugucuaaguaugaaagcauaccaagcugccugcuggaucaguguagggguuugguuucuaguggucucacccauggggguaucguguugcugucauucucccuccaaaaacaacacaaugaaaggaagcuuccagaauauuugucuuaauaaauuuguauggugacgaaauggugggucaccuuaaccccugucaacaagugauucauuaucauuuaacaauuuagcaagcacuaaguuuagugggacagaucuuugaagaaaauaaugggggaaaggacgcuuggccagagggcaccugagaccauuuuguuuaguuggccaugaugucuaccuacuucacucuguccuaaaccuggaccaucaaauguugguaccauagguugcagacuaugguaccaaccucuuaaggcuuuaucuuaccaugcauucaauaguuucacuggacagaaacugaucuucccuuugagacuaggcacaccauauuuacaaagugacauaucaagaguauauuguuugcuuuugauaaaaacugccccuaaaacaggcaucugaggaaagaaucccuucuauaauuuaguguuuuguuccuuuuuggaacuaguaaauaucaauaguaguaagguuaauaauacuagaguaacaccucauuuauuugauauuauaaaaggauagauaaaauauugcuaauaauuuaauauuguaguuaacauuuagcuuugaauauauguguuucaguguacacacacacacacacucucagacggauuuaauuuuuauggcccuuuuugaaaaauugaucuagugguguauuuuuuaaaaaugugcauauccuuuuaacaagaauuucauuuuuucuuccagaagaaauauuggcaauauauucuugccguaagccacuggaaauuacuaguaguauucaaagcuuuuaaauuuuuaauuugcuugugaagcuuuaaauuugagugaaaaauuuagucuuauaaacaacuuagaaagguugcugccugcucuagauacuauuugugcuaaauuaauuuaguauacuaaucagaacucuaaugaauucugugaacugcuaauguuagaucagugaauaaauggcugauuuuauuucccagaagagaauguuuggagaugagguuggggagaaguugaaaaaaaaaaucagaaugugguuguguaaucuuuuccuaguucccuuucaagaugaucuuucccaggucauuauucuuacuccugaagauuuuucuuucccucuccucaccucccagccuuccuucuauuucuuuccuucccaccaguccucugucccuccuuuucuagugaaacauuuuauguuggugcuuuauuuuugcuguuggaggaauuauuccugggauggugucugugaguaagaauucuagagcauugauuaauuucuuacuauguaugguuuuguuucauucaagcaaucuaauggucuuuccuuguagccauuuuauuagauucugaagggccaaaucaaacuguuucugggcuuggggccauauuuuauagcaagacuuguuugaguuuucaaugaauuggugcuuaagcuaaagccguuaaagccugcuuccaagaaaacaaaacuggcagcacaguuuguuccauuucauuuuuuuucagcaugcuugauuuuuuagggguuggaguuagcuaggaccaacugggaaaagaaucccguaagugggagaaaggcugugguguuguuagggagugcacuucagccuaaguggugauuagcagcauuuagccucuaaaaauaacuggugagcagaguuuguagucagguccaauuucaguucuagaggcccuuacagugcagggauuggccagucucaagcucugguaggcaagugcaugcagugugccuaaaaccugccagcaguacuuuugaguuuuuuuuuuuguuuuguuuuacuuuagcauuuauuauucauggauugaagaaaucaaaauggcugaagauaaagguauauuuuuguuauuuaggcuaaaaguggcuuuagaucuagcugacagcuuuucacuuuauuuucaguggugcucuguuaaaauauuuuuggcuaagugcuuugacuguacugucuacauuuucuauuuugaacuccuggagauacugacuuuucauaguagcugaauauuucauugaauaaucugucuuuaauccgaauauguuuuagugucuuaauuuagaugaccuuuuaguauguuguacuacuggaggcugcauuuuacaaauuucaaaaaauguacaagcucucuucuuauucuuauaaguuaauuacaaugaauuuaaagaauuaucuauauuuagauuuuauauaaaauuauaggagauauaaauucagucucauauuaaugaacagacuuaccugguucaagcaaggacuuaccauuuauggaaagugaccuacuuuuaugugaagcagacaauaaaugcaaagaaaaaacacaaggguuuuauuuugauuuuaaauugacucuuuaacuuugaaguauucuuuaacuauguauugaauuuaauguuuuguauauauuugcuuuugcuuuacuuuguaaauuaagauagucuuuccauuaauugaaagacugcauucacucauuauguugaagauuuauaaaagaaaagaauagauguaugaaaacugcuucuaacucucagcugucuaaucagcaacugaaaggauucuuugauuaggauagagaauauaagcauguacuaugugaauauuauuugaauaauuggugagaaugggucacuugacucgucugauaaagugcuucauguagccaugaagaagaauaugagauauguaucugacuuuuaguucuuuuggaagacauuucucuccucuuguggauuagguaauccauguaguuaggaaaaaucagcuguugcaucugaugcacuuuuaacaguuuuugauucccaaagggugacauuuuauagcauggaaaaauaaucaguuugaugaguugcuugacaguuuuuguguuuuucaaaaaacuuuaaauguguagaguuuauguguaaauaugaaauucccaacauaaugcuaacuaaaacuuauaaaugaucuauaauucaguuaguaguaggccagugaaguagcuggugacuguucaagugcugggguucaucuucuugucucccuuuccucaaccaaauaaauaaaacuacacauugcccuucccccggcuuuuguuuuggagagucuucauuuuggacuguugcuugccauaguaauuucuguguuuggugguaugugggaacauuuucugauuuggaggucauguacuuuugauggaauaacaugggaaaaaaugaaucgcaucguucuugcaguauucuuaaaccccaguaaaaauccgcuuugacugaucccagaacuacagguugaacaugaagccagaaaaugaaaugaagacuuagauuuauucugaucuuagaaaauagggacaucuacuagauguucuucccaaauaccuuuggaacaagauacugguuucagauuugcuuagggaguuguaaacccucuuaaggguuugucuuaccaugcguucaucaguuucauuggacagaaacugaucugcccuuugggacuaggcacagcauauuuaccaaaugacauaucaagaguauauuguuugcugucgauaaaaacugccccuaaaaaaggugucuuaaaaaagaaucccuuccauaacuuaguauuuuguuccuuuguggaacuaguaaauaucaacaguaauaagguuaauaauacuagaguaacagcucauuuauuugauauuaaaaagggauauauaaaauauugcugauaauauauucuaguuaagaaacauuuagcuuuuaaagugauaaaucucuuuacuacaaacuacuuugaaugaaaaucuuccuaagauuuauuauacauuucuucuauguuuuaauggcagaaucaaugugaaaccaguuacugucuuguacugaagauuauuugaaggacugucagggauucugccugaaaguuucaucauaaaugacuucccaccacucagcuuuucugacuuccugggccugcucuugcugagagaucugugcacucgauaggcuuuuccucugucaccacucuguugcuuugacucauuggguuagauugugucugaaauguagaguuuugugcauagagcuagaaaacuuaauugaaguuguuagaaucacaucuaaaauaaaaauguaaacaaauucuagguaaagguguauuuuuuacuguguuuggcugucuccuucccaucugaaucccuugcuguuuuggugcaugcauucauuuuuuagaaaaaauauuuugucuacuuuucccuuauauuuaguguuacagucaauaacuuaaaugaguaucacugaguuaacuuggauaaaugauaauuuccuuuucagaaucucagaaauuuuucuccuccauuucccuuuaagagagauagaaauggagaaaugauuaaaauuugaauucaaacuauuacuuuguuuuauuagcuauuucauuauagacuuuuuaauuuuuuuuuuaagaaagggucuugcuuuguugcccaggcuggaguauaauggugcaaucauagcucacugcaguauaggcuuauuuuaaauaauaucaucuuggguaucuguuuggccacauacucauuauaaaaacuuaauuauuggguaaaauuaucugauauucauguacugaauaaaaauguuggaugaaugaaaagaugaacuauauuuguuuagccuugcuguuuuccaguuaaugaggaaaaauacaagagacugguaucagcuacagaauguucaagaggacauaagacaagaacccaguuuuacugaaguuuuagcauuccuuuugccaaaaaaaaauucaauuugauucuuagaggcaauaaguagcaaaggcaggaaauucuuagucauuagcuacuauaauuccauauuuagaguauguggauauuuuggaagguaguauuuuuguuaaacuuaguguuguacgcaaauggauuuguacgcauaugucuguauguuauauagaaauaagcguucuuuuuuggauacaguguuagaaaauaagucuuucuguuuauaaaaauguagugaauuagacauacaaaacuguuucugaaucuguggugcuuccugaccucacagaagcuuacucacuuucguaaaucuuuuuuucuucaaauuuuaguagugguuuaauuuguauuuuucuuuuuauaugcuuacaacacauaaaaauuuuggaaaccaccauuucccucuaccaacauugcagacauucucacccaaucuucuccugcuauggcuguguuucagguaaugauaccuauuugaaguugauuuaaucugcaacaauaggaucuaugcccagcaaguauuuuuauuuaauacauaaauuacguuuuuauauagccagcuuuuauauagaucacauuagaaacaaaguugauggccauuugucauuugguaagcauacuuuaugaauuuaccauauuauuuacaacucugguucugagggauccauuaauauuuaaagaaugucagaaaaaggaauuacuugacguuuuaagaauuacccagcacuuugagaggcugaggugggcagaucacuugaggucaggaguucaagaccagccuggccaauauggugaaacccugucucuacuaaaaauacaaaaauuagccaggcgugguggcaggugccuguaaucccaguuacucaggaggcugaagcaggagaaucccuugaaccgagccgagaucaugcuagugcacuacagccugggugacagagggagaccaugucucaaaaaaaaaaaaaaauuuaucuacauguaggcauguagauaaauauauguauauguuugaguguacauauauauacucagauggauuuaguuuuuauggccccuuuugaaaaacugaucuagugguguauuuuuaaaaaaugcauauauccuuuuaacacaaagaauuucauuuuuucuuccagaagaauauauuggcaauauauucuugacuugagccgcuggaaauuacuaauaguauucuguaauuagaacuggacuuagaagucaaagggcaaguucuagauuagagcuagugggguuuuuugaaaucguguaauuuggcccacugauuagagauuaaggaacucagagcuguagagaugagaguauguucuuaguucuacccaacuuguacuggugacuuugggagaaucauuucauguuucacuuauaaaacagauaauuauuccuguccuucuuccuguugguucucacccaggaacugccccugaagggaacauguggaaaugucuggggauguuuuuuuugucauaagccuugacagcuccuugccuuugaguccaggggaaaccagggaugccagaaaucuugcaaugugaggaacaggugcacaggaugaaacauuguccugcauaaacauccagaaaugcccucuguagaaauaguggcaggacaccgugaggaucaccggcagcaaagcacaugaaagcacuuugauggcgacucuaccugccacacaaaugggagacaccgcccuggccuuccaucaucuguuugauaaacuuuuccucuucucagaaggcauuuugggauauuauuuauucuuuuuauuuauuaauauugauauauguauuauauuccuuuuuaugggaaauuugaauauuguauaucuuuuuaagggcaguguugacuauuuucuguuaauaucaaaucauuuuuguuuauuuuuggcuguaagaagaauauuuacaaaagaauauaagguauauuaagcauaucaaaugcgauaaaugacacuuuagguggacagcaguuuacaaagcuguuuccugcagugagaccaauugugaaugagccuuuuccuguuuccuuaggccucaacggaucuuguaaaggaguaggaauggauugugcuguuucacuuuucuguccuuuucucucuggcuaagaauauggaaugguuuagggggagauauuuucuucuguguguuaacagaguuuuuaagauucugcagaaaugaaaugggacggagaaaaggauuuggcuacauuuuuaugugauuucauuaaguuguuuaugugcucugccuuuggaaagagguaauauucaggucauuuugaugaguaacuuggauggaauauacauauuauacuaaaucuuuaaaaaaauucaggaguuuauuuccugcacuacuucaaaguuaguguugcaucuaaacaaucuuuucuguuuucagaaauauuuugugugacguguuuugagaauuuaacuggaaacuguuuuugaaaugaucuaucauuguacauaaucccaaauuauuggagaaauaauugugagaauaaguguucaguaaaauguuuucuucuuaugauaucuuacauuuauuucuaaacagagacaaagcauggaggacacaagaaugggaggaaaggcggacucucaggaacuucauucuucacgugguuuauggugauugcauugcugggcgucuggacaucuguagcugucguuugguuugaucuuguugacuaugaggaaguucuagguaagaauuuugauauccuuaugugaauuuguaagagaguaagugacaucucuuaggagucuugaauauuuguuaucaucuuucugguacugguaauuucuauagccuuucagugguucucaauagagugaggcugaaaggggauaugaagaagguuaccuuggaguauugucuuuugaacucuuuaaaugugaccuguagguuuuugaaaaaaggcuuuauauuguaugucugucacacagggagaaguuuuaucaaacaguacucauucucacuauaugcaguacuuuuugauuucuauucaauuuuguuauauuauaaauuuuaaaaauacuugaucaugagccauuacauuuauuuaaggacuugcuaauggaucauaaccacacaauaugcaaaacucuuccuuagagaggguuuucaaaguacacccuucugugucucuguugggaugggaugaguacgugugcacacauauagguacuggaugggugugcugagauaggcguuuguagauauuauuguguguguguaggugugaucugugugcuguucugaggaaguugcugugguccuucugauaguguccuuucuccaccuuuuuccuuuucuguaaucacugaaguuuuucaugauuuuuuacauuaaugauucuuuguuauuuuuggagucacauucuccuucacuuccccaaaaaucuuuuuuuaaacugaaauaaaauucaauauuauauauauuugaauguguacaauucaguuuuuuuuuacuauauucaucauuuuauauacccaucagcauuaucuaguuccagauuauuuuuguuacccccuuccccuaaauacccaaacucuuccucuuucccucuccugggaaacacuaaucuacuuucugugucugugcuuuuguuuauucugggcauuucauguaauggaaccauacauuauaugaucuuuuguaucugccuuuuugcacuuagcauaauguuuuuaaaguucaguacuucauuuuauggcugcauaauauuccaucauaugggcacaccacauuuugguuaucuguuuaucagugauggacauuuggguuguuuccacuuuuuggcuguugugaauaaugguccuccucuuuaguaauccagugaaagauguggaccugucacuggaaaaaaugcacacuugugucuauguacaauguugcaugggugauauccccuugcauuggacuuccugugcuucugcuuuacuugucaaauuauagacauauuuuuggggagaaagggcaaacaaauuuuuggcuguaggaauaacaaaauaugcuuauuuguaaucugucuuucauugaaguuuuucauuuucauuacuuuaaagaaagugucucuggauagauugacagaccaacugagggagaauuuuagucuggagacaaauuucugaguagaucuaugcuuugacugacuuacagugauauguuguuagggaauguaucuuaaaagaggacacuuuaaguauuuguaccuuuaagcacaaauaacaguuuucauguuuuuacaugcaugcagccaaagcaaaggacuuccguuauaacuuaucagaggugcuucaagguaggcuauuggaguugcauuucaagucuacguguguuacucucuaauggcucauccuuuuucuacuaauuuaauuauuaucuacaucagaauauaagugauaggaccaauuucccauuauggguuugucagaaaggguaguauuuucuaucuuuuacuguuucuugaauucuguacucugcauagccuugauuaguacuuuuuguuuucuuagcaguugaaauaacauccuuaucucuucuuucaucauaaucauuuuaaauguguauguguuugcuaagucagacuucuauauagcaaguuaaccauuuuccuagguagagcaagggcucuggggagauaaagauugaucagaacuaaucugagccaaaauuucugccuguucuucuguaauuuuuuaauguacuuuguguuaaagaaaugauaacaauugccaaaauuuuuuuuuaguacuaaugcuguauuugagaaagcuguuuaaaaaauugcuguacauuaacauuauuauguuucuccacagucauuguccaauaaugaauuagaaucauguagauuuuaggaugcuuuuuuagggaguugaauauauuugacuuuuugaaaugcuaaacaaaauaacaguguuccuuaugauaaagcacuaaagccuaaaaacguuuucuguucaucaggaggaaagguuuugguaguauugucuucucagcauaucuguuuuaagcccuuuuuuucuuaguauagauugccugugcugauuaaguuaaguagaauaaucauaaguuuuccuuuauaauuuccgaagccuccaguuuuauauacuuuauuuccagaaugaucuuuuauuuuuaaagguuaauucaugauauuucuguuauaagucaucauuguaaaauauaaaauuaaugauuuuuuaguuuuuaguacuuagauucuauguuaaucuauuuacauuuggucuuuauuugaggcuugguuguuucuuuugguucagauauugauagugugaugaaauuucaugcuuuagaaacauuaaauuucaagugacuuaggaaugcaucaauauuauuucauauaugcuaaaaacuuuaccaagaauauuuuuagcaguauaauaaaaauuauucugaacuaauuagaucaggauguuguucaaucuuuaaagauaaugcugugucaguuuuauuucauagcauuuauuagcugaacauuuccugacucucuuaacugaauugcucgcuauuuuuagguaagauauucauuugacacugcuuugcaggauuaaaagagcaaagaauuguauuaauugguaacauuuaugacugaguugcaugacuucacuaaguuauaauaccuuauuaaauuucuuuucuuuuuuauucccauauccaucauuucugcccuauuauaggaaaacuaggaaucuaugaugcugauggugauggagauuuugauguggaugaugccaaaguuuuauuaggcaaguacacauuuuauguuuuuuguuaguggugauaaaaugcuggaaacaauuauuuuugcuuuaauaauaucuaucucaauaguauauaucuuacaggagacuuuucucccuuaaaucauauauuucauuacuguuaaaauuuuaaauggcuuauuuuuccacacucuuucaugucaauuuacuuuuaucaaugaauaaguguauaucucuuacacauauaucuuuugauaaguauaauaauuucauguguguuuccagauuuaaaguacuucuuauucugaacuuagaauuugaauagauaauauccuagucuguuuuuagauaugguaauuauagccauuuuucauuaacauuacacauucacuuccauuucaaaauguaaauuucuacaggcuuacauaaauuaaugaugaaauaaaagugauaauaaacaucuuaaaaugucccaugcauauuuuaacgguagcauuaaaauaugaacuccuggucuuuugacccagugucuuuauuuuggaagucuuggacccuucucuuucauuaucagaauuacuugucuuuaucagagauguuucuuguaauaaauaacaaugugguauucccuuauuuguuuuaaagugcugucuugcuggaaagaaugguguuaauuucaauaugcaaauuuuauauaaucuggccuggugagacuuccuuugcuuuuguauguagcauaauauauguuaaaacuuuuuauauaagagucuuuagaaaaauaauggauauggcaugauauuauacacuaagcuuauaaaauaaugacccaaacaaauucuucuuaguuaacauuguuuuguguauauuuauuagauaugaaaacaugguaggaugccacaucuguaacuagugaaacugcuuuuaguagauuaauuccaccuccuuaugaaauaaaguuccaaauaugaaaauagaguuuuaguugugauuaaagguaauaaaccuuccuaauguugaccuguguugguguuuuuuguuuuuuuuuuuuuuuuauuauugcccauugggaauuaguguuugugcauugaaacuuauuaugaaauuucuuuucuugucuuaacuuuaaugaaauuuucaauguaguccugucauuguguaucuauauuugaguuucucuaaauauauuaaauccucagaugacuauaaucuuaggcauguaaaagaaacaaaauuauguagaacuuaucagaaugauguuaauuugcuugccuauaaaugguuuauuacuucauuauauuacuuuaaaugacacauucugaauagcaaagcuuuuuauuuuaaagauaaaauaaaaugugggccaaguucccucauuuuuagaaauaauauuacucucaucuacugcauuuuauugauuuuuauuuguuuguuuguuuuugcuuaaaaccagcuauguggucugucaggaaaugccauuagaaauuaaaaugugguauuucuuugauaaaacacacugauuucuauagcaaacuauuaccuuaacuugauuuuuaguguauuugagauuucaaaaggucauccccuuuaaguuuuuuaaccuaccauuaagaagcuaauuaauuguaacuuugaauauugcuguuugcagguauagugugaggaacucauaaauugugccauuuauaagaauuauacacuuggagguggaacuaaauuuggugaauaucaagguuuauuuugguaacuuuacuaauaaaugcauaaagacagaucagauaaagcuacauaaauacuuuuuuacucuuccuguacuaguuugcaguuggcuuguggcuucaguacagaugaaacaaaccaaaggugaaauguuaggcuuacuuaucaccucuaaucuuauuucauagcauuugaguucucugcaugaaaugcaaccuuaacuugaauugaguuuuaugacugaaguucuuuucugguuugugagauuauuguaguuuaguggugccucuguuacuggaagguuacugcaaagacagccuggugaaauuguugggaguacagaggcuuuaauggguucuuugaggucagguagagguuauggggggagcacuacagugagcauauacccaaaaugaagccagacuuccaagguacguucucacuggagagggagcuuaaugguaaaguuuaaacuuuaaggguuuagguuuuagauuaaggcccaggagauccaaggggaaggaggaggguaggaaaucagagauaagaggagcuguugucaucgcagguauaguaauaauuaagauauguuaaacuuucauaggauuuugcauuuauuucaucaguuuuuuuuucuagauucuuaaaucugcauauaucuaaaucuuauaaauuuggggaaauguacacauuuacaugguacauuucacucaauuuuagaguuuggcuuuucuugugaaauagaauuaaauauaugugaguaaaucaagaccccuaaccaucauuaauuuuauuauuugguuauuucuggccaaggcccuucugauucuuugaaagcgugcuaagcccauuuuucuucauuuacauaccuucuuauuuuuguggccaaauuaacuaaaauauagguaucuuuuguuguaguucagauuauugaaaacuaccuuguuugaaaauacauucuuuaaaaacuuauuuuccaaauaaaaucaacaggaaaaugacccaagaacuaaaugaugcgaggacuaaauccuuagagugacaccaccuaaggaucaugugguuguccuuuuguccuauggcuagcaccuagcuggcaucguaucagguauggguggaaagcaaaagggaagccagucagcacuugcuacauccuggaaaaucauuuguagacugauagaugcaugagugagcugaugggaggagaagaccagaucuugccaagccaaaggcauucccuuugguugagcccuguucuuagagguucagaaggaaucacaugccgagaguauauauuuuucucucuggacuaguacuuuugucuugagaaccacaggaagguugcuuggcuggguaaacaguuuuguucaaaugcuuuugcauauucguugcauauggucaucugucauacugaaggauggaaaaguuuuauauguaauacuuggaaguacuuauaauauauuggcaaauggagaaaaguaaagauguuuauacuaaauaugcagcuauaguguuuuaaggcaggaagaagaaacuguuauucccauagggacuuaguugggauuauagaucuuuguucacagcauuugucugcugcuaaauucagugaaaacauucuaggcuugucaaaaaguaauuuaaauaccaacugcaauuugcguuuuuccuaccaaaaacaugaacaaugacauaauauaguucuuuugaguaaagcagagaaaauucacuauaaucuuuaaaacuuuuaaauuaguugucgucuuauccuuuaucugccuaucuugauugcugguaguuauacuacauggagacauuguguguugccaaagccuuaaaugacugaauuacgugguuccaaccagaaaagcucaguggucauggauguucacauuucuuacagucagaacaccccacccuguuauuccuccucaaaauuaagggcuugguauacagcuugguagauucugauaccuacuagagcuaagaaaccuuugcuacccagagccaguucuucacaggaaaaaaacaaaugaugaaaacaauauauacuuugauuuauuucuauccuaaggccuguuugggguccaauacuuaguuguaaggggucuuagcaauagaagcuaauuucacaggcccauggggagaggaauuuggaauguuccuauugcaagugaccagcuaaggccuugaucacauuucauaucgguaggcaaagugaauuauuauuaauagcugacucuugucauuggccagaauuacaggaccaugagucaguugccagaguuuuauagagcuaccacauuuaauaguguuaaaauuuaaguguuaaaauuaucugaguuacauaauuugaguguauuuuugcccaccuauggaugcuauaaaugguaauacugcuaauuauauuaacuccagaauuuccuaagucagcuccaggucuuaagugggguggugguggggggaggggagaaguuugaggaaauaaaccuuucuaguuugaaugaacaaaugaacgaauguguguauaaucaacucucgauaaaaucugguugguaaaugagcaaaucuggagguugucagaguauauaucuuuuuuucccugauacugcuuuuacucacucuuccuuuuacugucaacugauuuuuccauuacuguccauugauuuuugaugauaaaauuuugucuuucaacucaacacucuaaugagagaaagguaaaccuggguaggggcugguaggaguggugaggcuuggucaaauuguggcuuucuuuugacauuugauugagaguugauuguaaggugugcauuuuaauggacuucuuuauuuuccaaauaccguuucuguaaaccucucugaccuugaugcaccucgcuuuugagaucacccuuccuccacuucuuuuuuccaccuaacugcucuccuuauuuucucucucucuuccuuuauucuuauguaggccugaccaaagauggcaguaaugaaaauauugauucucuugaggaaguccuuaauauuuuagcagaggaaaguucagauugguuuuaugguuuccucucauuucucuaugauauaaugacuccuuuugaaaugcuagaagaagaagaagaagaaagcgaaaccgcagaugguguugaugguacgucacagaaugaagggguucagggaaagacuugugucauauuggauuuacauaaccaguaaccuugauucagggacugaagucauuggcuaaugaacaccugaagcagccuccuuuuucuuuucuuuccuuggcuuaugcagggcuuaaugugcaguggggugguugugaucuuaccgugcaagucaaccaugugaucuugcccaguacagcuacuagcuagucccuugcucgcucagcucccccaacuucuauugaagaaaaugguacuccucauucuuguagucagcuacaaaguacacugaaaaugauguucuuggugguauaauugguuucuguaucguuuuguuucaacucauguauucacugaacuaaauuuggacacuuaacagcaaauuguguugugguuaacccuugaugcuugucuuucuaacacacuauuaauuaugaugauucuaauggauuucauuauaaaaauauuucuggcaugauuuuuaaguuaaaugcuucucuguucuuuaacaugacugauguauaaaaugaugguucuuuacuaagcugauauuuuuuauuguaauuuguuuagguuugucagauagguucauacaaauuucuauguaaaauucuguguuaauggugcuuuuaaaauaauuuaaaaauaacuccauguuuuugccuuagaguaaguuaacuuacuguuuucagauaguagcaugacauauuucugucugugaaagcaaaauuuauuuuaaauuuuauuuccaaauauacauccagagaaaguaauuuguauuuuuuuuaaaguaggcauauuacacaagagggaacaugugaauauguaucuuaauguuguacauauuaaaauuauucauccuaaauaagucuuuuuccauuuuuuccuucauuaacuuauuaauuggauauugauuuuggcuuagauguaaugugauuuuuagaauuauaaacuuauugaagugguaauuccauuuagggcaguaaacuuuucccauuagaaagccuuaaaaacauauuugaaucaauugcuuuaaaaaugaguuugcuucaguaguaaccaaaacagguguagcagcuauauacaaaaugcauuucuuaaaaugagauuucaucaguuuccccucaagcaaagcucuucuagggauaaggaagauaaggaaagggauguuacuuuuugaaggagugauguuccgugguuuuaaaucucuuccagcuucucuaggauuuugcuuaguguuaguuugucagagagcuaaaaauuugaaaaugcuugcacuuccucacguuuuauuuaacuauaauuucuacuuuucaaauauuucuugucuucuauaucuaaucaaauuacuuucaauaaguguaucauucauccauuuauucugaggggacuaugacaaauuuaaauuguuaugaauuacucuuguaggcugucauaauaacagccugaaaguagcagccucaagucagcaugggacauccauucccucugcccaccauuuaccugugucagcaaauacuguccaauuugcuaaucuuauuaaaaagcaaacauucuguagcuacuuuuggauguggauauacacacuggacaauaaucucuuaaaguuuaaaugacuauuaaagugacuauuaaagcucuuguuugucuugccugcacuaaugggcaaauauguuuuauucuguuaaugcagaagauagucuguuaaagcuucuguuuccaaauauucaaggacuucaguuaagcugucacuuaguagcauguucugcaacaaaugaguaucauucaguaauguuccuucugaaaauuuauucaaucuuuguauuuauugugucuucugcuuucauacuuggguacuaugaaauaucaaaguuuauuagguuuaaauucuaaaggaaucuucagccccacucaaugaaauucacccagccuaauuuccgggauauacuuuuuaaaggaaucuuauuuguuaacguguuguuacuacuaacacuagaagauauucgauuaauugauaagaaguaaaugauuaaauuuuguguuaaaaauauuugaaauuacuaauuuuucaucaggcuuuauuugcccuacuaaugcauauuuuauguacagaaauuaauuaugcuuuauuuuuguaagugaaaaacaagaaugugggauaaaaauuugcuacuuauuuuguaccaccucucauuaguuccucugaaagccucugaugaaggugacacccagguagcugacgaaccccugacuucugugacuuccgucaacuugugccuaaggcuugugugugugugugugugagagagauaaaauaaagguauuuuauuuuaucucugcacuauaaacugcacuauaaaguaucucaaagcugaucaaaauuacuucaccuuaguuugauuuauuauguauugcuaaaauucuuaauuuucuaagcguguauuuucugacuuuguuucauaauauaagucuuuuccuaccucaugucuuuuaaacuuaagaacuaaauuaaggcaaaaucauaucccauuaauuugaauguuuauauaguuauggaauuuuaaguuauacuguauuuacuuuaccuuuucagaguugagaaacucuguggaacaggcuucguguugagauauaguguugucuccucagagucacuguucuggcuuauucggaugugcugacauuuguccgauugcaaagacgcuggguucuccggaguuuggcacgaaaacaagacagcagcacucuggggauucuuuucagcccuuuagcuuccuucagccugccuugcuuugggacaugagugguggguauaagucaguaggggaagugucuucugggugccaauuuuacccaguccugaggccuggcugucagccugcugcccuggggauccugcagacgccucggugcugaggacauauggaauagugggcuguccugcauuuucaucuuguccuugauucuuucuuuauucuagaaauuaccucccugucuuauagagcuguauccagacaugaaagagggacuauuuucuguuugaauuauuuuuauuuaguuagauagaacagauugucuaccuugauguuugugacuuuggauaauuaucaaaaaauuagaucuagcacagccaguuauucuuaauuuggucacuugacaguuaacuuuuugggaauugaugcuccaugacccuuucuaaauaauccgcugggcuagcuccuuaagucuauaaaacauacaagaaauuuucugugauuuggcuguggaaucuuugaucacaaugcauauuuggaaugcuuaaagaaacucagugacccagacuuuauuuucauaaguuaaaugauggaaccaguauucagaauucacugccuuuguuauuuguugagaugacccuguaauacuuaggaguuagauauuaaguaguuuguggacuccuugaaacuaggaaccagaucuucgguuuuauuugaauucuccuucaaugcuaagccuugcaugugauauucauuaauaucauaugaauaaugucauaugcugguguggguccugaaggaugaggaguuacuccuugcauaauaaaauacugaguuuuuuuuuuuuaaaaaaaacugguuuaaauaagugguaaaauuauuggacauauuuuuugcaauagaaaugacauuuugaguuucuauaacaaaccuaugcuaacaaaagucuucaggugaccuuuccaaucuccaauuuguauuugaaucugcauuuuaccuuuuuuucucugucucuggauguaaucccuuucugcuuauuuagucuuucaguuuucuuauguucugauccuccguuccccacuuacuguagaggguugguggguuuguagcuuuuucuucuucuuuuuuuaaucuguacuauauuauuacaucuauuuaaaaauaaaaaagcaauugguguaguguccugacaugcauuuuacuaagaguagacauccauucuagaggaacagucugucucgcuaacaggaugguuacucagacauuuagggccucuuuuugcuauuuguagucaauguugaaaugauuacgauguuccaguaugggacggaggaagaugagaaggcuuacagugacucacaggucucacuagaaauggugagaguggcugaagugaccugaguaugaagugauauccagaccaauucuagagcugucugaaagucugaaguagcuacuuguguaucuguaaugcagccagucuucuaaaaucaugucuauugcaugugguguaaccacagaucuauccauuggcuuaaugguucaaacauuuuaauuucauagagaacauuugauuuugaaaauguagaauaauggccugaggcaguugccaaaauagcauaaauuuccuuuaggcaacucucuuacguucuaagggaagaauguaagaucuuuuuucuaauuucuguauaagaauucccaaauaguugccagagcuauuaacuaucaucacuuuaaauacuuacaucaaaauaaguauaaaaggacgaaaagaaaauaaauagcauggcaguuguuuuucagcauguauuuuaagcacauccuaaugcugcuuugauuauuucuuaaauuggaauauauucuauuaauuaaaaacaacuuuugucugaauggauuaagaaauaccaagauguuuccauuuuugcucgaauugauagaauuuucuuccuacuacuuggaaacuauuuuugaagagccuuuguguugucaugaauuuuauugauuaguggaauguucccuuuuuucuuuuuuuucccuagacauuagcuaugguacuaaagauagaaaaggagaaaaguagugcaugcuuguggcauuuuggcacuguagggagaaucuacaucaaccaaaguugcaaaugauaagaauuuaauucugucaagaauuaggaagaauagaaaggugggccuuucguaccugccuugugguuuucccuuaaguccacuucucuaaugcccgcaaacuaauauuuuuuccccucuacgugcugucacuaaucuuggauuaccacugaccccuuucuccauuacuguauuucccauuguugcugggaaaaaaaaaucuguuauaaaguuaccuguacugagccucugucgggggcaugcugcuccaacaguuucccuuguuagcagucauucuaaacuuuuccacaaccuuccuucuuccagggucauuuuauuccucuguagagaugauuuugcuuucugcuuuccuaagauaaucuaguguggcuucauuccauuauuuucuucucucuucccuuuacaacauuacuaucucaggauuuuuuugagcuauuguuucuugucucauucacucaccuuuuuuuuucagacacugcauccucugguuuccaaagcuagcccuuucccuugagccuguacauccuccugaccucaucaccucucuccuguuaugaacuuagcuucuuuuucuuacagacaugccugcguuuccucgaccuucaaaacaaaacccggauaaaauucuucaaacuuuuuccuuuucuguuccccucagaaucuagggaaauuccauguaugaucaguuuucuucuaaggaaaugaggaaggcugaugugagcacccuagauuuuuggucaccuuuccuuccaccuauguuuucucaucacuguggcaugacugccuucucuacugcuuguaaaacuguauucugaagaaccuuagaggauauuuaguaaguaacauaauaaaauagugcccucauccuaaaccuuuguucaugucuuccuuccuaaaacugaucauuucacuuuaaaaaaaaaacaaacaaacacauuuccuuuuuuaaaaaauuuaauuucauuuuauuuuaaguucugggauacaaaaaaaaauuuuuuuuucuuuacucucuuuuuguuucauuguuacuuagggacucuuguuaacuguuuuuggugguauacuuuuuucaugucuauauacuuuucuucagaaacugaauguaauaauuguuuaaauuauuagcuugguccuuuuuaugucaaaaauauugaaaaauuauuggcuauguuuuuaaguucagaaaagcauaagaugauccuuuggaguuuuauaucaugcauugcacuuuguucauguguucauuucuaucacuauaaggauuuauacccaaaccaaaaaaguuuaaaauaaagcacagcacuguuuauuuuuauauguuucacuaaucugaugcuaaucuaauauuuugguuuauucaugacaaaaguuaacucuagucuuuucauccauauagcucuuuuuaccuagaucauaacaguggggguagggagagggcagucuggguuuccucacucuacguuuuaauaggaaaaucugguucugcugugggagaacauguaggagucaggaggggaacauagcgguacuagaaguauauuuuaauguuuuaugcuaauguguuuuacaccuuagauacuacucauauuuaaaaguggguauuaugagaauaguuuugauauuuuauucugaaauaaacuuuaguggagagugauuggaaauagcacucauuauugcuggguuauacacuguuuuuggcagagguuaggaaagaaucaaguuuugucugggaaaaauaauuuuuaaacacaugggaauaaguacugguuaugguuaccuauguauuucauauaaguggacaaauauaaccauggucacguuuccauuuuuauguugucagugguaagagauacuaauaacauuuuugaagaauauugauauuucaaccaaaauaaauuaccauucucgaauggaugaccucaauugauagauacaaauugcuaucaauagugaaaggggagguuugaacaauauaauagaacagacaucuaauacugaaaguagaaguuuugagaaacguacaaaguggguuuuacaauuuacagcugcaaaaaugucagauggcuuuggggacuuucuugugaccacaccuuagaccuucguucuuuagugacaggcuaaaggccacccuuccugaggagaugaacacuacauugcaccuccaacccuaaugugccuaagaaauggauuggaacuuuacaaaguuugccaauacauagcauaaaccagccuuuaugugacugagagagagaauugggaagaucaguucauugggaugcuaaguacagccugguuggaauaagaguuagagguauauuguuagagacucaaaaauaaaucuauuaucagaacuuucauuugccaagagaggaaauagaaagcuauugcaaaguuuuuagagugggugaaaaauguaaaauguauguacauaauacugucauucuuacuugcuuguauaauuuuuuaaaagacagugcgaacugguggaagagcagugauuguucaaacaguaaagaugaacucuaucaaaauaugcuauccuuuuuuggauggcaagugugauugaguagugaaguaagguccuugguccuucacucuaguauuuuuaauugaucaucugugacccaagcggaagucuaccacugaguagaaaaugcaauuuccaguggcaauuaaguauuucuaaugccaacaauucuuaaagaucuaagccaaauugugaaguugguuaaaucauaggcugauuauaaugcauuuauauguuaaagauagugaaaggaaagcuuuaaagugacaaauaagagagauauuggaguauuuuuuaaugaugaauuuaacuaacuuaacauauuuuauaguggcauugauuuuaccuauuuaauagacacuuauuuuugaauucccuuaaauuuucuguuuauaaccuauuuucaucuuguaaaugucaacagaaggacccagugggguagccaagagaaaaacuaaggcuaaagguauuuucauuuuuucaaauuagccuugagugaaucaaguuuaauguuugaaaaugcaugacauuuucugggaauguuaauauugcuacuaaugcuaaacacuauugcuuuugggucuugcuugggugcaacuuagguuauaaguaguuuuaucaagauuucaucaaaggauuuucugcuucaagccuauaauuuuaagucauuaucuuuucauguuaucaaagcuuuguaauagucuuuaaauuaagaauguauauauuauacaaauauguuauauuuguuaugauguauauauuaaauuuacauguacacaucuuaccuuguucccuaaaaccuuucuuacuuugauuuuuuugaauuacuuuugggaaaaaaagaugaagucuucaguaauuguuuuuauuucuccaaaagcucucaugacacucugucuuagagcacagugaaagcuagugugauucaaauguguaguuuucaguaaaaugaaaacuuggauguaaauguauaacccuacauuacauugacauagaauuuacuguguuugauauuuuaauucauuaaaaauuauuguccgggcacgguggcucacgccuguaaucccagcccuuugggaagcugaggcggguggaucacgaggucaggaauucgagacuagccugagcaauauggugaaacccugucucaacugaaaauacaaaaauuggcuggacuugguggcaggcaccuguaaucccaccuacucaggaggcugaggcagaagaaucgcuugaacccgggaggcagagguugcagugagcugagauugugccauugcacuccagccugggcaacagagugagacucucaaaauaauaauaauaauaauaaauaaguuauuauaccugucagccauuuguagacuaacagcucaguauuacagccugacuuuauaugccagugguuauucuuguucauauguuaguagucauauucuuuguggguagaggcaugggggaugugcaugccucuauauaagccuguuuuucuuuauaagccugugauauucuuguggucauuucacgggcuuggcauauuguuuguaguuuguuuuuuuggugaaauaugaacagaugagacuuacuaugugauucacaggguuuugugauuuauauuuuaagaucaggaacuuuuaaugguuuaaccuccuaucucuucugaauaauuucuggggaugaaaacaauuuucaccaucuuauuuuuauauaaauaaugaugaaacaaauggacaauaaaauauuuuacuucuugaucuagagaagcaaauuaaacauuaaagacugaauuuuuuaaaagcaguuuucagaauaagacaugauagcauugcacauccauuuuacacuuuugcaaugccaguaucuauguuacuguccaaacgcauugaaguagaaugaagacucagcaugauccugaaugaauacuauucuguauucuuaaaagacuguaauaagguuuuuuaggaagaacugaagaaucuccugguugaucaccaggaaauucaguuaauggagaaacccuaugugguguuuuuguuuguuaaucaagauuuuauuagacagccuagaaagacauagugcuuuuagugagcacugcaaaucuaaugcucauuuugaauaccauuugugcuauguaaguuuuaugugauuuugaugggcaaaaacaucuuucacauuuuauuauauuaaagaaauauuucauuuucuuuguuucugcuuaaauguggcauugcuucugcuuaaauguggcauugcaaacaccuuaccuuaugauuuccuuaugagaguacaaacagaugaaauucagagcuuuugcuaacugcuuuauuaccauguaaagcaaguugaaagcaauaccuuccaugagauuuggaauuagcuguguguuucauuuaauugcucucucaacccaaugaacuagaagacguguguuagcuugaguugcucuacaugaauuaacagggaaacauacuuaaaggaauacugauuucaugaugaauauaagcagaaagagaauucuaauuuuuccuuuuaaauacuacagauaaugauuuaaaaaugucauacacaugacaauuuuuuccuaguuaacuaauaaaaugaaauuauauuuaauuuuauuuacauauauuugucuucaaagaagcacguguauuuuaaggacauauguuuuugagcuaaacauuuuaaauuaucuuuguauauauucuuacaaauuaugaaaaauuuguucuuacguugccaguguuccuuuaauuauaguuacaaagugugaguuaauacuuugugcaaagcacugccuucguggugcccucaauuuuauaauauugcauguuaauguuuuaagacaagucauacuauauuucaagauggaaaauaugacaagcuucuagcauuuuuuaauaguugauauuugauagagauuugcaccuauuuuuagccaccauaaagacuagugaauuaaaguaacuuucugaaugugcauuuccuguguguggagagauaaaaagagaauaccuuuucacuaacuuccuguucugugauuaagagauccugucaauaaacauuuuuuccuuuaauuggaaaaucugaaaguuaaagaacucacuaaagaagagcucaagaaggagaaagagaaaccugagucaaggaaggaaaguaagaaugaagagagaaaaaaggggaagaaagaggauguccgaaaggauaagaaaauugcugaugcagaccuauccaggaaggagucuccuaaggguaaaaaggacagagaaaaagagaaaguggaccuagaaaaaagugcuaaaaccaaggaaaauaggaaaaaaucaacaaauaugaaggauguuucuaguaaaauggcaucccgagacaaagaugacagaaaggaaaguagaaguucuaccagauaugcacacuuaacaaagggaaauacccagaaaagaaacggcuaaagcucuggcaucaucaucccagaacauggucauguuccagauugcaguuuguuacaaaaaagcauggaaaauguaauauugcucugauuggugaggguguguaaauuagccauugaauguaucauuggugcuuagcaaguaaauuaccugaaauuuaaauauaccgucucauacuucuaaauguaaaaacauuuuaaaaaugucauagaauaugauguaauaacuucuauuuauugaucauguauucagauaaauguauauguaucaugaauuuuuauggauuaauauauugaauacuuucauugacguuaaauaagaauauuaagauuuuaaauguuauuucugugcauaaugccuuguaacuuuuucaaguaugcuaaauacucagggagauggauuugcucguuguuuucuucccuccuuccccuuccugcuucccuguuuuucucuuucguggacaccuccccaggcucaugugccaccaccuucccuccucuccagcccucccagcccucccgcagccuuucagggggccguuccucaggcuuuucauggguucuccuuccccuuuucccucuuaucuccccuuuucuagucucccuccccaagucuuuuacucucuccuuuccuucacuccucaccucaccgcugccccucacuccugcaugcuucucacuccugaccucccuacaacaaccucacccuucucccaucauccaguacauacuuagugcuuaccaugugccacauacacugcuccgagaacuguggccauagccaugaauaaaggggagaauuguauuuagaagaacaguuucagaacacuuuuauuuaugauaccuuuauagucuuagaauaacuauagaaagguuuuaauuauuucagauuagaauguacuuucauuuuauaucacacuuuuuuuccauuauuuugguugaauggcauacauuuuucauauuugauugugucauuauuauuuaccauuucuaaggaauugcaaauguaaucucuucacuagagaucagaauuuagcaccuuagaaaacauuuaauauaaaagugaaguuuuagugagaaauuaauucuacaaaugguuuguacuauucugugccucaaauauuaaauaucuaauugugacuacugugaaaugcaguuaguugauaaugauaaaaucucugugguagcauuuuugauucucuuaauguuaaccuuauuaacaacagaaucaaaaaugcuaccacuaagauuuuauuuuuuaaaacauauuuauuuacuuuuuuaugaagaucuuaaaaacgagauuuuugaucuaauuaaagauauuucaacucagaaaugaguauguuuaaguguaaauauuucuaaauguauuguacaccuuuuucuuagguuaacgccuuuuacuauuuaaagucaaauacuuuacgacauuuaguugacagaaacuucaacucaauagaauuauacaacagagaagaaauccuagagaauaucuaauaucuccaauauaauccuguuauuuuauugcuuaaaaauuaaggccugaagauauuguaaccugauaacuucgaguuuuauguuuugauuagucaggauuuugccauuuuuacacauuacaagaacauuguaaaccaaaaagggaauucuacagcugcuuuguuuggcagauacagggcacuaacuucagaugacuagaucccaagucuagaccuggaaucagaguucuuuuuccucuuagcucacuuccuaagucuuaacugugcugguuucugccugaguuauucuauuuggagaugcuaccacuugauaaccaagauggcccucagcaggcuccagaccagucucuaguuuaccaaucccaaugcagauggcucugggagagauaauuccaguuggccugguuaggccuggugaacaucugggaccauuuuuguaguugaggauggugauucuucccaggcgcacaccugugcacaaagcuuuggaaugggaguugagugggucccacucaaacuucaucaaauguagggcuucugggacaagaaagugaggcuuugaaaacuggacagaagaagaagcagaacaugucccccaggcauaugaaaguuacacgauucucaaaccauauccccguguuagaucuuuucuccugagauaaauggaauguuuuuuuaaaacuuauguacaaaauuuuaagugcugucuucacuaaagauuuuuuguucucucuugaagaagggcaaacaauuauaagugaauuuguugagagcauucugguaauuuuuaccuuaguuuuuaaguucaauggcuauguggcagaaaauacauaaauacuaaauucuaaacaaaugagugaaaauauuuuggaauaaccuaaucaucaaaagcacauaagaauugucuauugcuauuuaguaaaguacuuugaaauguuuuggcuaucucauugauuuuuccuuugacuguuagcucaagaauugaaacaccucaacuaaaacauuuaaagauccuuuaaaagcacuuguagacuagaacuugauuuauuuuuucccaucucucuucuuuuccccuucucuuuucuuucuuuuuguaaauguuucaacuaacuuuuauugaaguugaagucacacuuuauccaacugcguaauauuuaagcuucaacuaaaaacaagcuuucagucaugauuagaggguuaaaaucaugcauugcacucucaguuuuacacuuuuuauucaguagguuguuauuucuguauuguuugcuucauauuguuuucuaaguauaauuaaaaccagaaagguuaccuuuuuaaauaagccagcuacaacgggacaaaaaauucacaauacuagguaguugggagucagaagcuguuuucgggaagaccugaaaagggaaaauuaaguacuaaaaauguaaguuuauuuugccauaccccuaacaacauuuuauuuaaauuauauugugacuugauuacaaaucuuuuaaaugacauuauuggcauauuuuucuuaaacuuuguaagaaaaagauaacauuucacauuuuaguagcaaaaucauuguuaagagauagucaauuuugugaaaauauuugagugcuaaucaauuuuuccaggaugaucuucuauccuuuaauauuuagauacuuccuuuugaagcacuuacaucaucaucaaauuuuuggucauuuguugugucaucuaauuucuguuucauuuucuaauggcuucguaugugaaugaauuuuaguuauuccuaacgucauugguagccacucuuuugaauuuuuuuuuuaaacaagucuuucaauuuuauuuuauagguaauuugcauuguauauagaugaucgucucaaaauuucacaaugagagacugaugaaauugacauaaaucaaucagcaugaacacuugaauuaauccagaggacuacuuaaguuaauucuguaggugguugcuuuauugagaauauuuuguauuaugaccugcuuagcuaugcaaguuuguaacuucagagguccucauaaugauacuuggauaauaaagauuccccauagacacuuccauugaaaaagaaaagaaguaaacaagugucauuuguaauuugaaauguuuuaaguuaacugucauguuacuguccaugaaauggaucuggugacuuaggcucuaucuccugacauugauuucuuucuccuguguccucaauuauuucuucuccuguuaaugcccacugguaauaauucucaaaaucgauugcucagaauauuccauuguaaaaugcaccuuggaaaugguuguuuuccucauuuguaaauugaagacaaugccuauuccucaaggugguugugagaaccagucaauguugcauauguguaaacagccagcacaugguugggcauucaguuucccuuuaucauugguagaauaagaauaguaauacucaaccaaaacgucucagucagggguuaaaaacuuggaagcacugaaacugugcuuccuauuccuacuuaggucaacagauugcaaaacaaauauuucaguccuuuauccuuuguaaugaaugugucuuugugaaaugaguauaguggagccugauuuauucuauugagaucauugagggggcaaaugcaaauaauuauaaauguugcacaugagugaagccguaagaaugcuuaauuuuuaaaagaauauugugacaaccugaaaacacaagauaugaaggcuagaaaaaaaguuaugaaauaaacuauagccuuaaguauaugguacaaucgagaagccuaauaaccagccuaauugugaaaaacuuauguuuguuuuguauucagaacacauuuuuccauagaugagauuuuauggucuucagagauuuuuuuuuuacucugguccacaaaaauugauuuaauucuaauauccauuucugcaacucucauuguaacuauguuucuauggaaaaugcauuuaucauucugccuugggauauuaggaauauauuuaguuuuacuucugaauguucuccagaauuucuuugguuacauccaugguguuaaauccauucagauaccuuacauggacaaaaaucauggauuggcucacauaauuguaaagcccaggaguaguuuuggcuuuuuucuuuuguuaugcuggaucuaggugcuugaacaguguucucaacauccaucugucuauggacccucaggaauguuggcuuucuucucgggcagagucucgugugcucaucuucaacccuacuccuuauggggugggagauaagaaagcugugauuggugacacccugggauaugugagugcccacuuuuaaacuguuggguaaagaaaaauuggaguccucuaaggaaguuaguguguuuuuaccagaaggaggaggaauugaugcacugaaagcaggcagaugauggaguuuguuuccccuuuuucuacccaucccauuccuacuucucccccugcccaaauacagagaggugaaugggaugggccaaaauagguauuucaaaauaagaagcuguggagcuaaacauuggguacucaugggcauaaagauggaaacaggagacacuagaacuucuagagaggggagagagggagggagacaaggguugaaaaacuaacuauuggauacuaugcucauuaccugagugauggaaucauucauauucuaaauuucaauaucacgcaauauacccaugcagcaaacuugcacgugcuccuugaaucuaaauagaaguugaaguuauauuuaaaaauuaaaaaaaaaaaagcuagggagaagagagagaucucauuccaaacaauuauuggucaacaauaguuuuagaccauugaaagaauauaagagaauguugacuugauaauaaauauugccauuuagaugucaggugauaaaguuuauuuuguuguuaagcucucuccauuuugccccauucaguuuaaaaggaaaguuuuuguguuuaggaaacuaaaggaugggugauauguagcagacccauaagguuauuuucaugaaaaaccuagcuugggcuaaucugaaagauuccucaauaacagucuuuggugucuuauccuuucuucuccauuugccuaagaauauaauuguauaagcuggauguuuauuccuuggcuaucguuuuuaccuaggaaucaauuucugcaagagcucuguaagccuuacaaagcagaaagucauccauuucuuuuuucuuuguucucauuuagugccucauuugauuucacuuuguguaucuauuuauugcuccauguuaagucagguaugcauacaucauagaagucugccucucauuuccaucuucuuugccuuauguaucacuucucuuguguccuauuagagggagaugaucuaugcuuaaagcuguuggguuauuuuugauaauuauauaacaccaacaugcugugucuauaguucccauuuauugauucaacuaauauuucugaguaucuacagcaugccgggacugggcaaggcaugggggauacaagagauugagguggcugcaaucccuccagugaaaugcugcaaaauaagcaaggggcugagagagaaaguaaugagacugaaacgauugucaguacagcccacuagucccucugccuagaacgugcuccugaaugugcuccugcucuguguggugggcugccuuugucucucccacgggacccagcccagucaucaccucugcacucagacaucucugacccucccaaguggcugcaucccacacacuccaguuaucgcacucaucaccuugccucauucuuggacuuugcugccagacuacgauuuaucucgagcaccuauccuaguaacugacacuaauaggcauucauuguuuguuuauugaauggugacuauacaaaauaaauuaucuaaaaauauuucagguguauauauacuguugaagaauauuaggaagaagaaaaccguguguguguguuuuugaagaacccaaaagauuguucaguaauugcaguguuuuaacuaccuuggaaguuaccugugacuggcagggagggggguguaaagauuuuuuuuagaagaaauuaaugaaaugguaaauuuuuggaaaaauacuuauuuaaauuaucucauuuaauucuuaaagcccuucuuagggguccuguuuuguccccuuuuugcauuuguggaaaccaaaaaguguagcugugguuaacacugagauagaauucaaauggaauucaaaggcauccucuugucccaggugccugaacuuacacaccaugcugaguugcauguccuugaacuguauuuuucaugauguuaaagugaguccacucucaccagucuuuguugagucccuucauuggugcugaaaccaggcucuugggaaccuuauuggcaguguuuaauucuuuuguaauuuaugucuguuugaaaucugucuguccagcuuggguuacuugaagaugcuuugaaucuggaauggcucuuacugcauaucauggggcagcuuugaguaccugguagucucagaauuuugguaaguuccgagacugcuguugguauacugaggaagaucuguauucacugauuacacaagccaggagcgacaacgaggauuaacgugguuaccuaguaugcaugccuuucugguguauugauuuuccagaauauuucucaaauuucauauaccuaugagccuuauucuugggauaaauugauuuauacugcuagacuccuugcaauugaaacaguaccacuucugagcacucacccugagcacagauaaccauagcuggaguaaccuggauuaguaaggacacguuuucuuucaucuguacaccuuugaauuaguaaaccaaagauuaaaacacuaauuuuaaaaaacuuuuuagcuuuuuaaugggcuagguguaugaaauuguaugaaacaaaguaaguuuauaauuguuucccagguuuuguugagggaguggcuugcuuauaacucuuaggagaaguaaauccuuuguguucccucaagucacagcccuuggauccagcauccagggccuuucugauaugcacaccucucuuggugccucagucaccuuucuuuuccuuggugccaaauaugugcccaguugaggaauuucguacagucacaugccucaugcuaucauuuugguuaaggauggacugcauguaugauaguggucccauaagaucauagugucauauuuauacuguaccuuuucuguguuuagauacacaaacacuuuguguuacaauugucuacaguauucgguacaguacgugcuguacaguuuuguagccugggaacaauaggauguugcauacagucuagguuuguggcaggcuauaccuucuaaguuugccugggcacacugcaauguucccacagugguaaaauuuccuaauggcacauuucaacauguauuuccacacauuccucagaauguaucgcuguuguuaagcaacacaugacugaacuugcaguucccuacccgaaacacacguguaacuuacauagccacaucccugauuuccuucagggucuguucacauguuaucagugaguccuuuugccaaaguauuaugaauaguccccacccccacuuuucccuaaugugcucccuguucugugucuuccccguacuaucuguccccauccaauauacucuaaauaguucauguuucuuauuuuuuaaguuucucucucccccggaagguagguguguuguuuucauuuacuguagaauaaugccuugaauuaauaggugcuaaauauuuguugaacgauuaaauacaacauacaauuuaguaaguuuacaacuacugcauauuuauggaaagaaauauauugauucuuucucauuaugggcagcagugaauaaaguaagcuaauccugggcuuggguauuugugucacucauauuugcuaugagugguugauuuaaagugcugauuucauuugcauuucauagcuucaucuaauuuuaauuaaaauuggaggggcaauuauauagugauuaaaugcaaauguuuuauaauuuccaaauuuaucugauuaaccuaaagaacuaaaaccaagguauguuuuaagggaauuaauguguuuuccaaaucauguuguggccauugcuguggacuggcaguaucuauucaccauacauaaugacuggaaggcggcuguggacacccuguuccucuuggcagcacaggaauggaagugggucccaguccugaugauuaacacugaaaagggagacugcugguagcuucuggaaaaaauuuccucaagccuaagaaagaagcagagcaagagaugcuccuuuugcuucuggacaucgccuugucugaaaaagaagcuugcagcuggggagcucugauugccagccugagggugaagcuugaccugcgaugcagucagccgccuccgcacuucuuguuuaguuagaugauaaauuuccuuccuacccaaccauuauaagcuggcaguuugguaacugcagccccaggaacaucgaaaccgacacaucucaugucauaaccuaauuuugaauauuuauuucauugcuacuucauugccacuuguaccucauaauaaauccauuuuugaaaaccuuuccuaugacugaauugagcuuauaugcauuuacuuuucuugauucauuuucgcuugcuuuuucccucaaauuuuagaacuaaaaugagcuuggguggcaaaaaguuuuuuggaaacacugaaauaaaaucuuguacggcaaauucuuccauauggguuguuaaagcaauuauagucuagaauguguuuuuguuaaguuucaaaaaguuuauagaggucuagaggaggagauacaguaauaugaucucagcuucuuugaaguuuacaauuuuuuuuuguacugauuucauaucuggaaauagcuaugaccagguauuaacaauuuuauaauacaccuuccacuuuggacaggguaaaauaaucaauauuuuuugcucugugcuuuugcuuucuccuguuuuuccuauguuuugcaauuucaauuuuagagacaaauaaguucaaguugguuagagaaagcugacucucaggggcauuguaugucggaauguugguauacuaguaguauuugaacacguagcauuaugacuuuucaaaugaaacuucaaaacucauuaagaaugggguuuucaggcaguuuagaucuuuaucguuuggugagaaaacauuucauugcuuguauaacacacggaacacaguuugagagccugcuaaaguggggucagugaaggaugacccuguaauuuuucauucagacagauaguuuugagagugaaauaaucucaggacagcagacauaaacugggagugucucaggcaaacuagacuuaugacacugaaaugguggaugcuggagcagaaauacggaucucugguacauaggaguagagaaguacuaaugugaguccccuucccucuucuacucagcuacuggagugcaccuaagaagcccuggcccugcagggaaucuccacagccauuuagacuuagcagaguagucacaccacuggguguauucagcccuucaacaaguguucauugagcaauugcuaugugccaaguguuagcugaggugcugagagugcaaagauaaauuacuugauucuugagauucuuaagcuuuuucccauucauucagcagaacuuggcaaugaaucauuccauaccuguuccauuaacaguugagggauguaaaaaugauuauuuaaaugguaaaagggagggcagcccuaaauuugaauuugaaaugugaugucuuuuacuaggccuucaucucuacccccuccucccugaacuugaacuacaauuaggaccuguguauaaucccuuugcagccugucuuacaguuagagguaacuuagguauagaacacaacuguauguguuggugucagguguacuaguggugaguuuuguguggaaauaguguugcaaaugguaacuagaggaaauguaagugauguggcaggguccuguguaucugucucuguuucuuuuaagauuugggaagaggaaugugggaguauguuuuuguccauaaaagaaacaugaagagacauaggaaaaauaauaaaaaagaagaguaauacaucgaaaugaaaauuuuccagaccacauuagugugcauacaugagcugcacagagcugcuuaagauuagaauacugcccuucacaucaccuugaccuuccugccgcaggcuguccaugcacagugacuacucuugguaggagauucuuaaugaggucaggaggaguccaggaucagcaaacggaaucuuugaacucuugaauuuagcuguuuucuaaauacuuggauuuaauugaggaccuauuuuaauguuccacauacaaaauaucaaauaacuucaaauaacuaaguuaauauaauagauuuuagacuggccuugacuuuaaaaucaguuucauguuaacauacccugcugucuuauuaggacuuguaaaagggagaagaacuuuuaaauuuucauauguuuuagcuguuauagaauaauaugauuacuuguagggguuuccuuuagaugauaauaaauaguuauguaugauuucuuuuucuuuuuaacuguuuuucaaguagaauaaauaauuauauaagugaaaacaucgaguguaccugaauaacagaaaauucaagugcauuuuaguugccucauugcugaauucaaacugcaggacuuaggaauuaaucgcuuaugaaaacaaaaggagcuugaacucauauugaacuuuuggcagguuuagacaugacuguuuuagagauucaugaacauuuaaacaaugauuuuguuuuaauuugaagugaaaagcuaacuaagacaaagagauauauucaaggcucaugugaaguugaagagcaaacuguuuuccuaccucacuuuuuaagcauacaauuuuagaaacuauuaauuagcagcacuauuaauuaaauguuugaaaauauuauuuuuccugguuuaaugugacagaaaaccccacaaaaacucaaguuaacuuugugaauaaaaaaaugcaggacuuaaagagagaucuacuucagagccagcagucccgccagaagaggcugagccacacacugagcccgaggagcagguuccuguggaggcagguaagcuuguccucauccucgagucucgcccaggugugccagagccugacagguauccgcauuuacagaaucacguuuuaccuggaauuuguuucacaucauuuacagaauaauuaacuacuuuuuuucucuucugaaauuauguaguauuuuucuaguagaaauuggaacaggauaauuuuaauuuuuaagaucagcucuaaggcagacaguuguucuuuguccaaaaccacacauuuaggaacgucaugaacugaauguuguuucuugauuccaauuccagcacuacuguacuauauuaccuugaaaguaaaaauacacacaauucuacacuacuaguguuaucauuugucacgugauuuaauagaguagaucuagugguuucucagucuuuuuuacaugagggucucguuuauuuuaaaagacuucccaaaccucccugugggcaucuauggagccuguuuuguguccacauggguucauaaaucaagcaucucuguaguuaccccaaagccuaugacuauagguaggaaagucgugaaauauuuuaauaaguuaguaaaucuaauacagucucuaaaucucugguuuucuuaugccaccuauugaaaguuuaaggaaugacacuacauauuuacugaaaacuuaaguacugaauccaaaugguacuuuggcugauuuuuucacugugugcugaggaauaauauuugauuuuuuuuccuuuaaggccaauauguugcucugaguuuuguuauuuguugaauuuuuaauccuaggacaauguauucucucucauuccuguagaauugcuaugaucauaccauagcuccagaauagauaguaacuuuuaaaaaguuuuauaauuuaauguguguuuggauuuagcaccucaaauuuuacuuuguacuaaaauaaaaccccucuugacccccacauuucuuuuuucugccaucuaaucccucuccccucuacaacagccacgauuuugaaagaagaauccacuauuacuuuuuuaccuuauuuuucauucauuuuuuuuaacccauuacacuccagcuucugcaucuuccaauccccuccagaggagagaaggaguauuugcaaaauuauggaaaguugaaauggcauggaguccucacuaaguucaaagccagugcugguagcagaugauucuggagaagugugugaggacucaguuguggagguauuauauucugcuccuaggaacugagacuuucaccaguuugggcaaagauagccauuaaagagugagcagagugcaccacccuccacuucuaguaacucagauuauauucucuuuggauggugauuucagcaguuaugaaccugggaauccaguuaggaagcuaucuuaggcuuugugagagaggauggcgauuggcagacucuauaauagcacaagacuacauauauaaauggcuugugaaauauaaacauuuauuaaaaauaggcauuuuuaugcuuuggaaaugauuuuguagugugauuagcauaguagauauuacauuuaaacucuuuuccuuccugaagucuaaauuaacuuucuauuuuuugucauggaagauuagcucuuugacaacaaccgaugucacuggcauuaucucacaugacagcauuuaugauaccaaguguagugcuacuucuauucacugaacauagauuauauuuauuagagaacuuaguaucaauguaguuauagcuucuuguucauugugugauguugcaguuaagucuaauaaucugauaagcaccacaguguuuuuggaaugucaucauuuauguucacuuuuguaauucaauuuauuugaauuuauggaucucagugucagaugugguucuccaaagcugaaaggauugucaguuacaauguaagguuuucuacugacacuuccugacaaaccugagugagagcagucggcuaccucugaguauucaguccucucaccugcaggagugcccuuucuccucucagggaagauagguaaugguugaccagauacuucaaucuguauugaccuugucuuccacauuucugucuuuauuuccaacuauuucccuuuaugaaagcuuuguucuucccacuuuauuuuaucauuauugcgaauuuuauuaauuagaaacaagucauuuugcuuuuaauaaggcucuuuuuuaaauacaaaucugagccugaguuuucuuuaaaaaucuuauugaaaguauuuuaaugcuuaagucuguugacagaauaaaacaaauuuuacauaucuaccauguuugccaacacagaacaaaaaaauguaagcugauagagaaggcaugcagaguugcuuagucaaauauauucauuuuaauguguauguaccaaugucauauuugaguguuagggguccauguugauguuugagcuuuucuacuuagcuauguuuugcaauuauuuuagaaccccagaauaucgaagaugaagcaaaagaacaaauucagucccuucuccaugaaaugguacacgcagaacaugguaugaauuaaaaucugcucuuuguuuugaguuacuaaaauaacgcuuaguuauguaaaaugacuuggacauuuguuuuaaaauuuaaagguuaauuggguguuuguguuuuuuaaaaaguuuuugaauucaaaguuagauagcagguguuguuuuugaaauagcacuaaacuuacuuuauucuacuucaccguggaggaacucacugcauacaucuaagagagaacuggugggaauaaaugagaaugaacagauugaaaacagugauccaucaggaacagaaggggaggauggagaggaggaaagugggacacaggcccacggucggguucauccagguguugugcuccaccucgauuuugcuucaugguuggcuggucaccacaacaaaaaugaugacacuuuuaauuacauagguugcacuaagcagacaggaaaaaaaacgugagaaugcaaaacauuuucccaguacuuaaauuuaaaaauuuuucauggggagcucuguguagaggauacuaaguaauaacccaggaacuaacguuuuaagguuuuauaaggcugcuucuugaagcaucccuugauaaaaacagagaucgugaucccaaaacguaucucaugaagggauuguggagugggcaggauguucuggaauccugauucuccugaugcuuuggugugauccaaggguggccuaaaggaaaauaaaauuacguuucuuaaaaacaaacaaugcccuguaguuuaaacuguuuuuugccaguggaugcuagggguguaggagccuguaugccuuuauuucuagcuucuuugcagcucggaaagccacucaugggccuauaugagcaagugcaggcuuccccuuccucaagccuuccuuccccacggcaccccaacuuuaacuuaacagaaggaaaauccaaucuaaauaaauaagugauuuaaauauaaugggguaagugcugucaugguaauaaaauaugggaagcucuucaggucuuacucagaaggggggucagaagaggcugguguagaccuucaccaggccagugcugguggugaguguuuuaagcagaaggcauaucccagagacaggaaaggaccugaaaguaguucagaauggcuggcacguggaauauguagguggagagucaugagaaaaaggauauuuuuuacuugauucuaagaguaacugaagccauuggggaagguauuuaggaguguugugccuucugucuguagcaugaaaaaugcauggggggaugcaagagugcagcugggagauuagauggagguugugcagguaacagugauucaggaugguagcaaacuugccucagccaaaggaggggauggagagaaauagaaagaacccuaagauguuuaggugguggggggugggcaggcagccaaaagagggaaguagucaagucuagcaccguguucuggccacagccuccuucuuggacuuguucuuuucuuuaaucacauuuagaaaaucacauuuauggcccaugguuauaaauauucuuuguauguugauaacuuuuaaauauauagcugcagcccucauugcucaucuaaacuccagguuuaccuaacugcauacuuggcaucuccauuuggaugucuuauggguguuucagacuuaaagaacucaugauucuucccacaccccauagcuccuccucaccccaguucuccccagauugcuuaugcuagucuuuuauauuuuaguuaaugguccuccuacccucuuacuugcuuaacuugaaaacucgagaguuuucuuugauuuuucuucuccccucacaucuaauccaucagcaaauccugucagcauugccccagcacugauuuuggcucucuagggccucggugugaccguggcuucuugccaugacuguugcaguagcacaguagcauccagcugggucucccuguuuccauacuugcuccucuauaaccugugcuuaauguggcccagccaguugugccuugucugaucccagccucuuuuuccccuucagugacuuuucucuagcccagcugaccucucuuuuccuuguaauugccaagccuaucacugcuuuagcaccccugcaccugguauaucuuuugcugagauguguuucccaccccgcccaaucacaucuuucagacugagcauaaccucccugcccccaucauggugcauucacaacuggauucagguccuguaucugccauugauuagccauguggcuuuagcacaguuuuucaaguucuucaucuuucaaaguaggauaccaguaccugcuucacagggaggauauaacagcugcagagggcuuggccaugccuagagucucaugaccccuuaggaaauuuuucaugaugagacucaaagauaguguucaauguuagacugguuucgcuacagaaaacaggaauacuuccacugaacaaccgcauacgaaagcuaaauccugcuaguguaaaaaucaucagauuucacuggauagaaugaaagaagaauaaggaaagaggaauaugauaaaaauaaaaagagaaguaaaauuuguagcagaaauucaaauuggugauuugcugaauagcagaaaaucuaaaaugaggaaaaacaguauugcaagcuaugaggagaagauagaaaacaaauagcaucaacauaaauaggccugccugauucucuaacaccugagagcauugccuugccacgcuaaagggagaguaacuaaggaaggcuucuugcagucugggcugggguugugggguagggggauucaguagcaguacaaaugacaauguuguuauuacuguaauaauggugauaaugacaccuaaauacuuagggccaggcauuuuucuaaguguuuuaaucuucauaacaauguuacaaauagauauuauucccauuuuaugggagggaaaucuguggcacaggguaguuaaguaauuugcccacagucacccagcugguauggaagagccugaaucuacagccaugcauccggaccccauacucguccuaaucccugagcugcacugcaaagccaaguccugcccauucacuuucuuuagaguauuauacacaggagauacucugcuggaagccaggucaaguuacauugggaugcaauacccagucuuaaccauguugcaguggaaucaugcaacauguccaaccucuacacaaaagaagcagagcaguucaauauaucauagaaguuaaucacagaagagaaagugggcaucuuugcauaacuugaagccuaauaggaacauuugaaugcauaguaugauucagguaaaccugugaccuagcauauaauuuauuuuuauuuauuuuuaauuuaauuuaauuuauuuauuuauuuauuuugagacagagucucacugugucacccaggcuggagugcaguggcaccaucuuggcuaacugcaacuucugccccccagguucaagcgauucuccugccucagccucccaaguagcugggacuacaggcacgugccaccaugcaugacuaauuuuuguauuuuuaguagagaugggguuuuaccauguuggccaggcuggucuugaacuccugaccucaagugaucugccugccucagccucccaaagugcugggauuauaggcgugagcugccaugccuggcccuagcauauaauuuagauagguggcuagucacucuuugcuauagaauauuugaauagucauuuaaaguuguuaccuggaauucuaugucaauucccaggaaaaggccauagaguagccuuuucuuugaccugaggauaauugaagaggcaaauauauuaguaauaauuaugaauucauuuauucauucaucaaauauuuauugagugcuuccuuuagcuagacauggcccuaggugacugggaauauauaauggauaaaauauauaagcuuccuguccugauguguaacauccuaaugagaggaaaccugucccccaccacauauacuuaggcagauuagcacuuggccagaggaagaaaauagcuguggaguggacaauggugucuucagcggccgaaaggaggggcaggggaagccccagcagcaggagcagguguguggcagcccuucacaaggggcuuucaugucucaguuguauguugccagugucacuuuguucauugucauaguugagggagaagacuugcaacaagaagauggacccacaggagaaccacaacaagaggaugaugaguuucuuauggcgacugauguagaugauagauuugagacccuggaaccugaaguaucucaugaagguagaacacuuuuuuuucaaguuuuaggauaaaauauaaucaaugacuucuaauuacugaaguuuuucuuaaaccccuuuaaaacugauauuuaacuuuugcuuagauuuuuaaaaguugaagcuuaaagcuucaauuaaagcaaauuuuuucuuaaaauagauaccuugauuuugguucaaagcacuuuucagggaaacucagaauauacaaauuucuuauaaauagugagucaaauacuugaggaaacuaguuuuacuauauucuucugcuuagggugcuauuuguuaaauaaaauucaaacaacugaugaaauauuggacuugauaaucuaucacaggcucauguucacacaugaacucuguaauuacagugagcaaaacacaauucuuagcuucuguaccaggcauuggcaaacuuuuuuuuguaaauagccagagaguaaauauuucagguuuucuggaucguacagacucuguucagcuacucaacucugccaucacagcguaaaagcagccuuugauaguuccuaagugggucaguguagcuguguuuuuauacaacuuauuuguaaaauccuacccaacauggcugguaagugcagcggcuugaacacagcucacuccagccuugaccucccaugcucaagcaguccucucaccucagccucucaaguagcuggaaccacaggcauaugcuaccaugcccugccaauuuuuaaauuuuuuauaguggcaaggucuccuuauguugcccaagcuggucucaaacuccuggccucaagcaauucuccugccucagcuuuccaaaguguugggauugcaggcaugagccauuguguguccaguuagcaaacacuuuuuaaaagcauaaaaaugaaaaguaguuuaucuacuuugcacaauacuaaauauuuuggaaaauuacuuuagcagcagguagcuccuacuuuaugaguacauguauuuccaaaaacuuauauccaugccuauuguuuagaacaggaaaugcacuuucccauaaaaauaugggaugguuugguuuucaaaagaauuguauauaaugcauaauuuucugugaaaaauacaagcacacaauccuuuugaacaucuauaugauuuauuuuugcugcauuacacauugaaaauaagcacuuauagacuaccuucagaacuuuaugccuuuaguaaucauuuaugucaugauuucuuugggacaagguuuccaguuucugaguagggauacugauaaaaugauuuccacauuuccuguugcuucuucucuccagucuuuggccuaaauggcucaguaagauugacaguugcucagaauuuuucuaucuacaugcugcuuauacaacaaauuucaguuaagaugcugaaauaaacagaagcaugaggaauuugauauucuuaaaguuaggagucacagauugggaguaggaagaaacacuuuuaagaaguucacaaauugcagaaaccuuacuuucugaucucaucuuuaauuaggacauagaugcaguuugaacuuaaaaguugguuguuaaaagucuucagaaaauaaaaauauuuauucuuuauauaugcauuaaauaaaauuagcaaggucauaaguguggugacggacagauagcucuucugcuaucugggguguauggguuaaguguucaacacauuuacccuucagcucccuaaggguauaaagccucuucagcuguuuuucucuguucccauccauaguugcuguacuuucgcucuagaaaaugguaggacaggucgaggagauagcacauucuaguggguugugaaguggauuagaaaugaacggcuuuccuggucuggccugugucacucuaaguuguccucucucuuuaguccaggggguggugguugucagccuuguggggaugaguggacugagaaggagaaugugugagacaucccacaguguacuucuagugaaauauaaaaguguuaagcagacuuuuaauugauagucccauuuuuuaauuuuuuaaauaaaauuaaugauaagcauagauucagaguacauauacgggauauauacauaccauuuuguaaaagcaguaaauaucaaucuaauuuuuuuuuuuccagaaaccgagcauaguuaccacguggaagagacaggugagauuuuaauuuaauucuguucuuaauuagagugagucuuccuuuaaaagggcaucauaaaauacauaauaucuauuauuaaugauauauuuaaauuaauauaugcaagauaugcaauuaauaauuuuauuacgucuuauauuuaugguauuucuuugugaauauacuuuuuuguguuuugaugccuaguuccugaggauaaauuuucaguaggauuacuaguucaaaagauacaauugaauugcauguuuuguaccuuucaauuacagagucaacgaaaggucuaaaucauguuuugucacaugccagcgcccuuaaagggcauggccacaggaggugggcgcaucaucugucagcacuuuacuguuuugcgguuugaguguaaaccaguugaugacaggccccccuuacucaucuuugcauuuggcauuuaacacacuuaauaccuauuuguuucaggagugaacauguuugaauaucauuaugacuugauuuugcauuucaaucauaacuagaaauugugucuuucugguuucgaauauuacauguauuccuuauuugagacguaauuuccuaauuauuccauaauuuauaguuucacaagacuguaaucaggauauggaagagaugaugucugagcaggaaaauccagguuuguaaauguuaaaauuauugauauguguuuucugauugaggcaguggccaaggccguuuuauuccaggguuaacaauugugauucaacacagagaucccuguaugguauuuauaaucacuuuugauuggucagauguuuauagaaaugucugaauauaguuuaauacuacauagagggaugagagaaaaaggagacguauuuuucaaaccacuguugagacuuuggucuuuguagguaaggugcuggaaagaauauuugaaaauugaaggggcaguaugauguacuauaaagucauucuggguacaaaucccauuucuacucuuuccuaucuuuuugacuuaggcaucaaauuguggaacguuauucagcuuaaauuuuauuaaaugauaaugaaaacaucuaucuggcaaaguugugaagauaauuaauuuaugaaucuccuagaaugcugucuggcaauguguuugguuuuuuccuguuuggcaaagguguguuuuuguuuuuuagauuccagugaaccaguaguagaagaugaaagauugcaccaugauacagguauuagaugagcauuuucauuagauuuaaaauauuaccuuagauuuuucaaucacaugcuguguuuacauggugauuuuucuuuuaaaggcaucaaagaaguaauuucgacaucuaaugcaugagauuuuguuuuauaacaaaguuagacuguuauaagaauaucaggcuuucauauuucaccucaucaacuaaccauuccauaacaaaacaggaugucaaauuuuaaugcuguuuuuguguaucaaauuccucugugccaauuugagaaauuuuaaugaaaauaauuuaccugccuuuuaauugcuuuugggcagaggcauuuauuauugacugagcagacauuaauauuugaaggaguagaguucuguguuuacgauuaaguaguauuuuguuuuaacugaacaauuguauagaaugacucaguuaauacuuauuuugcuuuuauucucuuuuuuuuuucagaugauguaacauaccaagucuaugaggaacaagguuugcaaaugcuuucuuuuuuuuuuuuuucuuuuuuuuuuugagauggaguuucgcucuuguugcccaggcugcagugcaguggcacaaucuuggcccacuacaaccuccgccuccuggguacaagcgauucucuugccucagccuccugaguagcugggauuacaggcaugugccaccacgcuuagcuaauuuuguauuuuuaguauuuuaggguuuaucucaaacucccgaucucaggugauccucccgccuuggccucccaaagugcuaggacuacaggcaugagccacugcgcccggccugcaaaugcuuucuaaccuuaagccaccuucuuguuuuaaaauauaccuauaguuugacuacaagauguggaacauuaugcuuuaaacuauaaacuuugcaacuuaaaacauccagaugaacgguagcguucaaagaauucacuuggggagacuguuuacccauuccacggcuucugccauugccuaaauaauuucuuaaacucuuuacaaguugccuuaggaggcaguuacagucauucaagaaaaccaaucucaguacuuuauaguugugucucuuuugacuaaaauaugcaugaacaacuacuuuagccggaguuaaauugcucuagcugcuucuacagguuaaucccacucucaaagaugacugauuugucaccuuggggaagguuaagaagcacuguguuccaggcuuaaaggcaguauggagaaaacaguucuggcaaauuuguggcaucagcagcaucugauucaguuuaggccuguaccucccuccucuuguguccaagcauugcauagacuauuguguugaacuccaugaaguagauuuuauuuucccugcuucccagaggacagaaauaagguucugacauuauaaauaagcugcccaagaauguauggcuaagaaguaauagaaccaauaauauauccuuuuuauuccauuauccucaaagaugauuauguagaaagagagaagucaguuggguauaacuuuauguguaaagcaagaacgaugaagaaauacaucguaauugaguugguggauauggaggacuuucuauguucuagaugguuuuagggccuggaauucaauuaugaguaacauagggucccuccuuucaaggaguuuacagugucaugauagauagugaaucacaauugaagaaaauuaggaguguuuauaaauaugaaucauauuuauaugaugauuuaagauuugagacccuaccaaguucaucaucuauaguggcuauuucuaaugggauaugaaugacaccaugggaaaaauccuagguugugucuuuaagguacugauaauuuuuaugaaaaguuaaagaauuuggaccugauguguucacaggaagauuuggggccgagggaagguuggggaauaauuuggucuugagauugcacuuagauuuucuuuccaaucuugaauuugaaggagaaaauaggaauuuauaaauacaaguugcauguaaugaugggauuugagauauuuuccucauuucuacugaucauuauaauguuuuuaaaaauauaaagaacauguuuggaaugcaauuugaagacuaaaucuagaggaauuuaaauucaaacucauaagaaguauaaaauuagauaccaugcgaaaagaauguuauauguuuucauagggcagaguaucauaauaaauguaauuuaaaauguuagcaaaaggcaguaaauauaaccuaagagauugacaugauuugguaagcuacuuuggauuucuuuguuauauagaacauaaacuguuucaaacaaauagaucuaauugaacaguguauuauucacuauaugcuaaaacaauaccuuugugaaaauucaggaaucagagcagagaaaccaaguaacugacauguaagugaagcuguaaguagggugaaaacaaaaccacauuucaaugggagaauagaauauauucuguaugaaacuugcaaaccccagaacauacacuucgauagaacuauaguaggaaccagcuucuacaucaaagauaaccuagaaaucaucaugccuacauuggacaaaccugggaagugacaguauggccuuaccauguaauugacuuauuuauucauacacuguuuagugucuucggucugaaacacaggacacuggagcaguucuagugaagaacacccaugguuccuguucucauggaucuuauauuuuaguaggguaguagaaauuaaacaagcaauuucacuguaguuuucauuuccaguugugauaagugcuaggaagaacaaguacagugguaacaagaauauguaaucaagagaccuuaccuaguuuguggaugaggcagggccuuccugaaguuugagcugaaggugagaacaauugacaaggcaaggagaaaggugacuggagagucguaugaggucucugacgugaacuugcaagaguaaggcugagguggugaaaugggcuggguucagaggaugccugugagcaagaucaaggacguucaucuucaccuuugagcacugccaagucagaucugcauuuugaaaagauugaucggucuggcaugcaacaaacagacuggagagacaagagucaauacagggagaacaguuaaguuagcuguaaucauccaaauugggucuuuccgugcaucacaucucucucugucugaaggaaccaaaggagaugaguuucaagaaagggauguucaguggugcccugcgcuacugagaaccaugugagaugagugcugaaaaccugcccugaucuggcgcugcaguggccucaacgggugacuuuagcuggaacuguuucaguggacggauaggacagauaugauaguuuaaaccaagggugguggcaaugauggaggagggaagugggcaaaguugagaaaugcuuagaagguaaaauuggcaggucuucaugcauggguguagcuggggggagacaacaaggugccaagagccacauacacucuucugcuucugcagccuggugacagggggugcucuuuuccuaacgugggagagacuggagucaagcacggggcaggggcucaugaguccaguucuuuacaugaugauagugagauuucuuugaggcaucugagaggagagaucaaaugagccauuuggugguguuugacucucagaagagaagucuacuucgugauugugagugugggaaccaucagaguaguuacguggucaucaggaccaagcucugagaucccuuaaggagagcagauugagggagacaugaggugguucuauggcuggacuuugaagaaagccagcauuuaaggacggcuaagaaaaagaugaagugaaaaagaagauugagugggagaaacgaaaaaccaaaggggagaguauggucacccugaaguccaggggcaacaguguuuggagaagaaugguguugcuaaaaauauagcgagggcuggcgaguguccaucauaucaaaugaggcacuggagggggucucagcaggagccuuuucagggauggggucagggucugaagacaggcgggagugaguugaggggagaggaagagaugagccaugagauguaaaugacugaagaaauuagauuguucaauggaagaaagagagggugacgagaagcaagcuuaagaaagagugguauugcauuuuuaaguucuuagaagcuugagcauguuuaaaugcugacacugcucagggcaacagagugagcacacauucacugcuccuucaucuuucaaaugccccaaaaggacaaaacgaccuauuaaacauuguucccugcuguaccccaauacugagagugucugaaagauaguaggugcucaauaauuuuucuuuauuaaaugaauaagaaagaauaaacuuacaaccaugcugggaaaaagaaggauguuuucuuguagugugccagaaaauuggagguauuuuggaagaucagguugacugaggaagcuuugagccacugggcccuggagaggccuguguggagaugagacuuccuugcagcagagcagagaagaagcacugagccucaugccagcaaaugagggaggcaagggcagcacgcccuaauuaggguggggaacgcuucauucucaggggcuggcggcagagguguuuggccccagguuagaggucugagaauuguuuccuaaacaaagcagggaaucugcccaugaacaccaggauccaguugauucccaggguacagcuucggcuaauucaaaaccuccaccacagacaugaagaaaauuuuaaaaagguaguaaaauuuuaaaaagguaguaaaaaguggcugcccuggaauuagaauccaggccuguuuuacccuagaccaaacucuucuccacccuacucucuagucggcuguuucccagugacugaaccuugcagguucaaagaugcauaaggcauugucucugcccuuaaagcauguugucaguuuuuguguuacaaugaaaguuacgggauuuuguuucuguuuuuuuuuuuuuagcaguauaugaaccucuagaaaaugaagggauagaaaucacagguaaguuuuuucuguaagcacauauuuucugcaagucagcuuucccuguauuuuguuaaaacuccuaccuguggaacaaagagucaguguagaaaaaaugcaagacauuuucaagucaguaagaaaauaauugaguaucaaaauuaaaguuaauauucuaauauaaauacucugcagaagacccaguuuaaaaagagucaaauuuagcaaucugaguggacacgaguuaauuuaggaaucugaaugaaggcgagugaauguaagaugugucacuggucagcaacauguaauggauucugauuuuauucuuuauuuuagaaguaacugcucccccugaggauaauccuguagaagauucacagguaauuguagaagguaagauaaauuuauggaagugguuuuaccuuccauaugagaauuguguuuguuuauucaguuauuuaucgaacauuuccuacuugcugucuauacagugcauaggagcuaggaguacaagagggaagaaaacacagaguccucuuuucauuggggcuggcauuccaguggccaaacagauaauaaauaacggaauuaaggauuaugagaaguacaaugauagugauaaaaacaggcuacuguaacagcaaacaauugaugaggguguggagggcuacccugaguagcagcagguuaccaccccugaggggugaucuggugagaagggcauagcuaugggcagagacggguugaaagaugggucuuuaugucaugacucaccugggaaaacaaaacaaauuuuuuuuuuuuuggugguggagaacugaagggaugguuucugaaaaacaaaaauaauugcauguauuaaacaguggcgcuucaauagaacuuagauuuaaauacaguucuuaguuagcauuuuacaguuauuucacauauauuauuucaguugcuccucguaguaggcacugagaaacagggagcguggagaucuuuguacuuauuuugcaaaugaagaccugaagcuggagugaggucaggugacuggcuagcccuagguuucauagcuguaagugaccaaggggauauucgacccaagacugggaccugugggugacucugcgugggggugugaaggugugagggaauggggucucugcuuuaacaaccauaaguugccagggggagcauguaagagggagaauuuugcucuuacaauuacucuuaaaauuuaggagcagcuaauugucaccuuucagauuaaauguuacugcuuuugagcuugguuaggcagaaaggaaaauggaauggugcaguugacugaaauggggggagauagguauaagggaaucggggaggcuaaaauugcugucuguguccgcuuagcugcugcgagagaccccuguacaggcacucugggcccuuguguaaaggcaggauccaucucuguguggcaaggcugaauugaguugagauuuuuucccaccuuguguuacucaguucucuaugagggauauuaauguucugaagaauauuacugagucuauauguuuauuuggugagaaucagaagauggaaacccauaaucucugggcagaacuuucuccaaccuacccuacauacgguuuauagaaaagaacuaugcaauuugacccuaccuuucuugguuuagaaauaguuuuuuccuaagacuuuucaguauuuugauauguugacagaggacauagcagaggcugcuaagggaguuuccuguccugggcagugaggcaccuggcuaugcaccugccacccauccugcagcuucugugcugggcuccuguagugccugaguggacagugaggggagcuuaucucucacagcaaccaaccuuguuuucccugucuccucuucucuuggccgguuguaucaauauauacuuggauucccagaccagaaacauggaacucguuuuugaguccucucucccucugucucuauagcuaaucccaagaccuguuaauagacucccuaaacauuucuuaaauccauuuuuuucuccauagcucuuguauagccccuugucuggcucagcccuuucucaucuuccuagauaauagcaguagucugcuagcuagacaucuugauucuguucuuguccccuccaaacccaucuuucacauacuguuaggaugaucuguccaaaaguauagcucucauuguaucagcccuguguuuaaacccuucuguuauucuccaucugugucaguaaaguuacuuucaguugcagauaauagaaaacgaaacucaaacuggcuuaagcaauaaagagauagguacagaucagucagggccuugcaaggccuacuaaggcuuuuuggauuauauucuaggcacagugugaauuaugaaaauucuuaagauauagcauaaucugauuuuuguuuuagaugugaaagugaauuacuuucacuagauugaauggagcaagaacggaagcagagcgaaacacccuguuaggaaaauauuguguacuaauccaaggaagugauugugguagccugaaauaagaucauggcagugggaauggaggggaaaguguugaacucgagauauauuuuagaauuaaaauuaauugaccuuccugaugguugugaagcaaagaugaggaauaaagggggucuuuuauuugguuucaguaacuauuagaugauggggccauuuauagagaagaaaacuauuauuagaauguauuagguuggugcaaaaguaauagcaaaacccacaauuacuuuugcaccaaccuuauagaagaaacugguuuaggagagaaaauaaaacgccccagaucagacauuuuaacucugggaguuaugugauauauccaagugaaaguaucaagugggggguugaauaugccaaccugagcuaguugggugaguuuuaagaugaauauaaacauuugggagccauugucguagagaugguauuaaauccauggaaacugaugugaucauuuuggaagcaaguggagagacgauaaagaggcaugcccaggacugagcucuaagaaucuaauauugugagguuggguggaaggugaacagccauugugugaggaggaaagccaguggagaaguagagaagggaaaaugugaauauguuucauguuguuguugaguggcccaggaauuucaggacugagaaguuaucaguugcauuuggccacguagagauugugagugaucuuaccaaaagccauuugaguaaauuaggggaagagaaagccauacagaaugaaguggguucaaaaagaccuggaguaaggaaaaguaggcuauaaaauagguaacccagauugugcugauagaauuaauucacgguuuacuuuuuagaaaucauguuauuacaucauauaccagaagaaauuucauaugaguuuguugaauguauauuuuuuguaauaaauuuagaugaaaauuuaacuugcaauaauaauaaggcuuucuuaguauaacaucaguguuggaaauaacaaaagcagcaacuaauacuuuaugauguacaauauuuugagcguagaauaacaaaaguaaaagaaauucugagaaaaauauuggcaaaguugauaaaguguuaauaugucuccaaauaauuaagaacaaaauaaacaggcaaaccuauuaaaagccagucacaacauagcuauucaauagucacuguacugcuguuauaagaagaaaauauugccagauacuaacagugguuagugggaaugggugugauuuuuguugcuguuuucaauuacuuuuaugugaaauauuuccaaauauucuguuuugagcaugugucauuuuuuauaauuagaagcaaauuaaugcaagaagaaaaauuauuaaaauagcuccauaaguguuuucuguuuuagaaaauacuguuaaaaaaaucuuucuuuuggccaaagauuguuaacaauucuuaaggaccaaaaggaauguugauauaaucuuaucucuagguuaagguaauguuaaauggguugcuagguuugaagauauuaauaugugauguaauuucauggagcaaaucagaucacuaugucuuuaaaucacuggguggggacaucuaccaucucuuuaauuguaacuggguugaagcaaccaaggaaaaagacaggauauuaaacauucacauccauaucuuugacuagucucagaauauauuaucuggaauauuaguuuucuaaaacaacuucaugaaggauaguguuugauguuaaagaagaaauaagauacuuuaagugucuuuccacagcucucuuaucaaaucugaugcaaaauuguggugaaagcauaaguuuuaguccauagcuccuuugcugggcaguggaguuugagguuagucgggcagguacuauaaaaccugcugugcugaaccguugagaaauacacaacauuuugcuaaguuguagcugaucauucuuuguugugaggguauagaagccuaauguuuuuauuaaaauuucaauugaauuguuuaaaaaaucuaugaaaaguaucaucauuacuuaaaucuggcaacgcauauuuuaaacacugaucagcaauauguaacagauuauaacuuuauuauuuauuuuagaaguaagcauuuuuccuguggaagaacagcaggaaguaccaccagguaugacauuuuguauguuguauuuuccucuuuuguuauccuuaaaaauccuguuaauauuaccaauagcuuuauaaugaaucuacgaaggauaaaaauuuugagagagauuaacuguaccuuaauuuagaauuuuucuguuuugaucaguucaaccaaaguaauggaaaaugcacaucagauucagugcaguacauaucugcugagcuagaauuugaggagcauuaaugaucauaugauuuugccauuauagauggugguaguaguggaaguuagaguuuuuuuguuuuccucuuugauugacaggcuauuugauggagaauauggaaucagaauugccuugggaugaaaguugaauaguguauaaauugugacauuacuccucuuccucuccauuccccaucucuccugagagcaucuuuagugcuuugugacaguccaggcugcccagugcuugucagugucccaggguguuuccuuuuaguucacugcauuacauacuuuucccuguuuuuuccuacuuuccucuaccugagcccucuugucaccaguuaauauaaagaaugguaacagcauuuccaccaaagccuaugcuuucaaaugcauuuuagagauggcauaaacuauaccugcaaccagaagugaguuuauaaaccucguacucucauagugggaaagaauguucuaucaaacaggauuuggaaaauccuaccucuuucccaaguguauuucuucucauuucugcauuuuauuuuugugucauauuuauuuguucaaccuuuacuuauauuuucuacauuuuaacaugaauuuuguagcagugaugugcauuccuauuacugauuuugguagaacuaauugugccugccaaaauuuauuaaauacuaaauuucaauuuucuuucuuuaaugauaaaaaaggauaaaauaaucaaagaauauauuuaguuauaugugggaugccuuagguuuugauaguuguccugccauguacauuaauaauaauuaucugcagaaacaaauauuugauuaagagaauggaauuguugguauuauaauaugaaugagaaaagcaguccauggagaaauugaccuuuuacaugaugacuacuaggcaguguguauuuguguuuaaaauacuuggacagggcaagggcagcugauauuuauguccuucugcugguuuccuuuucauuuuugaauacugcuucacagaguacccuguuuguaucaaagaggcaggaccaguuacagaauuagcauuuugaugacuauuccaugacuuaacagaaaauuauuuuauauuccuaaaaauaauguuuguacaaauuaauauauuucuaguuauaguucauauuuuaaaauacugaucuaauuuuugugaagauaugaaagauaauauuuuucagaccaaaaauuucuauacuuuuaacauuuuauaacugaacccaauaguuuauuuggaauguaaauaugaaacaccaaguuucugaggugauggaauaaggugcuuuuuuagauuuuuaagaaccaaagcacauacaaaugaagaucugauuaauaugcauaguucccgaccuauaauaagcucccaguaaguuuuggcuaugacuauuguuuaguaauuaauuagccugaucuuagagguagaucaagaucuaccucugugauggaugugagggccaucuggcugugacaucugucaccccauugaucaucaggguugauucaacugaucuggcuggccaggcagguguccccuucaucccucuccacuccaugugcaucccucccaaagcugcaugcucaguugacgagcaugaccguccccgauacaggaggaccagucuucagucaaggguauaugaguagcaccccugcuggaaccuccaaacaagaucaagagaagcuacauucugaaagaccucauggagaaguuguaaccuguaacuugguaccauaaaaauuugaaugauccacugcauuguuguaguuugacccugccagaagaggauguaaggcugagagucagcaauacagucaugugucacuuaaugacaaggcuacagacugagagugugucguuaggugacuuuguccacguaugaacaucauagaguagccuacuacacaucuaggcuauaugguacagcauauugcuuauagacuacaaaccuguacagcauguuacuguacugaauaccauaggcaguuauaaugcaaugguauauauuuguguaugaaaacauaccuaaacguagacaaaguaugguaaaaauaugguauagaaaauuaaauaaaaagauauaccuguauagggcacuucaugaguagagcuuacagcacuggaauuugcucugagugaaucagcaagugaguggugagugaaugugaaagccuaggacauuacuguacccuacuguagauuuuauaaacacuguacacuugggcuacaguaaauuuauuaaaauuuuucuuuaauaauuaaccuugguuuacuguaauuuuuuuaaauuuguaaaccuaauuuuuaaaaacuuuuugaugauuuuguaauaaaaauuaguuuaaaacacaaacauaucauauagccauacaaaaauguucuuauauccuuauuuuauaagcauuuuuauuuucaauuuuuuuaacuuuuuaaacuuuuuuguaaaaaacuaagacacagacagacauauuagcuuaggccugcaggaucaucaauaucacugucuuccaccgccacaucuugucccauugaaaggucuucauguguaauaacaggcauagaguugucaucuccuaugauaacaaugacuucuggauaccuccugaaggaccugccugaggcuguuuuacaguaaacuuuuuuuuaacaaguaagaauauagucuaaaagaaccguaaaaguauaggagaguaaaaccauuaacaguccuuuauuaucauugucauauauuauguauugugcauaauuguaugugguuugcuuuaauacagcuggcagugcaguagauuuguuuacaccagcaucaccacacacaugaguaauguguugugcugggacguuaugaaagcuaagaugcaucuagacaauaggaauuuucauuaucaaaugggaccaccaucauauauuugaucuauccaaaacauugcuacaugacacauggccguauuuuuaaccauugcacuugguuuucuuauuuucuauaagucuuaagucuuacucuuaguccuaccacauguuacaauuuuuuuauuauucacuugugcaaucuucauaaaucuguauuugugguauuuuugcacagucuaauuuugcaucugauuguaggaacacuaauuauagggccuaccuccuugccauuuuucaaucuuuaaaauucuuuuauucaguggaagacucaaauugaggacuucugcaaagugcugaauauuaguucacuuuuucuuuucccuuggaaccuaauugacgauugauuugccuucucugauuauccuaauacuaaguuauacagucuuaauauagcuuauuaaaguucauaauaauguaacuaucaaugugcuaaucccaaguggcauuaucaccauugccuccaucuaaaguagggaacagugaauuucauguuuauuaagcauuauguaggcgcucugcuaagcacguucuguggauugaccuuuaauaguucuaagaccccaagagguagauaugccauuaccuccauuuuacagaugagaacacugaggcacagcaaggccaaguaaccuuccccaggucacagagcugacaagugguagaaaucggauugauccuugcauucuggcuccagaguccacacugucagcugccguuuuucaaaggauuuuaaauaaaugaagacgugacagcugagagauuugagagcaguuuuggugugguaaaaucagauguguuauauauucuucagcaucuuucucuuaaucugcauuaguucaucacauaggccucaggaaugucaaagguugaguuaugauguauaguagaaaaguaaguuguccaguaguuugcauucugccuucuuucuugcauauuuauaaauuuguaagugcugugcacguggauucuuggcaagcauguggaagcuuaagcuuaagauuugauuuuucugauauuauaggccaaucacuuuggauauuagauuuuuaagauugauuuuggaauuucucauccauuagcagguuuucaccuuucuccuuaaacucauaguuuuccuugaaaucauacagcauauuuguagcaaucugacagcauaaauauacacaacacaaauggaacgacuuaugaaggaauuacuugugaaagcucauuggaguaaaauuuccucucaaacaauacuuuaggucauaugacugagucuauuaacuauuuuucuguuauacccugccagaaaagaauuuuaaaaguuaguuuauguuuuguguaaccauguucuucagaaugcagguaugugagcaucaugguuucuggguaauucugcugcuccugucuuugaaaauggagauaccacuugcagcuuaucccacugcugaguauuccagcauugguagugguuucacuccauugcauccauccagaacuuucacacaggccuccccauuacccagcauuuuuuaacauugaucaauaaggccuauaaccagauuuaggcuagcaacaccagaggucugggggcaaggguggaaauugacuuuacauucuuaguagcuaauauuccauaagugcuuuauauauauauuguuguuauugaucaucuauucaaaaaauauauauugagcagcugcugugguauaggcucugugcuggccagugaagauacaugauugacaauguugugcuugcuugguucacaguccuguggguacaugguggaguaaaauaaguacaauuaauuucucagagcugugcacagcaacacacagaaggagagauaacucacccagcuucagaggggugggacagagaaugagguuagccucccagauguccuugugcuaguuuuagcuguuuucagguguugauaaaagcuccaggagcuggcaggaggagagcagaggaagcuagagcuuacaaagcacaaaggccaugacagcaugccagacgggugaaagaggacaggggaaauguaggcaagugucucuucucagaggauguuauauacuauguuuaaaaguguugaucugcugggcacagugguucacgcauguagugucagcacuuuggggugccaaggugggaggauugcuugagcucaggaguuugagaccagccugggcaacauagugagaccccaucucuuaaaaaaaaaaaaaaaaaaaaaaaaaaagccgggcuuggugucacgugccuguaguccuagcuacucagaaggcugagguggaagaauuccuugaguccaggaggucaaagcugcaguaggcuaugaucgcaccacugcacucuagccugugugacagauugagacccugucucaaaaaauaaaaguuuggaucuuugccuaaaaaugacaagaagucacugaaaaaauccaagcagaggagucauaugaucuaaucucaauuugagaaguuaguccagcaaggagguagagacuaguaagaagcagcuaccguaggcuaagccaaaaauggugggagcuuggcugcaguagaaugaauggaaaggugccugauuucauggaaacuggagcuggaaauaauuugaugggggagggagaggaguccacguuccuacauuucuggcuugaguccuugugaaugaauggcagaauguuaauggagauagagaaggcaggaagaaauggagaguagcagaagagaugacgguccugguuuuggagaugugggauuugcaccauaaccacuucugaauggggucuucagacauuuauuggaauuguucaaaauuguaguagaacuuuuaguuuauuugccuuuuuauaaauacucauuguuauacuuugaacaacuuuccauuuucccaggguacuucugaaauguaucuuccucucaaaucaaaguccagaaaauuguugaaugccaagagaaucuaaaacucauuuaaauaaacuuuuucuauugggguauaauuuauacauguggaaaugcucaaauguugaauuuuuccaugcauauauacucguacccguuacucagaucaagauaaaacgacguaaagcuuuuaacaccccagaaaugucucccucuuccuaccucugagucauaccccaaccagagguaaccacucuugugaacuggaucaucguagauuaguuuugucugcucuugaauuuaagauccauaaacacacacauuuguuuuugcaacuuguuucuguucuacaucuugucugugguuucauccaccuuguuaaguguagucauuugcucuuauucauaacuauuuccuacaguuuuuaaucacuguuaauggacacaaugaguuuuuuucccucaauuguugacuaugaagaaagcugcuaugaauauuuuuguaaugucuuuuuggggaaauagaagcauucauuuauguuggguauguaaagguauauauagaaugucuaguuguucccaaacaauuccacuuacauaaaaaguuuugguugcacauguguagauagauagauagaaauucuuaggaaaguaggaaggaagaaaggaaauauugggauccagcuuuaaaaauuauaucaagauuuugcagggccuuucugugcaccaccuccuuuucuaguuuaauuguaacacaaauccaauucugugauaguaaaacaaaucagauacuaaaguuaagaaugaaaaaaaaaauuguaaaaaguuggauaggaaugaauuuuacuucuuuuaaaauacuuauauacuuuuauugucaaccauuuauguuauuuuaauuuucaaagcaauauauuuuaauuuuuaauuuuuuaaaauuuauuuuaauuuaaaauuuauuuuaauuuuuaaagcaauauauuuuaaaugcagcuuauaguguccaguugauccuugaaacugcuucuuguauuuauuuuucaaauaccauacuagauuucuguuucuuuuuaauagagugaaaauauugaagaaagaaauuuaaugcuguguuucuuaaaagauugagauuauucaguucaguuuuaauucucaagugcucgaaagaaccugagauuuucaucagcagcuuugcaagccauccccaggggcuucuuucgguaguugauuauucuguuaccaaguuguccuuaaaaacaaacaccaaaaaaaaaaaauuacuuuguugguggguuuuuuaaaaaguagaaugaaaaugaagcaguuucacagucugugucugguugguccuuuaauuuagauuuccccuuauuuuugcagauacuuaaagcuucaaaaagacugccccuaccaccacaggaggaccagccuaaccauacgcuccaaaagauggcugugauagaucuugugaagcaauuacugagcagaucaagaucuuugggaaggaacacuaaagauguuuugaaugaauuauaguccacuggcauuuuaguguauuuuuuuuucuuuuuagaaacacacauuucuaaaaaugucauguuacauuccugcaugucccuuuugauagcauuaguggauccauuggauuucuuuuuucuuuuugugagacagcuuuuagucuuaccugaauuuauguguguuuuuccgacagugguuaauaauuauauuggugauguagcagcaauuguguuggcaggguuuucauauauuauuaguaauuaacacuaacuguuggacugacuuguguacacuguguuaaacaugauuuaaaagcuauuaagaguacuuuguguuagcacucuuaaaaacgcuaacagagaucaucauuagcugugaagauuugaguuguauauaccugcacugauauucuuaucaaaaauuucuacauuagcuuuaaguguucagauuaacacuuuugaaauuuuuguagcuuuuagcugauuaauuagaaaaauuuaauauuucagugaaaguuuuaaauuaucauuuauuuauuuuuuuaaaugagaggggaaagcugaaauuccuuguuaagacacaaggaaaaagaauggcccuacuauuaucaugcaaaaaugcuuuguuggcaccucagauuaaucauauaauagcuauagucucuucagcauuuguuuaaauuuuagaaaaccuguauaaauuacuggugcauaacuuaaagauuauucugccuuuggcuaauugaguaauuccccuccagcacuagagaccgcucagugcucuuacuagaugaacucaguaacgccuugagcuggguugauugaggaugugugaaaagcucacagagcccgaugccugcugcuauuucacggcaaugagccuuuuucuuucuacacugaagauuuucuucuuauuuaaugugguuuauuuugggcucagaaauaauugcucuguugaaaauaauccuuugucagaaaagaagguagcuaccacaucauuuugaaaggaccaugagcaacuauaagcaaagccauaagaagugguuugaucgauauauuagggguagcucuugauuuuguuaacauuaagauaaggugacuuuuucccccugcuuuuaggauuaaaaucaaagauacuucuauauuuuuaucacuauagaucauaguuauuauacaauguagugaguccugcauggguacucgauguguaaugaaaccugaaauaauaagauaauaagaaaagcaauaauuuucuaaagcugugcugucggugauacagagaugauacucaaauuauaauaaaacucuucauuuugugaauuauagaagcuacuuuuuauaaagccauauuuuuuuagggaaacuaaggagugacauagaacugaugaaugaguaaaaguaaguuuugcuggauuuuuguagaacucuggacguugaggauucauuaugcugugguuaacuuuaaauauuuuugaauuccaaauaucugaauuaaugagccuugucuuuacaaauaugugccauugugcaacaucgguggauuuucuaaaaauaauguaaaugucuucuauuaaauguugagugcaauaaaauacagaagaauucucuauauugucauuauuuuugaaguauaagguauuuuuaauuuguuacauaauaaaaucaguucauuuuauccuuacuaguauuuuagaagauuauagcauuuuugauaacuaaaaucacaaaggaauaccuucagccaguuaacguauuucuaacagauaaugcuuauuuugcauuuacuaucaugcuacauugccaggaagcaagauuaaaauuaaauagccccugcagccauccuuuguagauuuuguccugcaccuagaaguuuugauuauucccuggacagccugcuccaccuuuuuuccccaaauuuuuaauuuuugugaguauauaauagauguauaaauuugacuauaugagauauuucgauacagauauagaaaauguacaauaaauuauuguuggcuauaguaacucuguuuugcuaucaaauacuagaucuuauucauuguauauaacuauauuuuuguacccauuaaccaucuucaccuccugcuccccucuccccucacuacccuucccaaccucugguaaccauccuucuacccucuaccucugugaguucaauuguuuuaauuuuuagcacccacaaauuagugagaacaugugauguuuaucuuucugugccuggcuuauuucaccuaacauaaugaccuccaguuccauccauguuguuucaaauggcaggaucuuauucuuuuuuauggcugaguaguacuccauuauauauguaccacauuuucuucauucgucuguugacagacccuuaaguugauuccaaagcuuagcuauuguaaauagugcaauaaacaugagagugcguaaauuucuucaauauacuaauuucuuuucuuuuggauauauaccuagcagugggauugcuaagagaaaacaauggggaaauuguccaggacuuuggucuaggcaaugauuucuugaguaauaccccaaaagcacaggcaaccaaagcaaaaauggaaaaaugggaucacauuaaguuacaaagcuucuguacagcaaaggaaacaacaaaguaaagugauaacccacagaauacaucaaaauauuugcaaacuacccaucugucaagggauuaauaaugagaauauauaaggagcucagacaacuucauagggaaaaaucuaauaaccugauuuuuaaaaugggcaagagaucugaauucucaaaagaagacauaaaaauggcaaaacagguauacgaaaaggugcucaacauccuugaucaucagaaaugcaaaucaaaacuaccuugagauaucucaccugaguuaaaaugacuuuuaucaaaagacagcaguaaugaaugcuggugagcauguggagaaagaggaacccucaugcacuguuagugggaguguaaauuaguacaaccacuaggagguuccucaaaagacugaaaauagaacuacugccccaccuuauauaucacuuuuuaaugggaggauauuaauuucaucgugaguggauggaagggcagaaauggauauggaaaguucucuuuuccauuuccagucuucauucucuggacagaaaaggagaacuaaauaaggaagaagccccugggguucuagaacagguuguuuuuagccccagcauguccagaagaaacaaaaauaaacacuaaugguaagcagacccacuuuuauugaaugcacccacucugcggaguacugugugcacaugucagggagcugaguuuucucagcagauaaguauuacuucugccugcaagugagcaaagccaaggucagagagguggggugccugcuggcccgaggugacacaccaguauccagagcaacucuccggcagcuggugcaagguggaagccauuggagggaggccaaagagcaggcaggaagaugguuaggcaacuaacuaguaauaggugauggugauacagcaugagcuaaggaagugcuaguagagaaggagacuggaaagcugugacgugaggacuggucagucugggugcuuagggagagagcagucucauguccuggugcagggaaagaacagaugccagugugguaaugcacucagagggaugaacaggccuggguggaaauucacuuugaauguaccuugaguccagcaagaacugcucagcuggcagauuagcgcaguggcuggaacacgaguacaguauaucuguuuuuuguuuguuuauuuuugagacggagucucagagucucgcccugucaccagacuggagugcaguggugcaaucucggcucacuauaagcucugccucccggauucaagcgauucuccugccucagccuaccgaguagcugggacuacaggcacgugccaccacgcccagcuaauuuuuguauuuuuaguagagacaggguuucaccauguuggccaggauggucucgaucucuugaccuugugaucugcccgccucggccucccaaacugcugggauuacaggcaugagccacugugccuggcugaguacaguauaucugaauccaccaaagcgauuugcuuuagugguugcaugacaauauuuaaagaucaauaucccauucuuuuuaguaagguguuuauuguucugacaaaauauuuaaaggagaaaaaacguuaagacagguaaagaguaguguaacaucuuuuuuuucugaauacgaauauuuaaagacuaaauaugaguuacaugugagcuuguacuuuuguaauuuucagggaugggcugagcauauagcucccuuuaguuaaugaauuccccauuacugggauauagagugugauuaaaguaguauuuuauggaauauagucucugaaauugguuuuguuuguuuuguaauccuacacaagauucuuuagccucucuaugccucaguugccuuauuuguaaaauuauaacuaccuccuaugaaugaugagaaguuuaaaugggauagucuguguuaagugcuuagaacaaugccuguauauaauacgugcucaagucauuuuccucuuuggcacagugagguucauaugaggucucccagagaagcauagguacagagaauaaagcaaaguaucacuucauuauuaucuuugcagagugcuagugggguaagcugaaucucacagaaagcuccuuuaccuaagcuaaauuuaagcaauaaaacuuguagagccuaaaacguauucucuguguauuuucuuuucuuuucuuuucuuuucuuuuuuuuuuuuugcucaaguugcaguaauuuauguauaacaauauaaaacuaaugcaaaguauuacuauuaucucuguguauuuucuccauauccgaaaugagucucagaacucagcuucuugaugugaggugaaggacagaagaggacaagaaugagaauaagagagcuuuuggccuggggccuggaaugaucugguccaggcuuuaggucagacugccaacccccuuuuagauacagcaugggaaguugaagaaagaugguggcccuuguuucugggcauauguccaaccacacucacccuccacguuccugggaggacgugagucuaaaggacaugaggagacccggccagggcccucccacaucgggaucagcaccuuccacuucuauauggaaugugaccaguucaaaccacuccuccuuccuuauuucccucccaagagugggaagaucuguggagagcccuaaacuccccuucaugaccagcacccaccuguucuaucuaguccaguuagaaacuugcauuuuacgcuugauuuuucuaaucacauuagccuuaugcaaugacugggggauguggaggguugcaguguuccugcagguacugcugaucccacuaggaagagcuccuucaggacuggaauuuuuuaugcuuuucuucauugcuguaucuccgaugacuacaaaugugccagacauuaguaggugcucaguuaauauuugcugaaugaaugguauugaauagucuaguucagcuaccuaacuuuauaauaaggaggcuauaguuaaagagaucggaaauucuagaacauucuaccaagaccuacauguccuuaaaaaaaaaaaaaaguccugcauuauucuugcagcacugcgcaggagguaugugcuguaaacccuauaaaaucaaucaacucuuugcaaaagucaagacuggcacuucucuuugaagaaagguacacagugguucaguggaaaaaaaguaugcuuuggaauuauguaaacugcuggccuugauagcuuuggggacucuaauuucucagccaucuauuuucuccuaugcacaaagagggagguaagaccuucuccacagggugugagaagacaagagaauucauaaaugaugugcuuagcacuuagccuggcacgcuagauuucaaaguuaguuuuccuuucuuccucuuauguagagucucaaaggagcaagaacacuugacuuauaaaaaucccuucccugcauuaaaaccagccucagauuuacuuuucaucuccccaaauugaaauguuuuauaugaaugaaugugggaaacuccagaccaacaaauugagugaucugugucaauguucacuugaccgcaucccugaucucaccgacauccucuugcagcuucugugggagaggacagagucugguuuuuuaucaaucucccagacucugccuuguucccucuccaaccuaugugcauacgaccguauuccuagaaauacacaaagaacagauaaguuccuacuagggcuguaaucaagugauugccgugaaaauuaacuagauccuaauuuaccuuacacaguaguccugauguggaguuacaggugcagaaaugagguuaaaaacacauggucagcucauaugcuguuguuuuccaugugagggguggauguucucuggcuagucuaggcuguuggugggugucacuguccuagguaauucuauuugugggagagacacugacugugauuuacuuagugcaucugacacagguggggucuuggguucaucucuggcuucucaucugggcuucagcacaagcucccccaauggaucaucuguguauaugugaaguccuuagaguagcagacuaauauuccaagcagugugacaugcugcauuccuuuaaagcacaugaugucaauuguucaaguaguuuucugguuuuaagagacaauaacaauauugaacaagcuuuaaugauggcuucuccccauccacaugucuuuguaccuuagagacacuuggaguugauguacaucacccacuccaacucucuuaucuuauagacaaggaguacuuagccuggugccuagucagugcuuggugacuuuuaguauaaguaauugaaauaugcccaaaucuugaucuuuucuaaugaacuucauguguaaugaauucaggauuuaggaaaauugaauuguaugcucagauauauuuuucuuugauuauacuuauugaauucauuuaaauauuguccuauauuuugagauacugaauggugacuugcauaguacuuacuauguuuugucuuuaauuuucagaaacaaauagaaaaacagaugauccagaacaaaaagcaaaaggugagauugucaaauaaacagccuuuaaaauauacauggggaaaagaauaacaugauuuuauguuccauccaagaauaacaugauuuuaugucacuaauuaaaagaauuugcuccuggguuuguuauuucaaugauuuaucaaagaacacuuauuaauauuuuacauaaacauuaagagccaaagcacagaaagagguugcccagcuucuaauucuaguuuugacauuugcacucuugcguccuugggaaaaauacuuaacuuuugugccucaguuuucucuucuguaacguaggaauaauaagaguaccaacuucugaaggcuguguuuccaugauaguaauaaaaugaaaauauacguaaagugcuuaaagcaauagcuaacauagaaagcacuuaggauauauuaaauaucauuuauuguugauaugucaacaacuguacuagguauaggaauccaaagauuccuagaacaugauaucuuuuucaaggaacucugaauuguuggaaagauauacaaacaaaguuacagcuaugcagaaagaauuauuucugccugccaaaaguuuauuacaaaguuuauuacaaagaguuaaaaaauuauauggaugaucauagaauaguggcuauuuuuaguaucaguugaaugauaugaucuuuaauaauugaauauuauuacaauuucaggaaugcuuuuaauuuaauuuguagugaugaaagcaguaucuacauauguaucuuguacauaacgugcauaagaucuuacuuagugugcaaaugauacuuggugagcauguggaauugcuggccucuggcuguaauuucacagcccacaaguugagaaguaggccuuuaauucaugaaaacuuuucuaacuaguuguuuuuaauuuuugucaaaguaguacaaggauauaguuuaaaaaguugagguuuauaaugaauagcagcaguccucuucccuacuacuucauauccccaagucucacuccuaacuuucuuuuagcuguuucuuucuuucuuucuuucuuuuuuuuuuuuuuuuuugagauggcgucucacuaugucacccaggcuggagugcaguggcaugaucucggcucacugcaaccuccuccucccugguucaagcaauucuccugccucagccucccgaguagcugggauuacagacacaugccaccacgccaacuaauuuuuguauuuuuuaaguagagacaggguuucaccauguuggccaggcuggucucaaacuccuggccuuguuguaauccucccaccucggccucccaaagugcugagguuacaggcaugaaccaccgugccuggccuuagcuguuucuuucuaguacuuaguuaugcauuucuaaauaauuuguauaaugcugcaguuuucuccuuaauaucagaaaccguuggcugacucuguuuuauagaucggugagauuagcucgaucaucauacucucacaagcucuccgcugccuuacuuccuggaucuuccgauauauuuaggacauaacuauaaauaagauagcgauaccugcuaaugagaaaacacaaggcaagaaggggcaaaucagcagcuuuugauagaguugaucacuuccuguccuucaaacacucccuucacauggcuugcuggauacauucucuuggucuuucuccugcucucuacuguuugcuuuucucaggcucuuuggauggauguuucucaucuccuugaccauuaaucaccggagugccccagacuuaguccucggagcauuuccccauauacacgcacucucuuaaugaucucaucuaaucucauggcuuuaaaugccucuguaugccacagauugccaaauuuacucacagccugggucuuuugccugcacucuagacugguguguccagcugucuacauguugucugccugauaacuucaauguguuggauguguaauaaucacuucaaacuuaacaagucuaaaaccgacuccugaucuuucccccucaaaacacacuucauccccuuaaaauuagugugccaacuacaugccaggaauuguucuagacaagugguugcaggugagagcaagacagaccagguuccuguuucagggaacucacaucccaguagggagaccagcaguacacacacagacugaaauugugguaagaguucugaggaaacaaagcaggagagcaugccguaggcagaagggguggugaauuagggaagaaggugucccaggagguuagggaaaccuaagcacucugagcagaggaacaguuuguacaaaaguccugagacaagagagaagggcccaagaagcuggagcaccugaacaagccuagaguguguaagauacaguuagagaaagucaaagacuagaccacagugggagucuggacuuuucuucaugcuguggacaccguacccagcccaugcacaucuguguaccaaacagagcccuuucucauuuacacauugacugguuugcuucugggagguucacuauaaugcauucuuacaaagagagggacagggaguccgaauggugggcauggcuuguugcagauaaacagaaacacuugcaaaccugccccaaaucugcugcucacagggcaguugcaauugugagcuccucauaucucugccucucaugcuccagaccucccauucuagucuuagcagcccguaccuuccccugcacugucggguauccucggugcacaggucugaccuccagggaugcugauccuaaaggggguuugccagggaaguguagaggcuggaaccucuggaaccugcaaagaaaaucauugcaacggcuucuguugacugguuugucacucuccccccauuuaaaauuagcacuuuagaucaguaccaaccaaaauauguuuguaacuaaaguauuuuauuaagggggaaaugcaggaauagacagaauuaaaagaaauaaugaaucaaugucaucacagauuuauuaaaaaucuauuggagcaaauugugagcuguggaaauuccauguauuuuuuauucaaaucgauucauaugauacuguuaucugguaaggaaaagggaaagggaaacauuauguaaacauuacauauccagaauauguaguaaaaaaauggaauggccuucacucaucagacuuuaguuucauaauaacagaaacugaaauuuuuuuaaggcaaaauaggcccucauuugcagacaucuguuacuugagucaaaucagauuauuuuuauguuuuagauaaaauugcgauaucaguuucuccccacuggaugucaucuuuucccacauauuccauagcccauggucacaaaaugugugaacuacaaaauaauccaauacaaaaauggcuuguuaaaugucaaauucaaacagucauucguguucauccauuuauugaguacauagugaguacuuaugauguccaggcucuguuuuaggcacugggcccaaaacagucaauaaaacaguugcagcucucauuguacuugcuuuuuaguguguauaggggagagaguggggcuggauauguaguuuuaaaaaauuaaaauauaagaggcagugugaagugugaaaaggaauauaagacaggaaaggaaaacagaaugagcaggagguguugcuguguaauaggccucuuggauggugacauuuaagcagagauuugaagaggcaagggcaggaguugcaccggcgucugggagaagaguuccgagacuuggggagcauucucaugguccucagggcaugugugcuuagcauguuugaggccuaacaaggaggcgauugcugguaaagaagguaugaggggagagugcaggagugcaugagaccagaguggucaaggguucaaaucacauaggcuuucgaagacaaaaguaagaacuuguguauuaccuccagugagauggccauugggagauucugggcagaagauggauaugauugcauuauauuuucaaaggcucauucuggccauaggggugcaagacuggaagcagggaaaccaauuaggagacuauugcagugguccaggcaagacaugaugaugaccaggauuacgauguagaguagaaguggugagugcugguuagauucuacauauauuuggauauaaaguuaguaggguuugauaauggguggaauaauggagugagagaggucaaauauggaucuauggccaggcacaguggcuaaugccuauaaucucagcacuuuggaaggccaaggggaggaucacuugaggccaagaguuugaggccagccugggccacauagugagaugcugucucaacaaacaacaacaacaacaacaacaacaaaaacccaacacguagccaggcaugguagcaugcgccuguagucccagcuacucgggagucugagguaggaggaucgaugcugcagugaacuaugaucaugccacugcacuccagucugggcaacagagcaagauccugacucaagggaaaagaauucacucuaaccuuuaaaagcuguacuuugacaaauucacugaacacaaaaaugugcaauauguucuugauuuaguauauuaucaaaggucaguuaucaguugggauuugugagccuuuaaagaaauuugaagagcaaaggaaauguguuuuuucuuguguguaucuaugugugcacguggguggguggguguuagauaaaacuguauuuguauuguggacuuuuccuaaaauuuuuuauuuagacuuauacuuaauaucuuauuaaauuauucauuacaauuaagaauauguuuaaacaguauuuacaugucuuuaaaacacuuaaagauuuccuggguacuauuuguauuuuuuuuuaaagucauaaucagggcccuaacaaaacaccagauggcgcuagaaaacaaaucacauuuacacuaacagaaaucacaucugcaaagcaacuuaaagaaagguggagauggcuguauuacagccaguaaaucagcuuggugcaacuaguacuucauauggauaguucuuaguuuucugugaucauaaagaaaauagaacagacguagcuaauaaucaagugucauucaguuuucuuauuuaaaaaaucuucagugaaguuuuccuugugauucuuauaacuguauauaacauauuugaacaaaguucucuauugcuuugaugauaaaaaaauaaacuucuuagugcagcacaugacgcaucucaggauauagccccugcuuauggccucccuguguucaaaaugcucuuccuaaucgcuccacuucccuuuuaucacucccauuucuuaaaacugagcuuagauguucugucuuucaggaagccuucucugacugcacucccaucuccuaccccagaccagaaaguguguuucucuuuuuguucccaagaugccuugugcuuacagauuuuuuauuagcacauauuuugaauuuuccuuuuaauuucuagacaaaaagcuuauuaagaguaggaaccaugaccaacccuuauccccuuauauuaaucagaguuuacagaguucuccagagaaacaaaaccaacaggaugguguauguguauagauauagaaauagauagagauuuauuuuaaggaauuggcuuacgugauuguagaggcuggccaguccaaaauccgcagagcagaguuaauguugcagcuugagucuggaggcagaauuacuuuuccuuggaaggagauaagacuuuuucuuaaggccuucaucugauuggaucaggacuacucauauuauggagaguaaucugcuuuacucaaagucuacugauuuaaauguuaaucucaccaaaaauaccuucucagcaacauccagacauguucaaccaaauaucuggguaccauggcuuagccaaguagacaaauauaauuaaccaucacacuauucuaguggugcuuaaccauagauagugggugcugaauaaauaguuguaguaugaaaaaaaugugacuaacccccuucccuuucauucuugccccuucaucugauagugauauuauaagaugcauauagccugaauggugggcaggaagaauuauaaacagaaaagucaaacuaugaauuaacuuuaagugucuacaaauauacuugcuacauuucaaguuauuuucagauggguucuuguuuaagccuuacccaucaaucuuaugaguuaagcauuuuucagcuaccauuucuucauuuuuuaaaucuucuuucucacuccccuacuucugugccuauaauuaaauguauauuggauugcuugaaaaugucccacaggucuaugaaacuuuguuuauuuuuagucugggcaugauggcucaugccuguuauuccagcaauuugggaggccgagguggguggauuaccugaggucacgaguucaagaccagccuggccaacauggugaaaccccuucucuacuaaaaauacaaaaauuagccaggugguggugugugccuguaaucccagcuacuugggaggcugaggugggaggaucacuugagcuccaaaggcagagguugccaugagcugaaaucacaccacugcccucaagccugggugacagagcaagacuuuggcucaaaaaaaaaaaaaaaaacuuuguucauuucuuaaucauuuuuucccauuggauugcaugcuuuauauuauuauaucuucaaguccagugauucuuucuucugccauuucaaaucuguguugagcucaucuaguaaaguuuucauuuuagcuacuguucuuuccaacucuagaucucgaacugcuucuuuuuuguaguuuccauuucacuauuaagauuccaugucuguuuacucauuaauacuauguuuuucuuuaauucuuuguacuuauuuaugaucaacaauuugaaguauuuuucuaauaaacccaauauuugggcacaauggcaggcagcugcaguuggcuccuuuuuuuuuuuuuccugagacugggucaggugauuccuauuuuuuuugcauaucuaguaguuuuugguugaaaacuggauuguguauguaauuuguuauaucaacuuuggaauuuguuuuggucuuucugaggacuguuggugugugguagacaguuaacuuggcuggacucaaauugaaaaaucugacucuccaacaguguaaagcagcuaauaucucugcucaggauuuuuggcuuuuaauugcuguguuuaaagucuggucagaaaggguggcggugucuugugccuucagaguuuacuuguuugccaaagauuugaguagaauucauacucagauuuugagacuugcuucuggaauuuccccuugcuucugggauucacuaucuaaauuucaguugccuggccaaccccaaguucugcccucuuacaccucaagccaguagaacuuuuaucuccucuauugggaaaugcacucaagcaaaacauaacgacuuguacuuucaucagaagcugcucuuuccggagguagauuuuuauaguagucagccucgaaggcagccuccagugauucuugccuccuggcauucaugccucuguguaguucucugucuauugaauaaagcugaccuguguggccgaaagaauauugcagaaaugacagagugugacuuccaaggcuaacucauaaaaaauguugcaguuuuuaccauaaucccuuuuaaucgcucacucuggaggaaacgagcuccugcauuaugagaguauacaagaagcuguguccauauagcaaaaaacuugggaaauacaauaaauguuuauggcuguugcaaggugcugaaguuggggaugauuuguuuuugaagucauuauagcuaauccaucgcccucaaauuucugcuagcuuuuucaccaggcucccuggggcuacccaugaagguggcaacuaagucagccagggaugcuuuggcuugugagcuugggaaguaugaagugugguccuuuccuuuaaaaauuuauucauucaucuuauugagaugagaacuguagugccuggcugcaaagacaccaugaaguugcaaucauucagucucugaggguccauuccauugaugcacaugggcuugaucaagccaucaccgccuugaacuuaauuacugcaugguuagccuaguuagaucugucuuugucuuuuugcugcccacuggagaugcuuuagccuugucuuuagcaguccugaaacacuagguauuccucauugacaacagccugccuagauguugcagcacaggcuggugguucaguuccagcuaaccacuaugccuaguaauuuuuccauguuguugaagagcaauguagcaauagcauaauaaaccaacucaaggaaaagcuuugaaaaaacagucucccguccacccuugcagcugugaaaagagauuaugagauaacugcucuuaaagauuuauuguagucauuacauucaacagcuacaguaguuuuagugguuccuaaaauacaccagcaguuauugucugauuacuuccacagauaaguuaauuauacaagauuucugacucucauacaagucugauuuagagagaaguuuaauuauggcaauuuuagugauugaaauaagcucagcauauaucaucagucuuagcaaguauaguagagguuuuuagcuguguuaaaauacacauucucuuuguuuuuauuuuucauuucaugauuucuaaccauaguguaguacaugugauaauuuaggacaccuguuuucaccagagugcaucuucagucaaacacaccacaggacaacaauagcaaauucuucauuaucauuaaaaucccauucuaaugcugcccauggagcacuccacauuuuacaaagcuaauuuguauaaugauugugacaaugugagcaggaaaguaaaauacuuuucuuaaggaaaaaaaaaucagguauugguauguuuuaaaaugacuguuaagauuguaauuuuuuuaaugauggaagaugugacacuccuucaaaucaggcaaugcacuucauuguuuaugaacacauugucuauuucuauacugaggcaaauuaaagauuaacuuuaaccacauaugcuuaaauuaacuuaaaauuaagcuuucaaaaaaugugccauaaaaagacagugcugugaguaguugaauauauucauuuauuuaaacaagacuucaaauuggugaguacauuaguuugaaaaaugcuuuacugaaaauuaccuuagucugagcccugcagaccucuuccccauagcacuuuucauucuucuaauauaaugguagguccaguggcauuuggagcaguaguuccugcgauauuuuuauauuuuucacuuaaaaaucaaauauauauugacaauaggaaaauauuaauaauggugaaaauaaaucaaauucuguuuuaauuugagugauuuuauuacauccugccugggaagccagucuaccgccuuuccuuaacacuaugaaugucagucaugccuuuccucuuugcugcaauguucuuucuucuuccucuucauccauugggauccaccccacaguccuuugcugcuaccaugcccggucagcagugacagagaugugggugagcauggaaugaagauuaggcaucucacaggcagugucuggagaccacgcgggaggcagcaggcaaaucugucucagaaauacggagaaaccuagccucauagggauucuggaacagaccacaaguaaagcugccagcagaggauguuugcuaacagaaagcaggauuuccacguggagggguagcauuggauccucaaaguacuggaauagcacagaaagccccgucgcuagcccugccacgucguuaggagcugguccaggaugaagguagcagggcaugagcucagugccaggagagcagccgcacucgugguguaucaccugccauaaugcuuuuaucuaacuuccccuuuccuccucgcccuccaucuagagcaccugaagcuaauguacggauaauuaacugcuauugaaaccagugaugcacccaaacaaaacuagguucuccuuaggcaccacuguauacuguagcauuucccaccccuaccugccugcucgucuaacccagcucugugucacugcuggccaggcacagugagagcaaaggacugcaggauggaucccaguggaugaagaggaagaagaaagugcgguagaaucacaugggggagaguucagacagugcccugggucccacccucaacuauucugauuucaucacucuaggugcaauaauucucauguguagucaugguugagaaguguuaguuaagauacgcugcugaccuagucagucuggucuguguaucaggcccaucuuaacuaaaaauuuuuauugguaucaccugauucagaaaucauuuuuugacaauauuugaauccgauuugaagggguuuuuuaauaaaauauaaagccaacaaaaggaucguuugagaaaagcugaaccuguaguaugaaaaaaaauuuuaaguuuauuaaacagcuauuuuaaagauaaccauaugagccacaaaugguaagcaaaccuagcuguacugaggagcugaggaaaccuugcagugcuuccuucucauggcguggacagaauacugagcuugguaguugaggcagcuguuacugccugaaucuuggcggagacccuuuucaucucaugacccauguucuaucucaucggcagacucucaccucacucagcuccauuccuuuagcaaaccgugcaaauuuuaaucaggacuaaaagacuacuuuuaacaaauucucaguugcccucuauacaugcucaaacuucagauaugaaagaacaagauuuuuaucaaugauauuuucaaaggucuagcuuuuucugaugccgucaguuacuacugcauugaugccagcaagugcuagaagaaaggugagccuuucccagugcugcaaauauguugccugggaaagacagcaacugccucuggccuaggacuggagagacccacuugaccacugucucaagucccccauccuccuuccugcuccugcuguccucauucuccacccugauuucagcagcugagaguagacacuauccucuuugagauuuuugcugcuuaacuauuugaggcaacuaauuaaauccucaucauguauguggggacaugucauuuacugaacaaauauugcuguauaggaugacgauguuugagggaaaacauaacccuaauaauaaauggcagaugcauuccacuucguuuguucacuuucugcaaagggacuuagcugugcuuuguacucagaagguacucagcauuuccugggucauugccauagaccgauucaugggucucucaugccagaaagaauguuguuuuuuuuuuuccuuuaacucuuauuauuaaaguaauaagaaaacauuacugagggcauaacaguacuucuuucaugguuccccuccuaaauuauuuacuacuagauauguuaaccacuuaaggugaauauauagcacuuuauguugcgaauucuaaacucauuucaaauuauaaauacauuuguugaguuggucaugguagaauaagagaacacugauuuuugccuuugaguucauuuuuaaaagucagcguguauggaugaacggaguaggagaaagaauuauauauauuccgacacacuuucauuuacagaggacucauuugcgucuggugaaagccaggcggcuugcaccauguccugggacuucagccauccuuucauguguugacccuucuuaaagaauggaagggggaacugaauaaagaagauaacagcuucuagcuaagaaggaugaugcauuaguuugccaaauauauaggcuccuuuugugugcuaugcucuguggagcgcucugaaagcaaagcaaguaacuacaauguaaagagguagagacuaugaacaaaaugcugugggaacaccaaggaggaaaugacacacugcuggcaggagauggaaagcaacuggagucuucauggagcgaugacauuugagcugguccucaaguagugggugaggauuacauccaugcaagagcccugugaacccagauacugaaguaugucuaaugacaaggaugauaaguugauauggaaaaaaaaucacagguguuucugcucacagcaagcccagcaguacuccaagagcaguacuuaacuugggugucaugggcuaugcucucuauacagaagauuacauuagagucuugucuuaaaaacccuuuuugggaaaauuaucauaauucauuuuuuucuaauauccaaugacuuuuacgcuuuugcuacuuugauucaucaguacguugaugauaccuucuccucuuugucccauuccugcuucaugauaauuuaaugaaauuaaaguaauggauuuaauuagcaccuacaucuaugauuauauguauauauuauuuaucugaaaccuuuggggugggccagcuaccacaauuaaaauaucaacuugauucaaguugugugaagcacacuuuaaacuugaaauaaaagugaauaaaaucuauuuauacagugugaugccuuuaauugauacccuuuauauaaaagccaagguuugauaaaguuguguuucagguaauaaccuugauuuuuaugcuucauugaaauuuggcuccucucccccaaggaucacugacuuccuugugcauuuauaucaucauaguagugauguuauuacuaaugucauucagcuagucauaggguggaaguagcauuaauugcaaauuauagcuucaacauaaaaccaaugaacuugggugagcauuuaauuucugggccuugucacuuugauucauacugcgucuuugccuuuuaacugcugcugugagcauacaugugcauucucugcaguauauuuuuucauggcacuuccagacaguccuaagagucaagcaguauaggacccagcaggguauguguuguugcgccauuaauugcauaccucugcgccuucugaggaaggaggccagaggcagauugucuuucacccccugagaaguaugauaauagcuugacagugcucuuacuggaguauuucucugugauuauuaaauacaagugaagagacuuguuagaaagagagaaaaaugaggaauauuuuaaaauugccuuuuagauuaauaguaucaaacacacuuagugcauugguacuagcgucauggaaauacacaagagguuuccauucuuggucagucugaguuugggguuugaucugguguguuuuuagauuaaaguguguggcuaaaugugaugcuggaggucaaggcucuuaugagcccuguucuuuugucugcuucagcuuuugaguagcuauuauuaucauuuuaucagugagcauuuuccuuauaggcauaugaauuccucuuacuagugugaaaucacuuauuuaauucuagaaaauucuugcaguacaguagaaaggguucuugacuaggaguguuaaucagcuuuaccaauucuuauuugcuauuucaucuugaacaagucuccuggccucucugagcuuuuucucccauguauaaaacauggagauaauucuaccugcacuccugcauuuuucgugcaggucagauggccauuuggcuuugucgcuggugucaugcuauacagauaugagcaacuauuaucauuacuuucccuccagugauuacuuuguauaaaaugcauguuaucccuaaguccaaaugcaauagaagaguaaucugauauugcuuguguauguuccuuuucuaagaggcucuuaaugacugugauaaacuuuauccacaugacauuccaaugucuuuaagugcaagagaaaggugguuauucuucagggauauuuuucuaggaaguguuuauaugugaaaacaaacaucuacaaguugaauaaguuaugagaauauuggaaagcuauuugaggaaugcuuguaguggcaacucauuaaagcguuaaguuaugcuuuccuucuaccuuggguguuacagcuuuauuaacacugaguuugaaaacagcuaacaaaaaaagcuaaaugcuuaagggauuuauuauaaaauucaauagugccauuaauuuccauguaugcuuuaaauugcugggaaaaaguaauguauucagcaaagaagcaaguuccugcuuccuccccugagucugccugauugugcaauuggucucucauucuuuaauuaaacuuguccaaagauaggauccgcuaaaauguuuacuguauaaauaguuuucauucccagugugcaaguuuaaaaccaugguaaaaaguuugucaucuguuaacaaccaaaacauguggugugcuguugcauaaaaauaaacugcacauuauucauaaaagggaucacaacauguaucacaucuuuggggcugacaauaaucugugauguuuuggaaugucaccuccuucuaagugacaguaugcucaguagugcauuauguuaaaaaacaugaucgucuauaauuguaauaaaaauaauucauguauuguuauucaagugaaauugauuuaucugaaugucaguguuacugauaagaaauuauaauuuuuaauuuuuucuuugauauuuucaaaucuaaauuuuccugaguuuuauuuucaagucuuuuuuuccucccuaaaauuuaaccauuuaauuuagccaggaauuuaaccauuucucucucuuucuguacuaccauugccucggcccugugacaucucaggcuuguauaucacauccagggagucuucuugccucuaguuuuugccuuucugcauauauguaccuaccacaagagaaaguucuugaaagacaggauucauaugcucacucauugaagccaucagaaauaccacauugucuguggagcaaagucaaaauuccucagaauuuuguucaaggcaccccauaaucuggcuguaagccaccuguuuagccuuggcccuaacuauccaugucccuguacuuuauagaauuccacaagauuuuucacaaaucccugaacauaccuuuuucacauuuauauguacauacuuucccauuucuuugaaauauuuuucgcugucuaccucauuccaaauuagaucugugccucaagagucaguucuaauguucugucauuccuuaauucuuuccuuguuuuuccaauuagugguaauccuuugcuucuuucuguucccagagcauuuuguaauucuuacuuugcaugaucauuuucagucuuuuauucuagucauuaauuuacuuccccccuaccacuuucuaaugugugaaguacuuggggauagggauugucuuguuuaucuuuguguccccacacuaguuagcauaauaccugugaggcacucaauaaauacgugucaaaaugguuugaaaauggucacacauuguguucuggagaauccaauaagcaaacuaaugcaauggaaaaauuuagacaaacaggucagagcagauugucauauuccacauaggauuuuuuuuucuauguagcaguaguuauggauguccuaaaaugauuuuggcccuuuccuauucaguauuucuuaauggacaagaguggacauuaauagacauuaauaucucacaagauucugcaggaaguucugauuuguuucacacaaaacgaauugcugucuuuggaccuuguuuaggucccauuucaaauuaacaaacucuauaaauuuuuaagacaaucagggaaauguaaacacugauuauucagugaaaguauccaacuaugauauucagaaauuauugugaauuucuuuucucuuuuuuuuuuuuuuuuuuuuuuuuuuugagacaagucucacucugucacccaggcuggagugcaguggugcgaucucggcucacugcaaucuccaccucccaggcucaagcgauucuccugccucagccucccaagcagcugggauuauaggcacugaccaccauaccuggcuaauuuuugcauuuuuaguagaaaugggguuucaccauguuggccagacuggucucgaacuccugaccccaagugaucugcccgccuuugccucccaaagugcugggauuacaggcaugagccaccacgcccagcugugaauuucuuuuuagauaugguaacaguauugugguuauauuuuuauauguuuauuauaacaacuucacugagguauaguuaauauacaauagacuucaccuaaagcauacaguuugauaaguuuugccauguaugaaacuguaaaacccucaccaaaaucaagauaaugaccauauccagugaucccaaguuuccuggugcugcucugugacuucuccuggauguucuuccucugugccccuccccaaccccaggcagccacugauccacuuaaggucccuacgcauuaguuuacauuucccagauucaguggcuggaaccuccaguaaaaugccaagaaguuaugcauggacaucuuugucuuuuucuugaucuugggggcaggagaggguagaauucagucuguuaccguuuaguauuguuagcuuuagauuuuucauagaugcucauucucagauugagaaaguuuccuaugucuacacugcuuaaaguuuuuuuucaggaauugguuuuagauuuagucaaaggcuguucuauugucuaaugaaaugaucauauuuuuuucauuuuuguguauaauauaaauugcacugauuaauucuagauguuaaaacaacuauacauuaauacauuucugagauaaaacucaugaugcauuauuccuuauauaucuuguuggauuugauuugcuaacauuuugauaagaaguuuuuuacaucuguguucaugagggauaccaguuaguaguuuucuuuucauguaguaucuuuuucugauuuugguuucauaauaaugcagaccccacagaaggaguugggaaacaaccccuucucuuuaagaauuuauguaugauuucuuuauuacauauuugauagaauucacuagugaaggugacugggccuaguauuuuguguuuggaaaguuuuuaaccauaagcuuuauuuauuugacugauacaagauauucagguuauuuguuuauucuuaaguaaccuuggguaguuugugucuuucaagaauuguguucauuucaucuaauuuguugaguuaauugacauaacauuguuuauaauauuuauuguuuaauaauuauagaaucuguaaugauaucaccugacucauucaugauguuggcuauuuauguuuauuugugucuucucucuuuuucuugaucggucugguggaguaucaauuuuaguuaacuucucucaaaaucagcuuuauuuuuauuaucuuccucugguauuuucuugcuuucuaaauuaucaauauguaccuugaucuuuauuauuuccuuucuuccacuuauuuuagguuuaauuugcuguuccuuuuugagguuuuuuuuuuuucucucucucucuuuuuuugagauggagucucacucugucacccaggcuggagugcacuggcgcaaucuuggcucacugcaaccuccgccuccuggguucaagcaauucucugcuucagccuccugaguagcugggauuacaggcacccgccaccacgccuggcuaauuuuuguauuuuuaguagagacgagguuucacgauguuggccaggcuggucuugagcuccugaccucgugauccaccugccucagccucccacuuacaaagguguguauuuuacuauuguugcagggagucuagaaaagucauuuaggucaaguugcuucauaccacuguucaaaucuucuauauccuugcugauguucucucugcuuguccuauuaauuacugauggagggcuaccaaagccucugauggaauuguggauuuuucuauucucuuuaaaguucugucagguuuuguuucauggauuuuaaaguucuguaacuaggggaaugaacauuuagauuauuauguucucuuaaugaauugauuuauuuaucguuaugaaauaauccccuuuaucauugagaauauucuuuggucugaaaucugcuuugauauucacacaggcaggcacuucagcucuuuuuuauuguccuuuuuauuagaaugauaugccauuuucuacucauuugcuuuuaacguauuugucuuuauauuugaaguguauuuauugaguuaccacauagcuggcucuuacuuuuuuauccaagcugaaauuguuuggcauuuaauugggaguauuuauauuuaaugugauuauugcuaugauuagauuuagaucuauuaucuugcuguauguuuucuauuuuucauauuucuucuuuguuccaauuuuccucuuuuaccuucuuggcuaaauuuauucuuagguuuuuuuuguagcuauuauaaacaggauuacuuucuugauuucuuuucagcuuguuugcuaugguguauagaaaugcuacugauuuuugcauauugauuuuguauccuguaacuuuacugaauuuguuuaucaagucuaaaaguuuucugguagagucuuuagauuuuuuucuauauaagaucauguuuucugcaaacaggacaauuugacuuccucuuuuccaauuugggugacuuuuauuucuuuuucuugcccuuuugcucuggcuuggaccuccaauacuauguuaaacaagagcagugaaaguaaacaccuuuuucuuauuucaguucuuagaggaaaggcuuucugcuuuucuccacucacugugauguuagcuguggguuugucauacauggccuuuauuauguugagguauauuccuucuaugccuaauuuguucagaaguguguuguauuuuaucaaaugcguuuucugcaacuauugagaugaucauaugguuuuuguccuaucgauguauuuuuuuuuauuuucauauguugaaccauccuugcauucaugggauaaaucacacuugaucauggucuguuauuuuuuagauggguuguuggauucacuuugcuaauauuuuauuagggauuuucguaucaggaauaucaguguguauuuuuuuguuguucuuguugucguuguuguguccuguuuggcuuuaguaucagggcaaugcuguccugguagaaugagcuaggaagaauucccuucucuucaauuuuuuggaauaguuugagaauugguguuaguucuuuaaaaguuuggugaaauucaacaguaaugcuaugugguccuaggcuuuucuuuguugggagauuucugauucagucucauuacuuguuauugaucuguucaggguuucuguuucuuccuaguucaaucuuggugguuguauguguuuaggaauuuauccauuuccucuaggguuuucaauuuguuaguguaugauuguucauaauagucucugaugauccuucguaguucuguggcaucaguuaaaaugucucauuuuuauuucugauuuuauuuauuugggucuucucuccuuuuuuuucuuagucauucuagcuaguauuuuaucaauuuuguuuuucuuuucuuuuuuuuuuuuugacuuuuuuaauauacuuuaaguucuaggguacaugugcacaacgugcagguuuguuacauauguauacaugugccguguugcugugcugcacccauuaacucgucauuuacacuagguauaucuccuaaugcuaucccuccucacucccccgaccccacaacaggccccggugugugauguuccccuuccuguguccaaguguucucauuguucaauucccaucuaugaaugagaacauguguuguuugguuuuuuguccuugaaaaaccaacuuuucauuucauugaacuuuuguaauuuuuuuuuagucccuauuuuguuuaguuuuucucugaucuuuauuguuuguuucuuucuacuaguuuuagguuuggcuuuuucuugaucuucuaguucuuugaggcaugucauuagguuguuuauuugaaaucuuucuacauuuuuguuguagguguuuagugcuuauaaacuuccuucuuagcacuacuguaucucauggguuuugguauguuguguuucuauuuugauugcuucaaguaguuuuuuaaaaauuuccuucuuaauuuuuucauugacucaguggccauucaggagcauguuguuuaauuuucauguauuuguaaaauuuccgaaguuucucuccuuacugcauuuuuaguuuuauuucauuguguucuggaagauaccugauaugauuucaauuuuuuaaaauuugucaagacauguucuguggccuaacauauggucuaccuggagaauguuccaagugcugacaagaagaagaguguguacuccguagcuguuggauaugaugcucuguaaaugucuguuaaguccauuuggucuaaaagugcaguuuaaauccaguguuuauuuuguugguuuucugucuagcugaucuguccaauacucagagugggguguugaacuugccaacuauuauuguauuagagucugucucuuccuuuagagauaauaauauuugcuuuauauaucuggaugcauauauauguggaauuauguccucuugaagaauugaucccuuuaucauuauauaaugaccuucuuuguuucuuuuuuauaguuuuucaugugaaguuuguuuuaucugauaauaaaauagcuacuccugcucacuuuugguuuguauuugccugcauaucuuuuucugucuuucuauuugccugcauaucuuuuucugucuuuuugcuuuuaguuuauauguguuucaggugaaaugaguuucuuguaggcagaauauaguugugguauguguuuuuaucaguuuauccagauuauaucuuuuaaguaagaauuuaauuuguuuauauucaagguuacuauugauaggugaggacuuauuccugucauuuuguuaauuguuuucuuguuuuccuuuuguuguuguuguauauuuuuugcuccuuuaucgucuguuguuuaucaugcaguuugguaguuuucuguacugguaacauuugacucuuguuuucucauuugucugucugcucuacuagugaguuuuauacuuuguuuauacuuugguguguuuucaugguggcagauauuguccuuuuccuuccagauauaggacccucuuaggcauuucuuguagggcuggcuuaguggugauaaauucugucaguuuuugcuuaagaaagacuuuauuccuccuucauuuuugaaggauagcuuugcuggaucugguaucuuagcuggcaauuuuuuuucuuucagcucuuugaaaaugucauuuuauucucuucuggccugaaagauuucugcugagaaauaugcuguuauucuaaugggaauuccauuuuaaauaacuugauucuuuugcuguuuuuauaauuuucucuuugucuuucacuuuugacaguuuuacuguaauguaacuuggagaagaccauuuuguuucaauuuauuuggggaucuuugagcuucucauauuuggaugucuauauuucuugcaagcuuugagaaguuugaaagcuauuauuucauuaaauaaguuuucuuugccucuguucauauccauaaauuaggacauuugguuauuugguugauuuauggugucacauauauuauguaauaaucuuuucuuuucuuuccuuucuuuucuugagacagggucuugccauguugcccacacugaucuugaacuccugagcucaagcgaugcauaugccucagccucccaaagugcugggauuacagacaugagccaccaugccugaccaugccaggccccuucauuguuuuuuuuuuuuuuuuuuuccugacuggauuauuucaagugaucuaucuucugguucugaaauuuuuccuucuauucaaucuagucuauuguugauggugauggucuugauuuuauuuuugauuucacucauugaauucuuuaguucccgguugaguucuuuuaaaugguaucuaucucucuauugaauuuuucuuucagaucauaaauuauuuucuuaauuuuuuugugucauuuaucucuguucucauauaucucacugaguuucuuuaguauuauuauucugauucuuuuucugauauuucauaauuuccuuuucaucagaagcuguugcuggaaaauuauugcguucccuuggaagugucaugucuucuuccuuuuuuugucuucauuuguccuuaccuuugauaucugcacauuugguauaacagucacuucuuccaauuuugugaauuggcuuucauaggaaagacuuuuuugcuguagaaguaucuauaaugcugguuguguagagcacuuugucuuugauucugggcuggcgcaguaguguagucucaguaugauuuccuuggcuguguucagcaucaguggugucugugauuuccucagugguuuagcugugaauuuuaguggaggcuguggugaggcucugcuggggacugggaugccaggugggcugguccuugggcaugcccgucugugggccccuaggcaguguacaugggcacugaugguaguggguccaggagagcagaccuuugggccuucagaaggcuuacuugguuaccagcaguggcugcagugggcaggcagguccucaggcaccuaggcagcaugugugguauuggccauggcaguagcaguagcaggccaacccucaggcucucaagugucaugugcagguaccuagguccccagguaggguguacaagugguugcuugcaguagagguggcaggcuggcugggcccauccucaggccccuggaaggcaugcacaggugccagugguggcagauggggugggucaaucccuaggccccuggaacauguguguaagcauuggugguggcgggccaggugaaccaaucuccagguucccagacaacaugcacagggaguagcaggagugguaccagguaggacacacuuguucucacacugccugacagugcacaugagugcaggcugcauugagggguggggcacggggcaauccuuacacauccagauggcacacuggggcaucagugacagugggggugggugggguggaucuaucuucagauccccagacagcaugcaugggugccugcagugacaggcugagugggccgauucccaggcuuccagaugauaugcuuaggugccaacagcuauggcaguaaaccagguggcccuguuuuuaggccccugaauggcaggugccaguggcagcagguggggcaggcuuauuauugggcuuccugauggugcauccaggccauucuuauuuuuauuucccugugugugacaugucuauucucucugucugcuuuuaugauccuuauuuuaucacugguuugaggaaugugaucccuaucucucagagaucacugaccuuuauuaccugauauacaguuucucacaagccauuguuucauagauaauauggaaauauuuagaaauuuuaccaaguuuacucucaaccuuaguauuugaagauaauguccuccucuuuauuguuauuuuucacuaccucuguuucagaaaggcaauggcuuuguuuuucaauauaucaaauaauagauuuacaucccuguuacugaucuauaaucucauuugucuguaaugagaaaccucccauugaaacauguauuuucucuauuggguaauacaucagaaauaguuugucacuucaucauccugcuauugcucaaguaaacuuaacuauuucuuacuccccagagaccaggaucuucacaguuggguauuuguugaaaguuuguggucauccugucaugccuaccaccucuacuauaaagcaagauuaaucaauuuuguaaugucagguuuucauucuuauagcauauggagaaacucuaaagacacucuugggguuucucucauugugauuuucaaguuguguuuaaagauauccacucuguuuuggugaaaucucagaugauaucuaaaaaauaugaauuccauguaauuuauuucuuaaaaguuauaauagugaaaaccagucaauaucaguucugaacaaacaucggucaaacauagauccugcugacaucuaaacaaucaaaugaaaaauaagauaguucagacauaggauuaaaaauacugaaauuauucauucauauaauauauacaauaguccuuccuuguccauaugggauacuuuccaagaacccuugguggauaccuaaaacuaugaauaguaccaaaccuauauauacuauauuuuuuccuauacauacacacuaugacaaaacuuaaucuauaaauuagucacaguaagagauuaacaacaaucacugauaauaaaauagaaacauuauaacaauauacuguaauaaaaguuauaugaauguggucucccucucaaaauaccuuauuguauuguauucagcuauuuugggacuauuguagaccaucuguaacugacacugugaaaagcaaaaccguggauaaaaggggauuccuguacuaaucuuuacauguagcugagauguugcagagcaaaaucaccuguagcaauuuuuuugguauugggguuugggaacaucuguuuuguuucagguccuucaggagacacugaugcaagcugggcuuagaaauuauuauuucauuugacaucacugggaaaucaguauuucauagaaacaauuauuuaaagaugauguuagauaacuuuaagcaucauuuaagcaaaauuaauaaauucgggugauauuuucuaaagcauuuuaaaaucauuuccccauuuaaaaaauguguugugcaaauaauuuaacauucccuggugacuggagacuauaauucugauuuuaaugaacaucaguuacuguaucaugcagugaugcuuuuggggacuguuaaaguguuuggcaccauuuaugucuacacaguuuaacccauguugcagugcuauuggagcuggguuuauuucagguuuauuucugguuucugacuuucuuacuuucagucugucagcuuguauccgcugcugaguauauaccugcuucaaacaacccucacuccaucuuguuaguuuguuaccuauaauaacuuaagggcuagagaaacagaacaccaagauuauuagaauuuuaucuaaaauaacauuugaggaagguggcuauucucucauggaacgugugcguggggauaaaauucagugucuggcacugcuguuggugaggcugcggacugcuuuggcacugaaggguuuucuguuaugucuagaaaacacaucacuuagcaucucuaaaauuucuaauuuaacauauggggucacaucuguuaaaggauuauuacucuagaaggggagugauguauaauuuauaaaaauaacccuaugggaaggcagccaacuacauguaauaaacuggaauacuugcugucuccauugaaugcucccagcagaaucucacauuaguuuaguagagggagcagaugaaaacaauugcccuuuauauacuauuuacuggguuguauaaguuagcaucucucagugaaaaauauuuguuaacuguuugguuuaagcuuugaauauugaccuccugcugguauauaguugauaauuaauucugaaaaaacagaaguccauuauucuuagcuguaggaggcaagaaagagugugccauccuugguaagagagucuuucaagaguugcccaaauuuacuucuucuucugguaauaccuauagaguagaucguguuagagaaaaaaagccucagaaggggcuauuuuuggaucaaacacauuagcuuuucuuucucacauggugauaauacaaacaaaggcuccugccagaagcaccuccauggcugucugcauauuggguuucucaacagcaaauagcaugucucucaauaugagagcagauuuauuucagaccccagugugaggcaucacaguagggaauaccuugcacaauucccacuuuuaaaugaaagagaaaauaacugagggcgccuacccacaucccccgccuguaggaacacucguagauucagguuugcuuuuccugugauuagcagauaacguuucaucaaaaauccuaacaugggauucuugaauucuugaauguuuucuucuuuuuuacccuuugccuuaauuuauagauuuaccucacugucaagacaaauguagagugauguuucuuuuauugaaaucuaucagugauuuuaaaaagaaaagcagaauuagcuuccaauccuaauaaaggaagauuaaaauaagcagggguccuaucuuggguuaacuguuaauugcuaugaauaauauugcaguaagguugcuuuaugugaugacuuugaaacuucacaccacaucucagucagauacagagcaccuuuuucuuuaauaucuuauuuuggucuuacuuuuccuucccuuaaauuguuuugcuuuuuagauuauuuuucaucaaauuccaccuuugaauaaccauagccaaaagcaguauuuaauauuuuaugugauucugcuuaaaaacacauacuagaguuugggaagcaggggaaguuuagcauggccucaaagcucuuuaauccuuuguugacuugaaauccaaacugaaugcagguauagugugauaaaguuauuaguugcccaaaaucucugccagggaaaugucugaucauagagaaaaucugaucuuuuuaaaaaauuaacugcuuaaacauuuauuaauaagagucaggcacauuucccacuuaauuaagcauagaauuuuaaaguaacuaaaaauaagauacuguagaugaaagucauaauuaacauuuauaugagguuuuaugcuccaugacuuuccuuuacuguaguaggaaggaggucagauauuauccccauuucguggaugaaaaaacaaaggcucaacaaaauuaagcaagcugccucagaaguagcggaacugaagcucacagacuggccuucaggcuuguacucugugguccuucuaccaagccaggaugugucuguguaaugucuaaaugcuacgucuugagacacaaaaugaaggaaaauuacuaugguuauuuaacugccuuuauccuuacagacaaguaauacaaaguucagcuacuuccuuuacacaaauaauacuuauacuaauacuuaauuccacugugucaucacccuuaaaacucuuaggaacacccuaauuucuugacuucugagccagaugccaaagauauagcaaaaugguuaagaguacagacauuggagucuacuggagagaacccgaagcuucagucucggugccuacuguuuacaguuugugcagcuugggugagucacacaugucuagaaggcuuaagugcuccauaaaugucagcuguuauuaucagcacagaauuggcuaaggcauuaagcagugacucagaacauaauagcaagcugcuuugggaaguuuuuguuauucuaaaauuagcgagaccuugcaauccaagaauuuacuguuaguugugccuuguauucugccauguguguccccauuugcucaauauacugaaaaaccuacauggaauaagauguagaauaaauguuaguguucccuacaagaucuucaguggggauuaugguacaaguaucuugcuuuuuuuuuuuuuuaaucuuccucuucgggccccuccauuauugaccauugaaacuuuuuggauuugaacucuauaaagcaagcaacucucagguaauuuucuauauugguuguuuauaauuuucucauuuuuuaaaagacagcugauaugcccaauuacaaauucacauugccauauccccuucuacagugucuugcuucauucaugccugcaugcauucaugccuuuagaaacaugaaaaauuguugaggauuuccuauaggacaggccauaugccaaaugcuguuuuguaaauuauaaguaacacaguucagaaauuaacaauccagcaagggaggaaggugggagugaggggggagaguuugagcgagcacuguguauauaccgccagcaugaacacagccugaagaguuuacuauuucuagaaauaguaaugaguauaguaguaauaguaauagaauguuauaugaccauaggagagauuauuuucugccuaaagaugccuuaaacuugauagaagaaaugacauuuaaacgaggucucaaaaguuaaaauauagaauauucuuugguagaaauaaaggaaaggguuuuccaggaagauaaaacaccaugagaaaaaccacagaagugucaauguucaugccauauucgagagucuauauaaaggaaauuaauagaagaggaaaauggagauuaggggccaauuugugaaaggcaaaagcugguucaaggaaaugcaacugugcaagagcucaagaugcacauuauuuuccuugaauaaguauagcauuucagaugggcuagugggagaaauucauacacacacacacacacacacacacacacacacacacagaguuaaauuaagguccguauuuaaucagccauacaaaauuguaucagaagcaaaauggcagcccagggcaggggcagaugcuaugucccuuugcauggcuucccuggccaucuagaguccuucacuggugcagaugggagccacaguuuuccacucucugucuugcauguuuucaaaaacccaguucuugcuaugccacugcccuuuuguagucaguguguauacccucucucgaaaaaccuuauacucccagagcaagcacucuggacucuacuggcuuuugaagcaggcucagcaucaauaaaguuccuucuucagacacggggagaaagcaagucagugucugggaucccugagcaauaucuacaccuucagcuucccaaaauucuagaaagcugaaauucuuauuguaagaaaauuuauguguuauggcaccaaacccuaguauccaagcaggagaggaauuuuagccuuucacauuaaaaacaaaacaaaaaaaccaaaaaacaaacaaaaaaaccuaacaauaaagguucaaauuccugauugugauugaguuacaaaauaaauacucucuccucuggccagaaugcuaccucucccuggguauacagaaguuuuuaguuuccccaagaaggcuccccucccaaauagauuaguaccacuccucauucauccuauaauugcacauauuccucuaacuauuaguuauucauguaugucuuccccaaaagacuauaaccuccuuaagaaagaucccguugaauucugagaaccucacacaauuuuuggaaaacgggcacuuuaacaaauucuugagugaauaaacaagccggugaacaagaugggcccuaauccacaguccuaggucucccuccacugugggcagagugacaugcugaggaacggccaguguuuugauguaguucaagaguagggugcuuggaaggcugguggcugguaaggaagagggcagucuggaguagaagagguagcugggauguuaaauacaaaaauauuccaaugucauugagggccuagcuaggucuagauucgcauguuggguuuuuuccuuuuugugugcagguaagugugucuuaaacaugggugagugaauuaccucccaaaagauuuuuggagaguuucaaacuaaauuuaauuucauuuuugaaaaggaugcuguuuuuauucccaaguguuucucauacuauuacaccuacacaguaagagucuucacugagaaucauggagcuuaucucugccuuguaacuuuuuuuguuaaaagucagguucauuaagaaggaauuuacauacaguaaaauuuaccuuuuauaguguguauucuaugaugcauauacaucuagauacagcuuuuauccaccacaacuaacuuacagaacuuugcaacccccuaaauuauuuugugcccuuguagucauccccuuuucccaccacagccucugaagccacuuaccuguuuucuguagcugcaguuuucaguuuuccagaaugcuaucuaaauggaauuagucaguagccuuuuggacuaggccacuuucacuuaacauaaugcauuuaaaauucauccauauuguugcagguacugguguuauugcugaguaguauuucauuuuuuggauauaccacagauuguuuucauucaccaguugauggacaucggguuuucucuacguuggggcuguugugaacaacccuguggugaauauuugcaugcaagucuuuguguacgucuucaugauuuauguuuucauuuuucuuggguccguaauuaggagcaggauugcuaggagggcaucccagugaauuuaauuucuauuuuuuauguucuggggaucuauggguguauuuucagcaauguaaugacaugaauaaauaguguuucaaaaauaaccugagaacaagguagaacaugggaacagacucgagucagggagacuaguuaggaaauuguugcuuuucaaaauauaccuuguaggagaaauugcuguuuucuucacugucuucaguggaauggguauaggacauagaguaaugugaagauucugugucuguuuuuauugaugaucaacuucuccccauggacuguaguauaaaaacaucuuccaugaacuaaguggaaaugaaaaggagucaacguaauuuuuauaaucuacaaaugcaucacuaguguuuuccuccugccuucagcuauccuuuuauuuuccuucuuuuccauuuuguuugcucuuaauauuucaaccacagccuggcaagggaaguaaggauuugaaauguaaguguuccuuuuucuuuucuucuuugugcuuuugaaaaagggccaaacacuuguaauggcagugauuuaaaaacaaaacaaaacuuuaauuuauauauagcauagauagcuuucuccuaaaccauuuugaaagauccaaauucaacaaaauuaauaauucuuucuaguaccuuauagguguacuuuaaaagauuaugaacauaauuuaaauacugaaaauuagaagcacaggacuuuugaguucaaagagaccuuaagagaagcagcccacaucacccauuucuuacccauggguaagaaagcugaggcccagagugcuggagagaguucgccagggucccaucaccagccugaaugaggacucauuuuuucuacagguagaacaugugccuccccagaaugagaagaaagagugagucugugguuuuuagcaguugggaaaauugccucaggcuuucuguguacuuaaaaauaaaaauaggauaaaauuugaauuucaaagacagguacaauaguuagaagcuaucaaauaugaagauauaugaaaagauagaacaugguggcaugcugugagauuuuuaauauuuugucuauuuuagugcuguuauugaaauaucgugacacuaagauacagcauugcucauuaacaagcauauaauuuugcuguuacacuguuuuggauguccuaaacugcuaguuuuuaguuucuuuuaaauaaauauuauuuuaacuugaauuuuauaacacaagagacauguuggggaaaaccagugaugcccacagugaaacugucuacucagcugcacaccaggcuuuucuggaggucucacugucauucuguugauagacacuucuacaaaagcaaaaugaacaauugggagacauaagucugugcugagaugacaaggcaugagcuccuacuaccaucaaucugugucacagagaaaugucuauucauuuuccauaucagcauauaugguaacauauaauggcaugcaguuuaaagcucauuauucacuguuuuuucagucucugccuuagacacauauagcuuucaacauuacagggauuaggguuucugggaggagagagaaggaaagucaaauaaauauaauagaagaucauagcaaacaaauguguaaguaauuaaaagaugaucagagugucagcuuuauuacuugaugaaaguugaauuaaaagaggggguuuggauaaucaggaauaacagauuucuuaacacugagccccagaauuggacauacccacugcuccagacagcauggaacagccuuaguucuuccaugugagagccucucuugcaguuccgcucagcacgaauguucucagaaggucagcucagcucagcucagugugcaugcucuugagagguagggaaggagugaaacugaacuucaaguuccuucuaccaacucagcaaguggauuaagucauaucaccuccccuguagggagagguaggagacuaaguauuuuggagaaucuucccucuucuugggaaacacgaaauaaguauccacuucuuuccaugugggugagagaguggaggggucaagguaacuaacccuuuuggaaccucaguggucuucuccguguaguuaaauucccuguguucaggaaguugagaaaauaaaagguaucuauguauaguguguggccgggcgacuggcgcagagugagugcuaaaaagacaguagugauuccauuccaucuuccuuaggaugauuccaugugcucuucuuugcccuuauuuugguuguguuuuauaaccaaguuucugauuuggacaauugggugucauucucugcaauaaagucaauaugaaaaagaauagaugugugaggaauagcaaauucuauuuuuuauuuacugaguuugagguaugugucaauaggugcuuggauuuauaauuuucgugaugcaggagaaaaugaacuaguugguuuguagcucagcuggaaauuaaguaguuaaagccgcuaaagagacugaagacugacccugaagaauauaacaucccaaggagcagcagggagaaggaguuacagaggcaauaaagagaaauucaagaggcuagagaauaaggaagaacacugggagagugggcaacauaaaagucaaggaaagggaucaucuaggaaggaggagggcaucaacugugucaaauguugcaaaagggccagguaaaauaggaagaaacagaacaaauagauuugcagaaagccguagccauuauuauaauagcucucagguacugagcacuuacuguaugccaagcacuguguuaaaugcuucauauacuauccugauuuaacccucaaaaacaccccuaauuuuauagaggagguaagugagacccagaaaaguuuagugccagcuuggcuuaggucacagagcuuggaggugacagagcugggacucagaccccugccaucgaugcuuaaccacacagccuucccuccucuggcagacuugcuucugcccacguggugggugaggaagccaaagugcugacaggaaaggugacaaagaggugccccccaggggaggggagggagcguggcaaguagaggaggguaggcugguuuguuuguuugcuguaagauggcagaaacuuuggcauuauuuaacgcauuauuaaauucccaccagggggcacacgagagaugcugagagugaauagacauucagaaggcacaagacagguguguguguuggcggagaggggaccuuagaaagaacagcccgucuuccuuugugacaagauagggaagaagcuauuaacgucuguagguuuauugucagaaaauugaggaaguucucuucugauuguuuuaauucgucucuaucccucccgcuuugcccccuucccugccaccacuccccuucuccagaacauucugcuuacccuucaagcuuccacucuugucacuuggggcuucugagaagugcucugcauccauccacucugcaggcacugccaguugugcaccagcaggacuggcccucucaccugcugggugugccuugccuucgggaggagggcuccuguuugcugggugcugagguugugcacagagccaaaaacuguuugcuaaguaagcaauggauugaugcuuacauaaacagauucagccugcuuuuaagacacgguaccacccugcaagaguuaggacuaagauaagcgcgugaaggauuauaacaaaaccccuaguggggaaggaccacaaaacagagauacgcagggugcaguggacuuaaagacgcacacaguggagcagggaacugaguacugugugggugauuucaggagaaacuuuauaaggagcgugguuuugaacuuauuguugaaggauaggcacguuuuucacagaagaagauaaagaacaggcuuuuuauuuaaaugagguagcauaagaaauggcacagguugggcacaguggcucaugccuauaaccccagcaccuugggaggccaaggcaggaggaucgcuugaggccaggaguucaagaccagccugggugacauagugagacucuguuucuacagaaaaaaaaaaagaaaaaaagaagaaagaaagaaaaagaaagaaagaaagaaagaaggaaagaaagaaagaagaaaaagaaagaaagagaagaaauggcacaaaaagcuuauuuggggaucauggggcagucuauuuuggcugaaguauggaacauagcugggguggucaguccaggaugcacuggaaggaccuugaaugcuaaacgaagaaauucuguuuuauuugacuuccuugagaggagccuuccauuuucaucuuuaucuguaucagaaaaaguuguggacauauucaaaaaaacuauuuuaaacaaucuuuuggacauagccaagaaguagauuaugagaguuuaggagucauacccaccauuuacaucccagaaaccaagccaguauccuggagaguuucaguauacuauccacccacucucccaagaacacauuguagcagauagguaagggcugcauugccuuccuuggcagucacugacuucaucacaccaucuaggggaggaaauggaaggcgagccugcagugugccuucuccugcaggucuuugguggagaccagcaucagguuucccacuacuuguaaauuguuaugcuuaauaacuauuucuagucaaaaaacguuaaaaauaaaaaucucuuuuuucuuucaguuaagaaaaagaagccuaaacuuuuaaauaaauuugauaagacuauuaaagcugaacuugaugcugcagaaaaacuccguaaaaggguagguugauauuuuuugugcaaugguuuuguuguuaaauaaacucaggcauuacucuugauuuguuaaaaaaaaaaaaaauaguaaguguaaaagaaacaacaguugaauagaguggauuuuuccccaggcacaugaacauuccacaugaaaugaaucagauggaagagaauugcuaccacauggccaaagagaaauagaacuuuccuucaggccagccgaugcgggugucagccuaccuccaucacauucuaguuaugcagcuuuggggaaaccacuuggcucuucugggcguuaguuuucuuacagacaugauaaugauaaauauucuuucuaccuccuaauugaguuuuuuaaagaucaauuuaaagaucaaaugagaauuuuuuuuuuuuuuuuuuuggacagagccuccacccaggcugaagugcaguggcacagucucggcuaacuggaaccucugcuuccugaguuuaagcaguucuccuccugaguagcugggauuacagaugcucaccaccaugccuggcuaauuuuuguauuuuuaguagagacaggguuucaccauguugcccaggcuggucuugaacuccugaccucaagugauccacccgucucagccuccgaaagugcugggauuacaggcgugagccauaagugagauuaaaauaauaauaauaauaauaauaauaacacugucaaguaucauagaagugcaaguuuuuaauuuuauagcuccuugaugcaaaaagaaaaacuaggucaguccauuacucaggauaguaauugguagaugaaaugacauucuucuuacuuaggguuaaccucaugcaccuccaguuuucaggguaccuuauuuauauuuuaauuugucgauauauuugaaauauuacuugcauuucuuuauagauauuacaauuuugagaacaauaaauugaaacuggauuuaaguuauucguucccuuaccuuggucauaucaucuaaucaucgggugcaaaaauauuuauuauaauguauuuaaucauaucuucaauuaaucaucuccuuguuuuuggcggaaauuuguuucucuacucugcacuugaauguagacucuguaauguucauuaguuuuccuguaauaggcuuuuuaaucaguagacauuggcugcaauaauaaaggaacaagugggcuuuaaguaaacaaacaacaauaaaaacacugguuaggaacuaaaaugggacaagaauguacguccgcauguuuauugaaaguguaccaaugagcauaaaggcuuuuggaacuggcauuaggugaggcuccaaagccaagguuugccaauaaaaauagaguaacuccacagaauauugcagcaaagucauuguucacuucccuuaaaucuaaccacguggaaugauuccuacuuucugauaguaaacaagaaaguuaacugucuuguuuaacuuuaugaagugaagccaucuacuguuuguggucaguuuguauuucuuaauagaauugaagcaauaaucuuuuucugccaccuccuuuggcaaccuccacuuucucuauacuaaaugucauauauaaaaaugggagugccuauugcacaggugacuuuugguguaaaaaacauaugagcagcuuuagagaaggauuuuaauguaauuauaugaaugauaaaggagggcucaguuaugggguauucugcaguguugcuccuuuggagaaguuauauuuuucucaaggagcaucuugaauuuauaccagggaaauaaaagaggaagaaguagccccauauacaauucuugcuucugaaacaacaggaagcuauguuauugacugacucaucaacauaauucagucuuuuaggguuguuuuuauggcuaguauuuucagaggaugcaccuuagugcacuggaccagccgaggccaacuaacacacacuccacacagagccagugcagccucaguucaugccuuaggcucaaggacuauguuacaugaaaguauguguucgcuuuuuauccccccagaaaaguauagaucagauuauauuccaauccucuauuuuaaaaaauaauaauauuuauuauuuaaaaugcuuuccuaccucuggaaaaaggguuugaaaugauauacugaaauauauuugcuuauuuguuggaaucacuuauuauuacagcauuguaagugauuuuugaaaagguggggagggaguaaagaaaauguaaucaaauaccugaaaguucacaccacuggcucuaaaccaugcuaggaaugaagucaacaauuccucgagggacaacauggaaaacagaaucagaagauaagauuaauauuguucaucagaagagcuguucugcuccaaguccagagagaaacauuuggcuguagaucuucauaaaagguauacugauggaugcaaaacuuccuacuuccccacugacaucauaccaguggauuauucuaccaugcagcugcaggaauguaucuuauuauccuuccgcacagcccauuggccucaugucaacacaguguggccuacguccaugucucucccaugaacugucuugguccuaggagaacauuauaagcuauguugaggaacagaucauuuucaggcaauucuucaaacauuuugugucuugcagcugaguuuuuaaauuagaauugagcaauaguguuuggagcuauacaaaaacuuagggaagggaaauucuuucagacuaaaagcaaacacauuuacuuugccagccaacugaagugaaagcaaggcugauggccccucaggaaagucacagagccucugucuugcagggauucaaaggaugcugcagacagagccaaaauaucccauuauuuuaacagccuugacagugucaagcaggaauaucucaccuuaucaaauuuguuaugaacauuguuauucuuauguuuuaagucugauauuaguacauuuagcacaauuaucauugaaauagcuuugacaguugcaauuuaaguugcauggggugcauacuaggcugaaaauagacccccaaaagauaugugucuggaaccuguaaauguuauguuauuugggaaaaggaucuuugcagaugugauuaaggacauugagauagagagauuauccuggauuauccaguugggccuuaaaugcaaucauguuuccucauaagagagggacagagggaaauuugaugccgacaaaauaaaaaguagcacauacagaggagaaagaaagcaguaugaagacagaauuggauauuggagugauccauccacaaaucaagaaauacugggaauagacaaggacaaauauucccguaaaaccucuggauagagcacagcccugccaccaucuugauuucaucccagagaaacuaauucuggaaaucuguucugcaaaacugcgagagaacaaaguucucuuauuuuaagccaucaaguuugugguaguuuguuacagaggccaucgaagaguaacacagauuucaauacugggccugcagguacacagaagucaggaauugagguuugggaaccucugccuagauuucagaggacguguauugaauugccuggauguccaagcaaaaguuugcuguacggguggagcccucauggagaaccucugcuagggcagcguagaagggaaaugugggguuggaucccccacauagaguccccacuggggcacugccuaguggaguugugagaagacggccaccauccugcaggccccagaaugguagauccaccaacagcuuguacugugugccuggaaaagccgcagauaccuaagaccagcccaugaaagcagcugggagggggacuguacccugcaaagccacagggguggagcugcccaagaccaugagagcccaccacuuguaucagcaugaccuggaugugagacauggagucaaaggagaugauuucagagcuuuaaaauuuaaugacugccacacuggauuuuagacuugcauggaacuugaagccccuuuguuuuggcgaauuucucccauuuuuuuuuuuuuuuuuuuuuuugacauuggcagagcuagcugagguuuuauuuuggaccaaaaaaaagcaauugaauuguuuuguagcuggaggcaugggcaagggggguccccagguaguaaacuccccaggugggcugagggcuagggcugagccucaggugggucuccuguucccagugcuacccugaauaguggccuccuucucaggcucuggggcagcgcaggagggguaggcugggaggggcugccacagcuguucacuugggcaggaugucagaggacucggacaccagcuucccaucacaugucucgaucuucuucacaaccacggcccuggaggaacuggugcggcugagggagcuggagccugcgccagagccaaagcuggagcccaggccguagcugaggccggggcuugugaggcccccauaggccgagcucagaccaccugcauagccgcugguggucuucguaugaauacucauguucugcaucccagacuucagccggcucucuuugcccuccagcagcuuccuguagguggcgaucucgauguccagggccagcuugacguucaucagcuccugguacucacgcagcugccgugccauguccugcuuggcccgcugcagggcagccuccagcucggacaacuuggcguuggcauccuuaauggccagcucuccacgcugcucggcaucugcaauggcggccuccagggaagcccucuggccuuugaggcccucaaucucagccuggagcuggcugauguuccaguucaucucagagaucucagucuuugugcgccacaggucauccccgugcuucccagccagacucugcagcuccucauacuugaucugguacaugcucucagccucagcccgucuuugguuggcaauauccucguacugugccuugaccucagcaaugaugcuguccauguccagggagcggcuguuguccauggacagcaccacagauguguccgagaucugggacugcagcucccggaucuccuuuucguacagcugccugaggaaguugaucucgucagucagcccuuccaggcgagacuccagcucuaccuuguucauguaagcuucauccacauccuucuugaugaggacaaauucauucuccaucucuguaugcuuauugaucucauccucauacuuguucuugaaguccuccaccagccucugcauguugccaagcuccgccuccagcuucagcuucuccuggcccagagucuccagcugccgccuaagguuguugauguagcucucgaacauguuguccauguugcuccgagccaucuucugcugcugcaggaggcuccacuuggucuccagcaucuuguucugcugcuccaggaaccguaccuugucugugaaggaggcaaacuuguuguugagggucuugaucugcuccuucuccugggugcacacagccuggauguugggguccaccuccaggacaagggggcucaguaggcucugguugaccaugacugcggugaugccucccaugccgcuggccccacuauagccgccucccaggccaccccgaaagcugcugcugcccacucaggagaagcucgaggagcugaugugggcaccgggcccacucguguaggagcggcugcugaaggcccgggggccagagguggacaccuuguaggacuucuggaucacccugauggacaugguggaggcaggaguggaggcaggcgggccgaaccaggcggagauccuagaaggagcggagaagcugcuucuugguccaauuucucccauuuugaaugggagcauuuauccaauaccuguacccccauuguaucuuagaaguaacugauuugcuuuugauuuuacaggcuucuaaguggaugggacuugccuugucucagaugagacuuuggacuuugacuuuggguuuaugcuggaaugaguuaaacuuuugugggacuguuguaaaggcaugauuguguuuugaaaugugaggacaugagaauugggagggaucagggguggaaugauaugguuucacuguguccccacccaagucccaucucaaauuguaauccccauaauccccaugugccuagagagacaccugguggaaggugauuggaucaagggggcaguuucccccaugccguucucaugauaguaaguucucaugagaucugaugguuuuauaaggggaucuucccccuucgcuccucacucuucucucucuugccaccaugucaggaggguccuugauuccucuuugccuucugccacaaucgcaaguuuccuuaggccuccccagccacguggaacugugauucaguuaaaccucuuuccuuuauaaauuauccagucucagguauuuuuuauagcagugugaaaacagacuaauacaauauucgagaacaugguagaaccuguacuuauauugagggaaaauucaauuucuuuagcaaaaccacauauuacaucauuuaucaggugucuugucuuuuuuuuuuuuuuuuuuuuuuuugcgagauugggcauccuugccauuuucuuuuuuuuuugucauuuuauuauuuauuuauguuuuuauuauuauacuuuaaguucuaugguacaugugcaccaugugcagguuuguuacauauguauacaguauacaugugccauguugauguggugcacccguucacccgucauguacauuagguauaucuccuaaugcuagcccuccuccauccccccaccccacgacaggcccuggugugugauguuccccacccuguguccaaguguucucauuguucaauucccaucuaugagugagaacaugcgauguuugguuuucuguccuucugucuuuuuaaaaaugaaguaaauauguguucauuacuaguuuucuguuugccuuaauauagcuuuuuuuaaaaucuuagauaaaacuaucuuuacacucaggauggaaucuaggaaacucugacaaaaccacuugcugaauauuaaauaacaauauugauugauuauucauuuuaauuuauuuuauuuauguaauuuugucuuucuaacagggaaaaauugaggaagcagugaaugcauuuaaagaacuaguacgcaaauacccucagaguccacgagcaagauaugggaaggcgcagguauucugagacccuucuccuuaggacacuuuuuugauguucauguguuuugugugauugaauuuuuuacuccucacuauuuucccuuucuaauuucucuacagaaucaguuucucauguauaugcauaagcaagaaauacaauuaucacuauugcaugcugcugaauuuaguaacauuuuuuucugcucccccuccauaugacuucucucuggcuuugaaaagaaaauaaacaguaacacuuuugucauugauuuaccauccccucaugucccauuccaucuaaucccaccauacaguguucacuugaggcuccucagagcuuucagacucucaguuuuauaacuggagguugcaaguaugcuuaggaaagaccuuucuaaaauauaaaguggaacauacuuugaugucucuauaguuuuuuccaacggacucauuucuuagcagcuaccuuuauccucaucucccaccgucuccuuucuuaucuggcuuuuucuaguuuccaacuccuuucaugaagcauguccccuuucaccuguaacugcauaaacccacuguaugucaguguuuuaggcccugggaaugucuguuuugcauucuuuuaugagaugguuagucaggugcagcuacaagaggucucacaggacaggauuaggaaaaagcaaguuuauuaugcucacagagacaggaggcccagcaugccaaacagggcuacaugggaaagacucaaggugaucaggggaugguaggcaagaacgaggggaagguuuggccauagccuuuauugagguuuccauggaagaggcaaaguagggcagggugaacaguuuaggacuggcugguuugaauaauuucagccuacagcggugguaccuuuugccuacagaggugguaccuuuugccuauaggggugguaccuggcccugagaugauuaaagucgaggaggcguggcucuggauugguuaauuugcauaucaaaagcuuucuccuggcugagcacuggccagcucagaauugucuagcucagggcagucucucccuagccagagagguuuuuuuaagaugucaaaacaucauaauauacagaaaauuuaaaaauaauuacaauacaauacagugaacauucuuguggauuccaguggaagauuuuuuuaauuauuaacaaauauuuggugaaagcccacugugugcuaggcccuguucuaagcauuagagauacagccaucaguagaacauauuuuaaaagcccuagcacuuacagaguuuccauuguaaaggggaagacaaugcauaagacaaguaaguccaauguauaugcuuucuagggcuaagugcuaagcagaggaaaaagaaaacagagaacagccaacagacaugugagggggucgacgugguaugaaagguggcagggaaaggucucaucaaggaggugacauuugagcaaagcccugaaagucuuuauaaauaaauauguacuuaaagaacauuauaaaguauuaagaauaaauauguuagaucaucuuaccuaauaagacaugcuguaaagaaaauaagaaaauguaauggaaugaagagcauaccuauuaagauuuuuuuggcugcagguaacaugacugaaagaauggggcagacagcgcuuuggacaaguugggcaggaaaggucucucuggggagacaacauguggcugagaugugaggagguuauauuacuagcaggagcuauccaggcaagagaaagcagcaagucaaaggcuuugaggcaggaaaacaaucuugggauaagccugaggaaagaaagaagggcaugcuggggcagggaagcaaggaucaaggaggcugugaccuugcagauuuuauucuacacgugcugagaagccaugggaggguuuguuuguuuuuuuggguuuuguuuauuuguuuguuuguuuuuauacuuuaaguucugggauacaugugcagaacauggagguuuguuacauagguauacacgugccauggugguuugcugcacccaucaacccaucaccuauguuagguauuucuccuaaugcuaucccuccccuagccccccacccgacaggccgcggugugugauguugcccucccuguguccauguguucucauuguucaacucccacuuaugagugagaacaugugguauuugguuuucuguuccuguguuaguuugcugagaaugaugguuuccagcuucauccacgucccuguaaaagacgugaacucauccguuuuuauggcugcauaguauuccaugguguauaugugccacauuuucuuuauccagucuaucauugaugggcauuuggguugguuccaagucuuugcuauugugaauggugccacaauaaacagaugugugcaugugucuuuauaguagaaugauuuauaauccuuuggguauauacccaguaaugggauugcugggucaaaugguauuucuuguucuagauccuugaggaauuaccacacugucuuccacaauggucgaacuaauuuaugcucccaccaacaauguaaaagcauuccuauuuuuccacaucuucucuauaaucuguuguuuccugacuuuuuaaugaucgccauucuaacuggcgugagaugguaucucauucugguuuugauuugcauuucucuaaugaccagugaugaugagcuuuauuucacguuuguuggccacauaaaugucuucuuuugagaagugucuguucauauccuuuguccacuuuuugaugggguuguuuguuuuuuucuuguaaauuuguuuaaguucauuguagauucuggauauuagcucuuugucagacagguagauugcaaaaauuuucucccauucuguagguugccuguucacuuugaugauaguuucuuuugcugugcagaagcucuuuaguuuaauucgauccuauuugucaauuuuggcuuuuguuaccauugcuuuuggugucuuagucaugaagucuuugcccaugccuguauccugaaugguauugccuagauuuucuucucggguuuuuaugguuuuaggccuuacauugaagucuuuaauuuuuguauaagguauaaggaaaggguccaguuucaguuuucugcauauggcuagccaguuuucccaauaccauuuauuaaauagggaauccuuuccccauugcuuguuuuugucagguuuguuaaagaucagaugguuguagaugugugauguuauuucugaggccucuguucuguuccauuggucuauauaucuguuuugguaccaguacaaugcuguuuugguuacuauagccuuguaguguaguuugaagucagguagugugaugccuccaagcuuuguucuuuuugcuuaggauugucuuggcuauauggcucuuuuuugguuccauaugaaauuuaaaguagguuuuuucuaaugcugugaagaaagucaauuguagcuugauggggauagcauuuaaucuauaaauuacuuugggcacuauggccauuuucacgauauugauucuuccuauccaugagcauggaauguuuuuccauuuguuuguguccucucugauuuccuugagcagugguuuguaguucuccuugaagagguccuucacauccuuuguaaguuguauuccuagguguugaauucucuuugaagcaaucgugaacgggaguucacucaugauuuggcucucugcuugucuauuauugguauauaggaaugcuugugauuuuugcacauugauuuuguauccugagacuuugcugaaguugcuuaucagcuuaaggaguuuuaggggugagacgaugggguuuucuaaauauacaaucaugucaucugcaaacagagacaauuugacuuccucucuuucuauuugaauacgcuuuauuucuuucucuugccugauuacccuggccagaacuuccaauacuacgucgaauaggaguggugagagagggccuccuugugccaacagucugguuguuuuuuguaaaguuugcuuugguuacugaguggaaaauggauuauggaggcaaaaguagaugcaaaaagaauagaaggcuauugcaaguguacacaagagaugcugguggcuuggacugcguucacggccauggagaugagggaagugggcaguugguggagcugaaaggacuugaggauggauuagauguaaaaacaucagaggaagaggacucaaggcugaccccugaguuuuugguucggccagcugaguggaggauaaugccaguuacugaccaggaagagcaagucuggagugaugcagaagucaagaguucaagaguuugcuguuggucuuauuaagugugugaugccuaugagacauucagguggacaugucaaguagaccauuggauucacagagccuggaacuuggaggaaaagccagggcaggauaucaaaauaugccaggaaguaaagcuccaacagcucugccuagaggucaagauugucaacccugcugggaaaugguagauucagagugcagaaauuuuccagacagaggagaugcugacagcaccccuauggagaagguccaugcagacauuuguacaggacacacacaggaacuaacucagcuguagauaaaacaagugaauuuuguucugaacugaagauggugaccacuugagauccagaugcucaguaucuucuuauaucuccauuaaaaaguaauuaauauauuuuuuauuaauucgauuuuaauuagauuugugaaaaauugauucaaauaaauuccucuuguccaugguacagaccagcuuuagcagacagcaacuguaugauuuuuauaaauuaguuuggucaguaauucucugaaauugcuaaaucauuuugcuauuaaguaagagagaguguguuuguuaccaaaaagaucaugccuauucaaauaaguaguguuuuuuaucacuaguauuaagucauuucauuaagagaagcauauuaacuagagagagaaaugguuuaugcaaaugcuaauuuaauuauggcaaaaauguuuuauaccuuagaaguuuuccuuauauguaauauuaauugugaguaccaaagucuaaguaaaugaaaugcucuugaaacagugugauuguuauauuuacagucagcccucugaauccucauguuccauauccauggauucaaccaaccacagauugaaaauauucagaaaaaaaauaaaaaauaacacuucaacaauuaaaauaauacgaauaaaaaugauacaauauaacaacuauuuacauagaaguuacauuguauuggguauaauaaguaaucuagugaugauuuaaauuauacaggaggauauggauaggcaauaugcaaauacuauaccauuuuauaucaggaaccugagcaucugcagacugagguauugcagugcggcagugauggugguggucuuggaacuaaucuccaguauauaacuaaggaugacuguauauccuuaugucacaguagaaaauugagauuuaggcuucaagcaauaucuuuuaucucuaugcuauuaugcuucaauguguuauugcuauuaauauuaauguggcauacagcaaaauuuagccaugguaaauuaaauuuuaauagaguaauuuaaaggaaacuucaaguucauaguaguuuuaaaaauaaaaauucaacagaagauggguuuuauaggaagaaauuaugacuuucauucuuuguuagcagauuaaacaauuacuuuggaauauuccaacaaauuuuuaaaauuuugcaacauuaagucauauauaaacuauaguaucucucauuucuaaaguagcacugauauugucuuuuucuucauaucaccaaaauuaauuuugaucaaguucccugaacauuggacacaaaauauuaaaauauaaacucaauucacuuuauuaucuuucacaaaccauuaaugccuuugaggcagaaaaugacacaucucauaggaagauugguugggugaauuaguuagagucaacaaaaggcuuugcgauguuaacauccuguaacaaauauucaguuucaguuuagcuuguuuuaucuacagaugcuacacugauaaaaaucaaucugcagacuuuucagugcaagugccuaucaguuuuauucaagagcuuauaaagaauuaugugccauuuuaguagugauauuuuuccaauucugcaaguuguaaauguuaauacuucauuaaaacaaagggcccuggggcaccagagaggggacaaggcauacagauuauacuaucucucucccuuuucagauugaguuuaaagauguuuauuccaaucucaauaaagaaggauuaucuugguaggcauuuguccucccacuaaugcuacagagaccuccaguuccaggaucuuuuugggcacucuguagguucaaaaugaagagagugaaccacagaugguuuacaauuuacaaugucuuuucuuaacaauuuuucaacuuuauaauggugugaaagugauacauauucaguagaaacuguacuucaguaucauauccaauaaauuacaugagauauucaacauuuuauuauaaaauaggcuauaugcuagguaauuuugcacaaauguaggcugauuaaguuuucugagcacauuuaauauaggcucugcuaagcuaugauguucaguagguuaucuguauuaaauacauuuugacuuacgacguuuucagcuuaccaugagguguaaacccgucgaaagucagugaacaucuguagaugguuuugaaaggacucucaggucuagaacucuguguuuugcaaaguuaucuaucaacauucauauucuggggaguuaacucacuauaacaaaacucacaaggagcugauaccuauacagaagagccaguauaugaauauaugauagaaggccaugccagcaucaugaucagugugggucauugacacuggacuuucucuccugguagauaagacuauucuggagaacauuuacagacuuccaaagauagugaauggucuggagcauaucuccauuuagcaagggugaauuuccuuuucuaaucuagagauuuuuauccuaccaaguuuucuuucucauaaaucuguccacuuccaucacuuuaauucuaguucucaucaucuuggguaauuuauccuaaucaguucauauuaucaaguuauuucauugaugucuuauuuugugaaaaaaaaucccauaguugucuuauuuugucaauuugugcugauucuuagguuuguuuguuuguuuguucuuuacuuugggauaugggagggaugggucauuuucuuacugugcccucaaauuauggagcgauacuuuauuuugauucugcauacaucuauauauuaacuacagcacacauuuuaacaacauaaacauguuuaaauauucugagaaaaaaaaauauaugcuacuuuuagcaucuagccagaaucauuuuuccucgaauaauaggcuucagauuguagccuccuaaaucugaugagauauugaugacauuuuacacauucuccucucucuuccugacuccaguauuuuacucuccauucucaguuuccagcuaagaauguugauucuuuuuucguuaagaaaauagaaauauccagacaauuuccaccugaugcugcuacuuugcuaacagccauccucuaccugugccuguauguucugccuucccuccuguuagcacagauggacuauucuggucccuguuccucucucaccugcugaaggacaucccucuaauuuuugugucuccuucuguaucaucagauuuucccucucuacugagucucuugcaucuccuuggaagcaugcuguacuaugucccauccuuaaagaacuccccuugucugcacauuacccucugccagcuggcucauuuuucugcuccccuuuacagugaaacucuucaaaagaguuaucuccaccuccuuccaucucauguucucuugaaccugcaguacuguggugcucccuccuuuuugcugcuccucccuuguuauccugaucucuaaugaccuuuaaacauuggaguucuuuaggauucaguucuuggaccgcuucuuuucucugucuacacucucgacugcuucuagcuuccuagcuuuacauaccaucuucauccuugaugauucccacacuuaacuucucuuacucugaccucccuccugaacuucagacucauauaugccccuuccuggucaguaacuccauuuggauaucuuauagacauuuuagguuuaauauguccaaaacaaaucuccugauucuauacugcccccaaacuugcuuuugcccuuucuucccauucucaaggaaugacgguucauccaguaaucacugaagcccaaaccuuguucauucaugguuuuucucucucccccuuucucacacccuacauuuagacaaucagcaaaucuguuggcucugaccuucaaaauguaucuauaaucugaccacuuguuaccacuuccauuacugcuaccuuaguccaagccauaaccaucccacaccuggauuccugcuggaguguucugccucucccagcuucucagucuguucuccauacggcugccaccaugaucccuucaauacauacaucagaucauuucaaaagcccccauugucuucccgucucacuuuguguacuagaauugucaauaucuugccaggcccuacuuuaccucauggccuccauuggucuucccuuuccuccccuccacugcacuggccuguccucgauuccucacuccuaccuccaagccuuugcucuugcucuuuucccugccuagaaugcuacuccccaagguaucuucauaauuugcucccucucuucuuucaggcccuccccaauuauccugauuaaauuagcaacuccuuaccauuccuacccagcacuccuaagccugcuuuguuuuuauccacagcacuuauggcuguuagacacauaguaccuuuauuuguuuauuauauuugccaccuuuccaaaauggaugcaaaguagaagcaaaaagggcuuugucaguuuuguucaauaugccugccacauuuguagaagagugccucuuucccagaaaacaguuguuaaaugaacgaaugcauacacgaauaaauuaaugaaagaacgggaacuugggcuggagaccugccuauauaauguuaguguguaauaggacguacaucuccaucagccccagcguguauuaguccugcauuuaugacauucuuucuugucuuuaguaacaaacuuuaccuuguauuauuaaaauaguguguugauuuucuaucuuuuguuaguuuuuuuuaucucuugauaaggagaaaaggcuaacgugucuuacauuucuuuuaaagcauguccaaaaguuaacuuuuuaugaauauuuuggguaauuacaaacacagcuagucaugggacauuuauccagucuggggacuucuucuagugugaggaugauuuggcugagaagaggagaaguaaugaggugcuacguggagccaucgagaccuaccaagagguggccagccuaccugaugucccugcagaccugcugaagcugaguuugaagcgucgcucagacaggcaacaauuucuagguaagaugcaaucaaagguaauucaguaggaaauggcauauguuuuaucuugaagaagcugaagaguguauucuucucuuagaagaauuacgugggagaaaaccugaguuuuacaacugauuucaaguaaugugucuguccuaggcucaccaucucuaaaacugaaauuguaauccuaaucuuaauagaggcaugccucacagauacuguggguuugguuccagaccaucagaauaaagagaguuacacaaauuuuuugauuucccaggguaucuaaaaguuguauuuauacuaugucauagugucuuaagugugaaauaacauuaugguuuaaaagacaauguccaagccuuaauuuaaaaauauguuauugcuaaaaaaugcuaacgauaaucugagccuucagugaguuguaauccuuuugcugauggagggucuugccucaauguuaauagccagugacugaucaggguggugguugcugaagguuggggugacugaggcaauuucuuaaaauaaggcaacaaugaaguuugcugcauugauugacucuuccuuucaggaaagauuuaucuguaguuugaagugcuguuugacaguauuuugccuacagaacuuuuuucaaaauuggagucaauccucucaaacccugccacugccuuaucaacaaaguuuauggaauauucuaaauccuuuguugccauuucaacgauguucacugcaucuucaccaggaguacauucagucucaagaaaccacuuucuuugcucaucuguaagaagcaacuacucaucuauuaaaguuugaucaugagauugcagcaaaucagucacaucuuuaggauccacuucuaauucuaguuaucuugcuauuuccacaucuguaguuacuuccuccacugaagucuugaaccccucaaagucauuaaugaggguuggaagcaacuuccuccccaaacuccuguuaguuuuuauauugugacauuuaaauaaaauguauuuauuaaauaauagaacuuaaaagucuaaauuacuccuugauccaugaacugcagaauggauguuguguuagcaggcaugagaacaccauucaccuccuuauacaucuccaucagaguucuuggugacuaggugcuuaucagugagcaguaauauuuugaagggaaucuuuuuuaaggacucaacagugggcuuaaaauauucaacaaaccaugcuagauguccuaucauccagacuuuguuuucccauuuauagagcacaaguagaguagauuuagcauaauuuuuaagggccccagguuuuucaaaaucguaagugagcacuggcuucaacuuaaagucuccagcugcauuagcuccuaacaacacaguagguguauccucaaaacuuugaaagcaggcauugacuucuccucucucacuaugaaaguccugauggcaucuucuuccaauagacagugauuuugucuacauagaaaauuugcuguuuaguguagaucacuucaucagugaucuuagcuguuuaguguagaucacuucaucaaugaucuuagcuagaucuucuggaaacuugcuacagcuucuacauuagcacuugcuacuucaucuuacacuuuuaucuuauggagauguuuucuucccuuaaauuucaugaacaaaucucugcuagcucucuucucccucuuucuucccauuuuaugauagcuuguauaauuugccuaaggaaucauagcuaauagauuaauaggucuggaauaaaaaacucuuccugugauaccaaauucuuuucuuccuuaacuauagcaaaaugauucauggagguugaaauuaucuguggaaauuuuguauaaaugaauaauagcuguuucugguacucuaaaaaaaauuuacugguaagauuugacccuauaucaaggaaaaugcuagaaaaaaaaacaugaaguaaauuugcaaauacuuugaaaagaacaucauaucauauaucaucagauuuaggaggcuacaaucuaaagacuaucauuugaggaaaaaugauaccagcuagaugcuaaaaguagcauacauaauauagaacaucauauaccauccucuggacugacccagguucccaguaccaaaggcaaguaagacuagcuguuagcuaacuucacgauaaccaggcuuacaauucucuucccauaacagaucaucagucaacauggagggaaggagcuaagcuaugagucacugccaaggcaggugcucggcuggcaagauaguuacauggacagauuauuaaugucacuuaggggaggcuccuauagauuagagucaaggcccaauggacccuccuaucaguuuuccgaggauuagaaugaagaggaguuguaucacuuuuguagauaaauaaaauaggacuaaaguccaugugaugauuaaaaaugauaagaaauggucaguuagacuaauauucauagggaccagugcagcagaacaaaaacaugcagcacaaauucagcacagaaaaggcagggccgggacuccagagaggcaaugcgggcacucgccauggacgcagaaucagcauuacugcccggacgcaguggcucacgccuguaaucccagcacuuugggaagccaagaugggcagaucaccugaggucaggaguuccagaccugccuggccaacauggugaaaccuggucucuacugaaaauacaaaaauuagccgggcauaguggcgggcaccuguaaucccagcuacucaagaggcugaggcaggagaaucacuugaacccggaaggcagagauugcagugagccgagaucaugccacugcacuccagccugggcgacagagcaagacuccaucucaaaaaaaaaaaaaaaaaaagaaucagcauuacugaguuuuccucuugccucagucuccacuauggcucugcuuagcacuguuuagugauucugucacuaaaguguuaacauuuucuucaucaugaauguuuuacauuaauauugauuuuuuaaaaggaugcauuaaacuagccuucacaucaaaauuaugaacuuuuuuggcauccucugaaaucuaacucugagugccucucuggccucacccuguccucggcccugggaaggugacugccucuuccacagcaauccaucagcauuugaauguaguccucucagaauguccuugagaauaaagcaaguucacucgaggaggcucugaggcaaauggagacagaagauuuuagugaaaaugacaugguggugaaguuggucacaacacaacaggguucccagaugcagaguggaagggauggggagcagauggcugcaaggaggaguuuguguccaugcuuuuguuguggauaauaggagauuucuagaagaaagugugagccuaggugggcagauagggggaaggaaagguauagaaaaggaagcccagauuuguuagugaggaaaugacuaggguucugguuggaauaugauuggcugguaauggggcauaggccgucggaugaguuggugaugcuuuauggcagaugguuuggcaguggaauauacagcugcuuuagcguacugacacucccaucacucuccuagauugugggcaacuaagcccuuuagauaauucauggcuuuuuucguugaugcuaguccucuuuuugcacauguucuuuuauacagauaauugaagcuggguuuuuucaugauucaugcgugcaaaguaugccuuuguccacgagagggccccauaauacuggaugauguaucauuugcuccaugacuaggucauuaccuagagaugaguacacuugucauucauaggggaugugucagcaguuagguacuguccuauguacuuuggugccuuuucgaauugcauacagggugcuagacccugaaguuaguuaagacuuuuuauugcuuauccccuauucauaaaguuaauaaaccaaaaagauuucagcagaacuuuuuuuuuuaacgaggaauuguuaacuaaguuuuucuugagaaggaauuuaacauaaaaugguaaacauugcugaauguaaaaaaugagaaugucuuuagauguuuauaaucaauaccauauucaguaucuacuuauggcaguuauuaauaccauugcaacuacauuaugaaauccuacuagguacuuaguaaaccacuaauaaagccagauuugagcugguucucaggcucuggugaauagucucucaugacuuacauucucaauacaaaaguguacauaaucuguuuuuauuucuauuuuuuuuaaauucccaccuacucaggucauaugagagguucccugcuuacccugcagagauuaguucaacuauuucccaaugauacuuccuuaaaaaaugaccuuggcgugggauaccucuugauaggagauaaugacaaugcaaagaaaguuuaugaagagguaagcaucaaucuuguauuaacuacgucaaauuaaguucuaaggcuauuugcaaauuacauuuauuauacccagucucucuuuauuuuaaauuaaguuaaaaagcauguaaguauuauuauaguuaacauauucuaaacuauguuuuaacauugcuuuucuuccuagaucagaagauuuuuaaaucuuaguuaacacuuaguacauuaaagccuucaacuuauaauugugauucuuuuaaaacuucauauuuaucuuuccauacauagucuuucuaaaauuguucuucaugacaggaagaagaauuuaaguuccugugaauguuacacacacacacacacacacacacacacagacacacuuuccuuuuuuuuuuuuuuuuuuuggcagaaguauggucuagagagaggcuauauagaacaggggccuuucaagcaugugacauaaauuacuuuucagcagggcacugacucuucaaauccucuggcaaggauaccuuucaaaggauuucuacuuuauaacagauguugauagauaaccucuaagucacaaguaacuagaaaaucuagagaaaugugacuucuuuaggcaguggaggaauucauuugguacagaaugaacaggaugcccaaugaauuuugaagauggagaaaguuagcgccucuguaaaagaaagaugaacauguuuacuuguuauucuuuaauuuaggcccuuugaucaaugguuuucaagcuggugaagucuacaucaauaugcuaccacucagugauaguaugauuucugcuacaguuuuguuuugcuuuuguuuuuguuuuugacacguggucucacucuguugcccagacuggaguguaaugacaugauauagcucaccucaacauccaugucccggacucaagcaauccuccugcuucagccucuuaaguagcugggacuacaggcacaugccaccaugcccagcuaaauuuuaaaaaauucuuuagugauggugaggucuuccuaugauauccaggcuggauucaaauuccuggccacaagugacccuccugccucaggccucccaaauagcugggauuacaggcacaagucaucucacccuacuccuuuuacaguauuuuuuaaaugccaucaagaacagcaguuucauacucugguagggacugggucuauccucaaagcgguacuuuccucuguguauugcuauuauuguguaaugaaaaucauugaauugugaagcaguugucuuuuuaccuuucucauaauuuuuauauuuucugagagaacagaaauaagaccuuugcuuuuauaacaucacuaauagcuacacaggguggauugaaccuuuaauguugacaaugugugccauuuacuaaagaccuauuccaggucauaaauuaauuccauguggaacauugcauuuguuaauggccaacacauaacacucaaugcccugucuuacagaguaugguuaagagaagcaucauauaccucagugaaucagggucugugaauguaagaauugugaagcuauaacaaacauauccauuaguuugucacugucagaggccacaaaaauggaacuuguagaauuccuaacuuccuuccucccucccucccucccucccucccucccucccucccucucucccucccucccucccucccucucucccuuccuucguuccuuccuucuucccuuccuucccuuacuccucauucccuuccuuccuuguagaauucuucccuauuuucuuucuucugucccucuaccccucccucucucgcuuccuaccuuccugcacccuuuccuccuucuuucuuuccaucuaaaaaacauucugaaguguugacugggugcaagcacguuugagguuagggcaggaucugacagcauacugguuucucuaauacacuguggauuuguccuuccucaccuuuuuaaaaccucccuucaggauauucaucccuuuaccugacgcuaaaucucagauaugugaaacauuuuacuucaucccgaaaaauaaaauuuaccuguuguuuauacauuuuauaucauaaucucaucugaauaugcauaauaggaugcagaaagucuaaaauauaaggauauuauucaauugaaugaguuuuuuuuuuaaagcaugaauagacugaaaauaugugugggggucgccuuuuuuccgguccucucacuuuuaaguuaauaagcuauuaucuaauggagucucuuucauuaaccaagguuuuucuugauauguuuauguuaaagaucauuuuuagaaaacagacauuguaauuuuauauuuuucuucauguuaauuuuuacuuuugaguacauuuauaaaaaucauugauauuuuuauuuuuccagcuuuuugcugcuuuuaguugcaacaaagaaacuggcuuuaaaauggugugacaucauuugcuccagucuguggcuuuuugcggccccuccugggauucucuugcaaguuggcaacauuagcagcugcccagguguuacaguggggaguuucaugccacuccugacucacccgccacugcucacguauacccauucacucagccaacacacaucuauuaaaacccauacacacuagcuagagaaacaguaguucaugaaacacacgcagaaugugcccacaugaaguuuauaaucugguaccaaaucacgaauuuguguucauuuuaacuucugauuaacuuucaaaucccuucccuuuguaaccaaagcacccgucaucucuugccugagcagggacagguuuauccuguccuagcuugcucccccccccaacccucaccaacacuaaaacacaacccugaucaucucccucggcuuuaaaucuucugugguucucauuuccugcagcaguggucuucaaacaugcuugauggcggcccuuccagacuaaaauguucaagcaaaugccugagauauguuuauguacuuauauguuauguguacauguauguacccacauaauauuauguauauauauaugcacuaauauacaugugcauuacaaaagguacauaccccaaaacaauuuuuaagaugaugucaaauauaaaauucuauuuaacugccagaaaaucuuuuaacucuugcugaaaaauuaauauuuaugauuuuaugauuauauaacuuuuuaaaaucccaggaauguaucacgcaaagaguuuguacuggggauagaaaugucggcuguaugagguugugguuguuuuugucugugcuuuguguuuguguauggauguguguguuuuauagagagagagaaagagagagacaaucugucuaauauuacauuuggcccuugaacaacacagggguuagggaugcuaaccuccugggcaguugaaaauccaugugcacauuuugacuccccaaaaacuuaacuacugauagucugcuguugaccagaagccaccggguagcauaaacagucgauuaacgcauauuuuguauauguacuauauguuauauucuuauaaugaaguaagcuagagaaaagaacauguuauuuuaaaaagcauauaauuggauuauuuguaacacaaaggauaaaugucugaggggcuggauaccccaucuuccaugauguaauuaguaugcauaguaugccuguaucaaaauaucucauguaccccauaaauacauacaccuacuauguaccuacaaaaauuaaaaaauuagaaaaagaaacuguaaaagccauaaggaagagaaaauauauuugcuauucauuaagaggaaguggaugauuaaaguuugcauccucacuguuuucaccuuaacuaggccgaggaagaggaggaggaugagggggaguuggucuugucucaggggcagcagaggcggaagauaauccaugcauuucaaaccaauguuguucaaagggcaacuguagccucaaucuggguuuuuuagaaaucucauaaaaccacuugucauuuucugaggguuuguugauuacaacuagauaauacaaccugcauguccauuacacauucgcauauaaacugcagugagcaugguacccacgcacaaagaagcaagcagggagggcagcacugucagcugcccuggggccugagcccugaaccucgccuccugacaguguuuuuccugaaugggacacauggcuguccaccgugcagaucacaguagagccacagagcuuguuucacacuauuugagagacagauacaaguagaaguguauguaauuuuuuucuacuccccaggagauuaccuuguacuugauacuaaacaggacccuuugugauuuaauuugacuucugccuuuucuccagucucuucugcuaucaccuuuuguucauaauuuaacaacauucucuuuugcuuuuccuggcccacuaucccuuucuacucacuuucuaauauaccuugaaugccuuuuccuccaucaucccacacuuccuuuuccuggugaacuccuauuuaucccuaaauaccuuucagagcuuggccccacccacacucauccuagagugagccaggugccccucuuauauaaccccugcaugcuucgugccuaucuauagcuacauuuaccaucuugcauugucuacuucuaaauuugucuacuucuaaaucugucucccucacuugagugagagcccccugagaaaagagaguauaucucauuuaucuuucuaugcccagggccuggaagaguucuguguguucuaagaugucuaguaaaucaauaaauuuguuaauuacuugagauaauggcugugugccugcaguaggcagaaaugucaucuguguagcuguaauaauuaugauaaucccuccaugguuaugcuggcagaaucaucaucugugucaauuuaguucaaugccagagguauuuauugagcuccugcucaaugucuagcuugggaacaguacuguggaaacugcagagaagcaggaucugggcuuucagaggucuaguuagggaggaaagcccagcauguacucaucugagcauuuaguacagguuucucgggcaccugaaugcuaugcuaugcauaacaggcaguggggaugagcaaugagcaaaacagacaaaaucccuguagagcuugcaucuuagugggagaaauaaaaguauacuaggucagacggugauaagugcuaugaagaaaagugagacaagguaaagaaguuggagagugacuagggauggaggggguucaguuuuaguaaugcggguaauggucagggguaggcuucacggagguaagggagcuugcuguggggaugucuggcggaagagucugagccagagggauacugugaaugcaaagacccugaggcagggguaucuuuggcuugcuguggagcagcaagaaguccaacaugccucagaggcuuggcugggaggggcaggggcaggagaggaggccagagcaauggagaggcccagccaagggaggccuugggggugguuccaggaacccuaucuugcacucacucugagugcaaugcagcagaggaggguugagaucugaccuaggauuuagcaagcggagaguggacuacacagggucagggccaugugugcagaggaucugcagugaggaggcuccuguaagaagauauagagagaugaugagacaccucucuugggucaggguagcaguggugaaggaagugacacaugguauguuucugaauauauuuugaagguaguguuggccagauuugcuaaucgaugagguucaggacaagaugcaagcugaaaaugcuacagcaucugcaguguguguugugugggccccccgagggccugguguccccugcguguacacuugauccuucuguguaaccccauuguaguccuacuguggcugugacuucccuuuuucuacucagucucaaggauggagagaagagaugggagaugcaucuuucccuacaugcacaugcaccgacucaaaccuucuccauccuucucuuuuguuccauaaauuaguuugucuaaguagcuuuucaaguugaauguuguuguucugguuucucacuauuaauauuuaauuuagaggcacuuugcauaauuuaucuuuaaaucauaaugaaugcauauaauaauaaacagugaugugauuuauaugaaauauuuaccuggguuuuaucacagaauauuggauuugcucaccacuuuaucuucagggcuuaaaauggucugggcacucaagaaguuuucuguugaaugaauggauugugauguauuacaaaugcaaaucuaaauuuucucuuaauuaaggcaauguauaaagcuuguauaugaagugaugucuaauaaccauucagaauugucuucaaguauagcaaauuuaaagccauuuucccuugaucacuaaaaaauauugaagucauaucaauugagagauauuuugcugauuugcauuguuaaagugaugcuuuaacgguuauugccuuuucauucauuucuucauucuugaagaaccauuguguaaaugugcaaagcauauugaguugagaggaaauggagccauuuaagcuuaaugauauugccaugagacaaaguacuaugguguuuucagcuguaacaucauaauccaauccaaguacaacaaagcuaauuaaaacugguuuugacagucaucuguagaauuuucuaagcaaucaccuauguuuucuuugaguuauguucuguguuuucuuugaguuuaggugcugagugugacaccuaaugauggcuuugcuaaaguccauuauggcuucauccugaaggcacagaacaaaauugcugagagcaucccauauuuaaagguaaugcucacugcuucuccucuccuuucaucuuucaaguccuucgaguuauugggacacacuugcuuauuccuuguagauugauugcaugcacugcugaguauuuucauccucaggauguccacccucagaccaugacauucauaagcagcgugggccuccacuguaaccaaaagugucagaugucaggauaccaaccacuugagcagagaugauuuggaaaauauuuuauuuuaaaauuuauaaaacugaaguuguuauuaguuuuuaaauaaauggcaaaggcagacaaaauuagugauacuuuaaauauuuuuaaauaaagacaauaggccgggugugguggcucaugccuguaaucccagcacuuuggguggccaagguggguggucaccugaggucaggaguucgagaccagccuggccaacauggugaaucccugucucuacuaaaaauacaaaaaugagccuggugugguggugugcaccuguaaucccagcuacuugggaggcugaagcaugagaaucacuugaacccaggagacguuggagaagucuggagaacccaggagaacccuggagaaguugcacaccagccugggcaacagagugaaacugugucucaaaaaauuaauaaauaaauaaauaaaauauauauauacacauauguauuaaauauagacaaugcauuauauguuccuuuuacaaguuaauuauauauuuacuguacucagaauaguacucuuaacuacccacacaaaguuagguaacaaauacuggcugaaaaggucauugcucaaaauauucaaauuaaaauaugccuuuuuucucauaucuaauuaaauccucaucaauucagcagaaucacaggugguguagaccagggcuucccaguagaauuuucugcugugggccaggugcaguggcucccaccuguaagcccaacacuuuuggagaccaaggugggagaaucacuugaggauaagaguuugagaccagccuaggcaaccuagugagauucccaucucuacagaaaauucuaaaaaucaaccagaugugguggcacaugccuguggucccagcuacucaggcccaggaggucgaggcugcauugagcugugaaugcauuacugcccuccagcgugagcgacagacugagacccugucucuaaaaaauguguauaauauuaaaaaaacaaacaaacaaaaaaaacagagcaagacccagucucuaaaaaaaaagaauuuucuacugugauggaaauguuuuuuaucuguguucuccaauaugauggccacuggccacauguggccauugagcaccugaaauguggccacugggacugaggaagugaauuuuucauuuuauuuuaauuuagcaguaauguguggcuagcagcuaccauauuggacauagcuaauuagauagcuguaggcuuuuuuuuuaaguaucaauauauuccacuuuuaugaucucuuucuuucacaugacuuaaaucagagaucccaaauaguaacccacugauugcaaauagcuugcauguuuuauuuggcuggcaugguucuauuaaaaaccauuuuaauugcuugccuuauuugagaaucugagcauuuuuauauaauuaugcagacuucuaguuucucuugaaacgucauaucuggcucacuucccugcacacagacaagcagugauccccccuugggauggggcugucccuggaccccugucaagcacuucauauuuccugccagggcccugugggcauguggguuucugugauuuaaagugucuccuuacauuuccuuugacauaggauggcuuacugguacucugccugcuucagagauagggaaagcaagagcuggccuggucaguuaucaagcaaggacacuugaguguuggucaauuagaagcccucgccacagcucccuuccucuccugagugaugaugccuuucccauucuaucgugcagcuugcucauuuccaacauuauguaaauacaauuucuuccuagugaaagauaauaggcuucuugugaagaggccucaaggaugcagauuuuuagaaagaaguccuugacauuuacauauuuuuaacuuuuguccuucugcuuuucuaaacgcauucuguugcuuuaauauuuucucuuuucucuuuguggggacgggaaugggguucaucaaucucaauuucaguccuugugugagaaaucagagaauuagguaaauguuuuagaauagggauuuguuuaauaaaaauuacauuuuuaaagauucaaauuggcuuuaauucuccuguauguuuuguaaaaaaaaaaaaaaucauuaaaagguaaggacacauuuguuuugaauggaaagaaauaaugcucgcaguuggacugccaucacuucaaacaugagcaguuaaacauuuugguuuaggaauaaaaagccucuagaugacauauggucagauuuggagagcaaaauaaauguaagagcuauccagccagagaaauucuucaaaauauugaaauaugauuguucccacacagaagguacacaaaguaucauacuaauuuugugggccauuccacagugaauuaaugaugaaugcauuguuaaauuuagcuuuaugaccuccuuuuguuuuggcauugcaaauguugaccaguaaccucauucccaaaguuuaauauggagauauauuuuucugguuuuuagguuuucauacgaugugccauaagaaaagcuauguaaaucaauuaauggaaucugguauuuaauuauuuuacccauacuaacacuguccuuucuacaggaaggaauagaauccggagauccuggcacugaugaugggagauuuuauuuccaccugggggaugccaugcagaggguugggaacaaagagguaauggguauaugaauuucugauucucucuaacagaggauggaguugggagaauaauuauuucuaggaaaguuagaauucaaaaaauauuuugagugugaacuuucgaaagcagugauauaaacuauuuaguuacuuaaacuaucuuuggaacaacccaacaacuccagcuuaacccuuuaaagaauuuuugggauuuggcuuuuauaguuucuuucaagaaaucagcuaaguaaucacaaaagcaaucucuaaguugguacaugucuguguauguuuuugucuguguguaucugugugugugugucuguguguguacagagagauagaaauugccuuggaaaaguauuuuuuaaauuuugaaaugaagagaugucacugaaauaauuuaaauuuuuagaaauauuuuaacaguuugacuagauucauuuuuguuuuauuuuggacuuuuaaaaguaguucuuuuuagaaugaagucuuuaucagcugauuccuaaucacacagauccuaaugguuaguuguguaacuuauccucugaaauauuuaauaccaaguuuaagacgaacauuguggugauaguaaugauagggauugacacaaaaaauguaguagcuaaaaaaguuccauguuuccuuuguaaugguuaccuuuuucugaguacagugucugcuucuauaaccauaacauugucucauuaaucaugacaucgcaugcuauaaauuucaaaacucugucacagucuaccaugauuuacgauuuaugcagcccugcuggauggcaaagcccuccuuuccuguccugcuuuauugcaggggugagagcugggcucuccuuagagucaguggauaaaaggguaaagugagacacugaaucuuuguaaccauugcaucccauguauguaauaaagugacaucuaaggauaauacagcuucagguuucuaaaauuaguaagaacauggaaucaucuggggaauugaggguucagagaagugaagggguuugugauaacguaauugucugcuaggaacaugaaccaaucuggagguacuagagguucagauaauugacaauuuuugauuuauacaugucuauuuaucuguaccuuucccccucuaaccuaccagucaacugaaauggaaugagauauuagaauuaaagagaaagaugggagaagaaauugcugauuaguaguccuuuuugcaucgcauuuuucuuuuagauguaaucacucagaacuccuuugaaugagagggauaagaaagauuuugcuacaacaucuaacacuggauaaauguucaugucugacuacuguaaauguaaucaucacuaauuaauuuaucuuugaacauuucagaguccagggcaaagacagaugaaagaagccuaugauuuaucucacaucuuagaugaaaacagccguuacuucaagggcaaaaaguucauuacuauacacuuguuaagggcuugggauuugaacguaugggacuguucuaccaacuuaauuaucaugaauaugcaaagaacagcacaguucuugaauuuaaaaaguucagaaggauucguucuuacaggagaacagaaacaaaccuguagaaacuccauguuaguauauucccagcauuagguguugagucugacuuggcugucgugcucugaguuugcaugucaggaaguaaacaccuuucacguuuuuaugccuagagcacugcuccaacucugaaagaggauggaucugcaaaaagcaaagccacagccucugugcugcagagacugacaagaaaauggguugugaggaaaauuuuucuaagugguccguuuaguaugggcaggaagacgggggacaaaccaugagggucugcagcaauucagauagcaguucucgguauucccauaacuuccaaauccacguucuagcuagauuuagucuccuucuccaaguccccauucucaugucuacugccagcucagugucccacacgauggcacagagacaacuuacuugucuuucucuaaaccguuuuuccuccuagguuccuucucucauucaaugauauucccgucuucccaggaucaagauuugagugagcuugagcuccucccucuccuccuuacuccagucuagucagggccagcuauggagaucugguuuucucauguuuuuggcaucccccucacccucccucuugcucagucagugcuaacuccugucuuugucaacugcguccucaaugauagcugugagaaccuggauguuguuucuugcuuggucucaguuuauuucaagccacccuaugcucaaaaagccuaccaugcaaaauaacauaacauucuguuugcacgcgauagcauuuacaauccuuaggcaaguugcagccagcucuucucaccagaagugugucucucaggccucacuggacagugggcuccaggcagaacauaccccagcuggggccacuuaugacagcccauuccacagauguggccugggcuuuucugggauccagucaucugacauacuuucugucucugucucucucucucucucucucucuuucucuuauguguguguguguguguguguguguguauguacaugugcauaaaaaccauacauagcaacgauuggaagaaaguagagacaacauugauauaaaauauauuuaacuucuuaaauguggcccaggggcucuuacugccccugugucccagggccuccuacugucuauuuuaauauuccuaauugcugauuagacaggaaaauugcugaucagacaggaaauaguagagaaauuuucaggggauucuaacuugaucuuugauuuuauagcaauuuuuuauuguaaaguaguuuagguuuuuuuuaaaaagcacucuagcugaauucauuggguccccugugucacauauuauuaaaggugauuuuuaaaaauuucugauauaucacuuucacaauuuuguuucuccuaaaauuuauaugacaggagagugaaaaauugaguccuacuugaugcaggauuacuuacuuugagugucagaaaagaccuuauagauaguuuaaacaugcuguuguaacuugcccagacaucuagcaugucgagggcuaauuaaaggccggaacuaaaaucuaaggcuuccaacucuugaacuacagcuauaauguuugcuguuuuuauuuuucuacaauaacuucuuuucucacuauucuagcaauacacuuuauccuuaaaaugaauugugaugacucaaaaauggacugucagauuuuugaaaaaacaaucuguuguccuuaguauuauuguucacuuuugcccugaaaagcauaggaaguaaaauccuaaauuuuaguuggacaaaaauaaccacaauagucaaauuaauuucagagauauaugcuauuuuuuaaaaaaauuagauaacaauuagccauuuuaacuuucuaguuuuuaaaggaauucuggcuacaacuuacauguauuguaaggaaaauauuuaagaaugauuuguauaugcauucuuaguuucagauauuaauaaaaaagauaacuaaauaagaaaaucauuuuucauaguguuugcuaaaugauauaaauaggaggagaguagaauaaguugccaggagccccaaaugcuaguucagaagauuuagccuuuauaaaccuuaguuucaacauuuguaaaauggagauauuugggguuauuggaaaaaucaaaugagauaacacauucaaagaaaguagucaauguaaaguguuacugaaaauaugaggugauauugcuaucccccuucagucuccuaaugagggaaaauuugaaaaguuaacauuuuuuacaucuaaaguguaucuggugauuuacaaagaagauauucaaguuacuaugaaaugcuuauuuuuauuuaucaaaaauacauuugaauuaucucuguaaaaguaaucauuagaucagguuugcaguaguggaggggauaauauuaaguguaccauuagaaagccuuccauucaaaagacaauggaacaugcauggugcaggaagugggcagggcuccuuggagagcauauggugagggcaucauuuaaaggagccauaaagagcgucaugcuccguagccagcugucccugaaaaggcuagucuuggaggcaaguaguaucauguugcagcuagccuaaagccacacauguuaucccuuauggcagaaaaaaauauauauuaugaacaaaaauuccuucuuuaaaaaucuaaaaugggcuaucacuguauuuauugcccacucagaauaauuuuucccuucugucuacuuaauuuaauggaggguuugcacucugacgccuuggugugaccuucuuaaauguggacauggaaaguacaugugaaaagaagcugcuuuuauuuuagcauucugauucaguaaaugcaaauaucuuugaagaaauuauuaaaaucauaaucuuuuucuaauggaaauagaaaauagaaaaggcccuuuggugucuuauuuauucauucaaaaaauaagugcucgacucccugcuggacacucgagggagaccaaaauguguagggcaugaauccacuauccagagagacugcagccuaagggggaaaagaaaauguacauguucauuauacaaauaggucauaaucagaaacccagugaaauaacaauauuuucaccagauuucaacagauuugaguaccuagcaguaagcucuuuauuuaaaugugucaaaguaauaccuuauuuuuaauguuuucaauuuuaaaauuaauaaaaaugcucuguugaaggaacaguuuggagcacauucuuucuguuccuucaggcauauaagugguaugagcuugggcacaagagaggacacuuugcaucugucuggcaacgcucacucuacaaugugaauggacugaaagcacagccuugguggaccccaaaagaaacgggcuacacagaguuaguaaagguaaguauaacuuagacaucauccucaccagaucuuugucuauuuccuccucaaaaucagaaaauguuuaucauaaaaaggaaugucagggaagagauagauuuuauuucuagugacauuugcaaaauauaauggaaaaagaauugucaucucauuaaccaaaaguuucauuuagaugaugaagggaauuugugcggaacuuaggaguucucaaccuuuuuggccuuaggacccucuuauacucuuaaaaauuauugacuaccccaaggaauguggcuuacaucuaccaauauaaucauuagacauuaaaagugaaagaaaauuauauauauauuuaugaauuauuuaaaaauaauaaccucauaacaugucaguauaaauaacuuuuuaaaaaaauuauauuuucaaaacagaaaauguagugagaagauuggaauuguuuuguauuuuuacaaaucuuuuuagagucuggauuaauagacaacaggagaauccucacaugugcuucacacauguaccuguuagagcugugauguccuaccucauguagcuucuggaaaacucuacugugugcccagaaaagaaugaaaagagcacauaauaucuuuguauuauuaagaaaguaguuuugaucuugcagagccccuaaaagggucuagagaacucucagauguccuugaaacacacuuugagaaccacuggcccugcaacuauggagagaaaacgcaguuauaaauauuguuagaaaaugcuguggcagaaaauguuguagcauuuggagaaacuaagugauucuaaauagcuauaaaaauaauuggaagguuuuauauuaguagguuaaaccugaacuuuaacggucucuacuuggugacuuugguagggacuggucagaaguuuacuuuugcuuugguaagcccccucuucuuagacagucauaaaaugagacucacaguuaauuaacucauaguuccaaucauguuguuuucuacucaaaauguaaaaacuucauguaucuuacagguuagauggcuucaggguuuugaccucagacucuaauugcuauuuguacaugguuuauauaagaaaauauauucugauguucaaacaauugauuuuacaugugcaagaagcagggaugaagaggaagagugacaaaauauugauaauguuagaaucuggcugauggauauguggagguuugucauacuguucuuucuuccuuuagguauauguugaaauuuuucauaauuuuucuuuuaaguaacaucuaaaauaaacuguaucuauaagacuuacaagacuucacugauuaauuuggucuacuuggggaaaagagguuuucauguacuuagauuaugucuuacuugacuguguuuauucuguaugucauuauaaaagcauacuuuauaaucuucauaauccaauuguaaaauaggcugccauugguuagccuuugaauauuuuauagcucagggaaccauggcauggugacaauuaauacagauugauuuuuuaaaguuccauauccagauuagaaauagcacaagaacaacaucuuccuugauaggucggcuacauuuagcacugucggguuuuuuuguuuuguuuuguuuuugucaaauuucacccucccucagauuggaucccaucgaacucuucugauucugcuuuacuaucuuuuauucaugaucucuuugugaguucauuucucuacuguaccuuuugggauccuuucaaauucaaaacacggaaaugcaauucaaaccuggcuuaaacaacaagaaauguuacugauugacauagcuggaagccuagcaguagggcagacuucggggcaguauaaucaagggaagauguucuuggcucugcacuuccuccuuggucagcuuuguccuugugcuggcugacugcaggauggcugccagcagccacuggaagagagggggagagagugacauugcugagcuaccaccccagccguaaauggccuucuggaaaccuccuggcagacccucuucuauuggugggaaccaugucucaugggcacucacaguuacaagggagucugaaacaccagauggcuggcaacagucugaggcagccagcuuccaggaggagagaggguguaccucucuaucaucuaaggaccaguaaucuuuccuuucagucuuauugagccaauuuaagucagauuuccacucuagaugaauuacuggcagggggauaugagauuauucuuaaaccaacagaucaaacccuacagccagaaaaggauuaguuuccucuaaaucaaauaaaugguuuaucuggaggaagguggacgcucaaagucagacuuuuguuaagaagaaagaagcaugauugauugugugaaggcagucuacuaugggcugacauggacccaaacauuguucuuugcuuucuuuucucuuuuucuugccauucauuuucuaagaaaucuucuccacugugguuuaacugcugugaaaauucuaccaaagcuauguuccccaaauggacuucucacucuuucuauucuauguucagcucuauuaaaacauuaacauucggugugaacauuaacucaccacguaaccccuugguuaauaucguuuuccagcuuuccaguuuuggucagugucuuaguaguccauuuaagcugcuguaacaaaaugccauaaacucgguggcuuauaaacaauagaaauuuacuuugaggaaguccaagacuaagguguuagcagauucagugucuggugaaggccugcuuccugguuuguagauggugcuuucuuguugugucuucacaugauggaaaagagaaggcagcucucugaggcuuuuuuuauaaggacaauaaucuuacuugccuaaaucaccucccaaaggccccacuuccuaacaccaucacauuagugauuagauuucaacauaugaauuugggggacacaaacguucagaccacagcagucagugauucagcuuuagucugccuuuaucucuuaccacugcccuuuaccauccucauuccagacaaaauucuuccaacagaccuucccauacgguagcccucuuuccuggaggacucuuucuuuaccucuuucuguuuuccuucucucauauauccuucacagccaauuccuuuuuauccuucagauguuagagaaauugucacuucuucuaggaauaucaguccuuugcauaaagccaaaagcccuuuauacuuucuuuuuaaauagcacacuauauucuaaagucucuuaguucucugagauugugucuucuaagaugacagggaccaugucucuaauacaugauggguucucaaaaauuagguucauuguaugaccuucuauaaacuuucuuuucucuaguuuuuucauaaauauguuagaagcuccagggauuuaaaaauguuacuacugagcauuucuuacauauaagaaguugcaacaguugguauccuugguuuuuccugaaugugaggaaaauucucccuuacugcacugcaccaggagaggaaggccuagagagaaagaaaauuaucucuaccugcuauuuuaggagcaagggacaaagguauucauuuucuugaaauuguuacugcuuaagaaagaaggauauuuagaauguucucaguuccugaugaaaccucaagcauuuaauugcuuauaaaacauuguguaaugaggcagaacaucagaauggcagagggaaugucuucauaaaucuaccccuccacaaaagcacugagaaaaauuguuaaaaucaacuucuuuagaacucuguacauuagcaaagacauacaacaauuagaggaauauuuauugaaggaaaaagugcugaaccugaauaagaauagcaggguuuguggggugguaauuuuaacugcucccaaccauucuuccccaguuccaggguagccuugaaaacuggcaaucucaaaacacuagagcagugaaaaccauagcuuuccaggcacuaguggggccacaucacauuuuuaguaccucacaaauuuccauacccagagcauugucaccauuuuaaaccucucucuuucuaccuggaaagcugcauucucaggacauuguuguuauuuguccucacuugcaagaaaagcucuauucccaggcuauuagucaaaacaauuauuggcagguauuuuuuuuaacauuacaagugcccagagcaacuacagguaaggcuacaggcaauagagauuucacaaaauuaauccagaaagucaguaaacaaacaaauagugacaacgauaacaaaaaugaacaacaacgaauuuuaugagagggaccgaacugauuuccagaauugccacauuguauuaucuaaaaacuguccaguuucaacaaaaauuauaugacacacaaagaaauaggaaaguauauacaugcacagaaaagcaugcagucaauagaaacugccugugaggggcccugaugcugaacuuacuaaacaaaggcuucaagucagcuaucgucaguauguuuuaauaacuaaagaaaacuaugucuaaagacuuaaaagaaauuauuacaaugacgucuccccaaauagagaauuccaaugaagagacagaaauuauaaaaaagaacuaaacagauaaucuggagucauaaaguacaauaucuuaaguuaaaaaacucacuaggggggcucaacaccagauuuaagcugguaaaagaaauaaucaacaaauuuggaaauagguucuuuaagauuauccaugcuaaggaacagaagaaaaagagaaugaagaaaacaaccuauggagcacgaucaaguguaccagcauaugcauaauggaauccucaggggaagaaagagagguggcagaaggacuguuugaaaaaauaauggccagaaauccuccagauuagauaaaaagcauuaaucuacacaucugagaagcucaaugaauuauaaggaggauaaacucagaaacauaccuagacacaucacagucaaauugccaaauuuaaaauuuauuuucacuuucauuuuauuuuuucaaauucuaaucucaaauugacaaucaaauaaaaugagauucuugaaagcacacagagaaagaggacuuauugcacaaaaggaaccuuccuuuuaagaugaacagccaacuugucaucagaaaccauagaggagagaaggcaaugaaugacauucaaauacugaaaggaaaagacugccaaccaagaauucuauaucuagcaaaauuaagacauuuccagauauauaaaaacugggagaaguuaaugcuagccaauauuucuugcucuacaauagauauuaaaggcaguucuuuagauugacauaaaaagauaccagaugguaauacaaauccacaugaagaaaaaaaaagagcaucacuaaagauaguggguaaacauaaaagggauaauauauguguuuuuauuaguuuuuucuucuaucuuauuccaaaaccaaugcauaaagcaauaaauguaauauguauuguuuguggacuuauagcauagaaagauguaauuuguaugauaauagugcaaaggaggaaggggaaaagauuuauguuggagcaaaauuucuguaugcccuugaaauuauguuagcaauaaauugaaauugauuguuuuaauuaaagguauuaauucuagugcccagggcaaccacuaagaaaauaacucaaaaaaguaggguaaaauuaacaacaagguaauuaaauggcacacuaguaaauaucuaucuguuguaaaggaaggcaguaauggaggaacagaggaacaacaacagcaacaaaaaggacauuaaaaaugaauaacaagauggcagacuuuaucagcaauuacauuaaauguaaggacaugaaauacugcaaucaaaaaguacagauuaacaaaauagauuuuuaaaaagugauccaauucagguccacaugaaacauuaaccaggaaagacuauacacuaggccauaaaacaagccccaacaaauuuagaagcacugaaaucauacaaagcauguuuacugaccacaaaggaaugaaauuaggaaccaucaacuaaaagcucuccuuguccucaaaaucuguuugcuugccaguaccccacuacugcugucaaaguuacugacuucugcuuauauaucuuguguccuuuuccuuuuugauaucaaguauuuuauuaaaauucuuauuuccuugggcuuuuuucuuucagcccugccugucuuaaacucugcuuuauuuaagaagaaaagcaagaucagagugugaaucauagaauucucagugcauggaaucucaguguguguggcaucucaugguuacaacuccaugcugugugauuguacuuugagaacuauauuugcaggaauguuaauuuaugacuuaaaaaaaaaguaacgucaggaugaccacuugacaguagugacugugacauuaagagagcugcugugugcagaaacccagaguucauugaccguuuaguugacagacccuggaacaucaagauauucuucuauuguaauuuucaaauuacagaauugaauauuaugagucauggaacaucacccaaguauugacgucuuaaaguggaaacccucuagauuuaguagcugcaacauuuggccaaaauacuuuuagaauaauuacccagauuuuggcccuugagugacuuuuaacuaccaugaauagggcauuucccuuuuuuuuuagacggagucucacucuguugcccaggcuggagugcaguggcgcaaucucagcucgcugcaagcuccgccucgcggguucacgcuauucuccugccuuagccucccaaguagcugggacuacaggugcccaccaccaugcccggcuaauuuuuuuuuuaauaugaauuauaucuuuacucuuauaaaagucauguugaauaaauaaauucuaucuuuuaaaauacaaaaccauuauauugccuuaacucuaauuuuuuguauuuuuuaguagagacgggguuuccccuuguuaaccaggauggucucgaucuccugaccucgugauccgcccaccucggccuuccaaagugcugggauuacaggugugagccaccgugcccggccucucauuucccuuucuuaauuuuuuuuucaauucuuauuuuuaaaauuauaaagauggcguuucaccaugaugcccaggcugguuuagaacuccugagcucaagcgauccacccaccuccgccuccuaaagugcuaggauuacaggcaugaaccacugcgccuggccugauagcacauuuucauucaacuuacuucuugcucuacauuacagugagagauagagugcaguuuuccugaaggcaggggacagugcucaguaaaaugcaucauauguguuuuccccuuugguugaauuucuguaugcccuugaaauuauguuagcauuaaacugaaauaguccauucuugcaucgcuauaaagaaauaccugagacugguauuaguccauucuugcauugcuauaaagaaauaccugagacuggguaguuuauaaagaaaaaagguuuaauuggcucacgguucugcaggcuguauaggaagcaugguggcaucugcuucuagggaggccacaggaagcuuucaaucacaggacgcuuacauggcagcaugaacaggagcaagagagcuggggcaggugagguguuacauacauguaaacgaccagaucuccaagaacucauucacuaucacgaggacaguaccaagagcgaugguacugaaccguugaugagaaaucacccccaugguccaaucuccucccaccaggccccaccucuaacacugaggauuacaauuaacaugagauuaugagauuuggauggggacauacauccaaacaauaucaccccucauuguguaaauauaauuuggcagcucuagcacuaggaguguggagaggcuauucaacucaaggaaaacauuagugaaaaauauuccaguagaguuuucucuuuucagcuuauuuuccuuaaaauugaguagguuguugcccaaaucacaacuaucaaagcaccaagugccuugggcuuauuuaacauagaaauugaaacaaaaauggauuaaaaucuuugcuaggguaaaaauagaaaagauguccuauaguuagagaaaagccauuaaagcuuaagaguuuugcucuucccuuuucgggauuaacuauuugauccacacuaauuuagauguaaacacacauucauagaaaacacuauaguaacauugaaaauaaacaaccaauagcaacucaaaacuguuagaguagguagcucgucaggcauaagcagcgcaggagagggacagacacacacacacacacacacacacacacacacacacacacaccccagaaguguuaggugaccaucacaugauggucaggcgguuguuaacuuuucucuaaaguaauaauuggucacagccggcaccagggaaaggcagucuccuaauagauagaaaacaccugaaacugaucagcagcuucccaguaaggucucaggaguggggagaaguaacgcaagauccuggaaguauaaccccaagccgagaggucaagcagggcauuugaucucucagccugcuuggcccucauccaggugugcuuuccuuccuuccuuucuuuacuguucuaaagcuuuuuaacaaacuuucacuccugcucuaaaauuugccucggucucuccugcuuuaugccccucagucgaauucauccuucugaggaggaaagaauugagguugcugcagacccauacagaaaacuaccgcugauaacaaaaacuauaauuuuaaauauauauauauuuugagauggagucucacucugucgcccagucuggggugcaguggagugaucuugguucacugcaaccuccgcccuccggguucaagcgauucucaugccucuaccucccaaguggcugggauuacaggcgccugccaccacgccuggcuaauuuuuguauuuuuaguagagacggguuucaccauguuggccaagcuggucucaaacuccggaccucaggugauccgucuaccuuggccuccuaaagugcuggaauuacaggcaugagccaccacaccuggccuaaaauauauuuuuuguauuuguuucuccugcugucuaacucugcauucaucacugagaaaaaggaaaacugcauucuuuucccaguuuuucagcgcagcugcuuggauauaaacacauccaaacagcaucauaaauaaguuuugugauccaaaauagcaucauauauaaguuugccuuucuucauauuguaguuuuauuacagcuggaagagugcccaguaauauuuugccagugaugugacauagugcauuggaaugauugauuagaauagcacucugucacuuuccuucacacuguggcuuuuauuaauuaagaaauccauuguguaugaaugacuucgccuagacaaaaauaagacuuacacagcacuaaauuagugguucagcauuucuuucuuuguaauuaaauacuugaauguuuucacuggacugcuuuugaaaugaaauaauuugagaaagcaaaaaugucagauuuauaguggaauuaagcuguaaauuaagaggauuaauaauuuauauaauuuacuuuuauguaaaaguaaauauaguaucaagaaguacugaaagcaauuucuuaagauuaacauaauagcuuagucuuaucuuucuaaaucaaacuuuaaacuguuuggguuucgaugacacuuucacugaagaugucaacaaaacaacaauuggaguguggaguuugauaauuacaugauuuaacggugaacuuuuuaaaagggcuccauaauuagaaacagauuuguuuugcugucagcucugacacuuugggcaaguccuuuuacccaucugagccuguuuuuuuguuguuuuuuguuuuuuuaucucuaaauucaaaauaauuaccucagcuccucuucucccgugacguuuugguaaggcuuaaaacacaaaacaaaaugaagccuuccaucauggauguuccugugugcuauuuagauaugagcccuuaauaagaguccacacggcugaggcuauaggguggccuaugaugccaauuauggcagcagagcaaaggaacacaguguuuuauauucuuugaguuauuucauacaaagaggcuuuuuuuuucugaaagcaaaaucagugaguuuuuauuauuugucaaugugggagaaaaaaaaagaccuacaaauuggcuuucucucugacccucuuugggaacuuacagcacaacguuugauauuucagaauaauugcaaacuauaccucuagguugguacuccauuugggguucuaaaaugucuaauucaguaggucaugauuugucucaauaugcuacacagauagaugucuuaaauaugcauaugcccuuugggaggcugaggcaggaggaucacuugaggccagaaguaagaaccagccugggcaacauagcaagaccuguugcuacaaaauaauaauaauaauaauaaauuagccaggcaugguggugugcaccuguagucccaacuauuugggaugcugaggcaggaagauuucuugagcccagagguuugaagcuggagugaguuaugauugugccacugcccuccagccuggguaacagaucaagacccugucucuuagaaaaaaugugcauaugcacauacacauuauaggcaauuuguuuaucucuuugucaagaaauuuguugcuuauauacacauaaaguuucagcugccugagauuagugacuguggggcugcuacucuagcaucacucaggaugucccuuagugcacuguuuccagcugguaggugggacaugaagucagcuccccaucuucccuuuaccuucucugacugauagggcggacuggcuucccugccugucugagccaauauaugaggaauaugguucuccucugccaucugaguccuugaagcccucaggcugguuguuuguccuggcaaccuggauuaucuuuucuccuuccucucaggugaagcaauccuuuuucucucacucacuagaacgagcaaaagucauuucuccaagacucuccugucaccccagugcuagcuaggugccucauguuauccuuuuccuucagcaaggaugaugagaggcugaauucacagucaguagccagacuauauguaaaaauagaauuuugacccacaaccugcaguaaccugcccaggaaaccaaucccuuaucuaugauaaacagcccaggaaaccagcaugcuauaagucagacuugcaggaagccagacuucuguaucuaguaacaauccagggagcuacacaaucaauucuguaacaaucagaauagccccaaauagccaggauuugauuaauaacugaaggcuucccugaauuuuguccacaguuccaacguaagcccaaccagagagagccaaauaugcacccuccucuaaucacauaggauguccugcuucuaguuagccacuucuagcuuccuuaggccaacagcccccacucagagcaugccugaagccuucucuuccuauuauaaagcuuuccuacuccucugccugccuuuagagugucugccaaaacacaagugacaguggcugacucccuugcuguagcaagcuuagaauaaauaggcuuugcauuucucacuucauugacuuuuauuuccacaauaagaaaugucaccuguugguugggugcgguggcucacgccuguaaucacagcacuuugggaggcugaggugggcagaucaugaggucaggagaucgagaccauccuggcuaacauggugaaaccccaucucuacuaaaaauacaaaaaauuagccaggcaugguggcgggcaccuguaaucccagcuacuugggaggcugaggcaggagaauugcuugaaccugcgaggcagagguugcagcaagccaagagcaugccacuacacuccagccugggugacagagugagacucuugucucaaaaaaaaaaaaaaaaaaagucaccuguuuucuuuuaucuguauauucacacuugaaaaacaaggagaucuaaucaaaguguauuaggaccagugagagauuacacuuuaaugcuaguaauuuccuuagcgguguuguuagaaguauugcaaagagaauuugcugcaauagcauuacagucccaugguguuugauguaauaaccucgucucagcacccagggggauccccgccauccugggauguuguuucuaaggcagauuacacugcuacucgucuuaucauguuuagaguauaggcauguuuugacuaaaauuuaagcaagcugauuuuaucucuuaaaaauaagauacauaauuccucaaauaauaacuaaugacaagcauauucuuaaccaauuagauaaaauuuaguacacaguauacuaaugcaccauuguuaucaauucauucuaacuccaauuuaauacacagacuuugccaagaauagccuuucacagcaucccuuuccucaauuuagagucagaaacuuucaaggaauguauaaaacucugggacuuuucucaauuuccagugucuguuuucucgaugccucuuuuucuuaacagcuagucacaaacaguuacuaaccuaaucuugcuuauguuacacugaacccuaagaguuguuuuguucacauguuaaaaacagcucuuccugcauuucuucaaaacuguguuuuauuuugcuccugcgaauuuaccuuuuccuauguugaugugaauauauucuugauccccuuccaucugcuguuugcuuuuguagcuagagcuuuuucaaacuugaagcuauauaaguguuaugggcugaacuguugcuucccacaauuccuacucugaaauucuacuccccacgaccucagaaugugacuguauuaagagacuguguuugggucuuuaaagagauagugaaguuaaaaagaggccauuaggguggaccguaguccaauuugauugguguccuuauaagaagaggaacuuuggaaacaaagagagacacccaggaugcauguccgccaaggaaaugccacaugcagacagugagaaguuggcccucuguaagcccaggagagagcccucgaaagaaaccaaacuugcugaccuuggucuugaacuucuagccuccagaacugugagaacagaaauuucuguuguuuaaaccacccagugauacuuuguuauggcugcccuugcaaauuaccauuagugacuuuccuucguaaaucccguuacugaaauguguacuaacugccucagcaaaaacuuuucucggaaugguccuauuuucccacauacaagaaaauauuuaaagcucagaccaauuaugauugauuagaacaaaauuaaaaugguuuaggucaaaccucaaguaucacuuguaucaucaucugagugugucaugggauugaggauauacuaacuaagugaugcaaggaaaguguauaggccaagaggcaaaaagaaaccaggucaacaagaaaucaauauauggauuagcagaguuugauucaaaauguaaaauaugcugauacuuuuuuuuuuacuuucuacugcauaucucuagcauguggaauaucauuacuuugaguuugaugaucucuuaaaaacgaauuugaaagacuaauaagggguuuugccggcuaauaggauuuucuuucuaagcaucacuagaugguuggauuacauauuacaagauuugacuagucuaggagaaaaggagguaaaaguaaagaaagaaaauucaauuauuagagauauauagaaaauaugagugggcugggcaugguggcucacgccuguaaucccagcacuuugggaggccaaggcgggcggaucaccugagguagggcauucaagaccagccugaccaacauggagaaaccccaucucuauuaaaaauacaaaauuagcugggcaugguggugcaugccuguaaucccagcuacacaggaggcugaggcaggagaauuacuugaucccgggaggcagagguuguggugagccgagaucgcgccauuguacucuagccugggcaacaagagcaaaacucugucucaaaaaaauaaagagucaagaaggauuaaacaaacugagcacaugcauuuaauagcaccccccaccugaaaccucacuuaaaugacaauacaagaauaaaauggcacaaauuguauuuuuuaaagggagacaauagcagaugaacagugucagcguguaauuuugaaaguggaaaacagaaguagaugauuuggcagaucuaagacagcagaaacuguagcaauuacagagaagcuuccaaagaagaaauucaaggcaccugguacuacagcaauucaagaaacugcauggccucagagaauagacuuaucuacgcugacauuuuaggauccccaauuaaaaaacaaacaaacuggcuugacaaugcacccaacauggaggccugucagacacaggcucugcccuuucacaagauguccaauuguagucucaauuuuauaggacugacagccaaggaucacgaaacauuaaggagauuuuuaacacgaaagaugaacaaaacaaaaagaaugauguagcuugugggaaaucgagaaaauguagggaacaaaagaaaaacaaaauaauaccucuaauauacucagagcaauaagagaagauguguaucuguaaaacaaguaugggauacuguaaaaaggaagaauugaagacccagaaagggcucucagaaauuaaaaagugugauuugcagaaauaagaauuuaaagcaguauuagaagcuaaguuaaggaaaucucccagaaggaaaaacaaaaaggcaaagauggaagauagaaaacauaggaugauuagaggcucaauuuaacauagcugacauucagauaaaaagaguuccagggagaauaggcaaaaaaaaaaaaagaagaagaaaugaagaaaugaauaauauuagaagauaguucagaauagaaaaaaugugaguuuucagguugaagggugccacugaguacccugccuuuacauuaaggcauauugccaugaaauuucaagaaacaggaaagaaagagaaggucuuaaaauccucaucaucaucauagcuauacuugcauauagugcaagcacuuuucacacauuuaauucuuaaagggccucuugagaaaagcuuuauaaacuaaggcacagagauaaguaauuugccccaaaucacacagcaaauaaguggcagagucagaucuccaaacaugcagucuggcuccaaauuuuauaccccuaaacacuauacuauccugacuccuauaaagcuucuagagaaggaaggauaggaagagggagaaucuaaaagucaucagguuuccaacagcaacacuaaaaguuauaauguaauggacuaauccuuucaaaauuauaaaaagacauuccucuuggcaauaauuuuguggauaugacauggaaagcacagacaacaaaagcaaaaaugaacaagugggacuacagcaaacuaaaaaguuucugcacagcaaaagaaacaauaaaaugaaaaagcaaucuauggaacaggagaaaguauuugcaaaccauauaucugauaagggguuaauaaccaaaauauagaaggaacuaaugcaacucaauggcaaaaaaacugaauaacccaauuuaaaaauuggcaaagggccuaaguagacauuuuuucaaagaccugcaaauggccaacagguauaugaaaaugugcucaacaucacuauucaucagagaaaugcgaaucaaaaggacagugagauaucaccucauaccuguuaggauggcuauuaugaaaaaaaugagguaacaaguguugaugaggaugcaaagaaaagggaacacauguacacuguugguggaaauguaaauuggugccauaauggaaaaccauguggagguuccucaaaaaauuaaaaauagaauuauuauacaauucaacaguccuacucuaauuauauaucuaauggaaaugaagucaguaacucaaagagguaucugcacccccguguuuauuacagcauuauuuacuauagucaagauauggaaacaaccugaaugucuaucaacaggcaaaugaagaaaaacuuuaguauauaaacacaaugggauauuauucagccuuuaaaaagaaggauauccugccacaugcaacaacaugaaugaaucuggaggacauuaugcuaagugaaguaagccagauauagaaagacaaacacuguaugauaucacuuauauguggcaucuaaaaaagucaaacucauagaagcagagaauagagcagugguugccugggaguggggagugggagaaauggggacauguugguugaagaguacaaacuuucaguuauaagauguauaucaacucauugauauauauugcccuuugccuuguucacuuugaauauauucaaucucugucaacuauacauuuuuaaaauaaaaauaguaucacacuagauaacaagaaaaaaauuauaaaacaaaauuauuuacuaacuaaauaaauuuacaaccuaaauaccuaaccauacacacucaaaccuucaaucagguauaagagcuugagacacuuucagaauucaauuuuaccugugguguguccuuccucaggaauaacuagaauccaguaauuagggagcccaguaccaggcagaggccaaggggaguuccauggccaucaucaucuagcaaauucagacaguaacugauccagaucagagcaaggcaaauggcugcgggaggguuaucuucagaaaaagagaaaaagcaagaaaguaaucaauuuauaauguuuuuggcaaaagguagaauaaaagcaucaagggauuuaauagcacucuuucagaguuagugaagaaauaguaugaagugcauuacaaaauaaagccaaugaaaaggggacagaaaaaaaaugcugcaugugacaugaaguguaaucauuacaacucaaguaugaaugauaccugauugucauacuauuauaaaaccugaaugugaauuugcacugauaugaaagauuugugaaauuaacuguauuacaaggauggagaaggaagacauuaaauuguuuaauuguuaaccuucuauaauagaugagugauaaugccucaaauuaauaaaucaagaauagcaauauaacaggcuauuuagauauaagcagguuaacaacagaagaaauauuuuaaauaauuagccgggaguuauacugaggauuggggaagaguuggagaagagacugcaauucucauuauaagaccuguaguaauauuugacuuuaaaaaauguguauuuuuuaauugaacaaaaacauuaguaagaaaaauaguuaaauaaaaaugaguuaggcuuuaguuugcuucucaaaagaaagacuuucugcaggaagucaauuuuaagagaagauuuuaaaaauaggacuuaauuugauguuacagagaaaaguacagcauccagguggcaugagcaggcugucuggggagaugaggaaacugcuccuaacuggaugcaggucugggauucaggagagcuggggcaggaugugggauucaugaggucagaacugggaaggccauuuauagaugccuagagugaaaaauauagcuaagguguaacuggugaggcacaugcugagauggcuuuaugaagccaugugcugccguagaaagaaucaaaccugugcuuucuaaagucucuuuugccacaagaagaaaugggaauuagaaacuggugucuuucgggcaaccaacugaauacugaugcaauuaguuucucuuucaguuuuaugaaauagaugaguuuagagucaagggaguaauauuucagaagaggcuuuuaaaaauguaggcauugccugcuguuugugagccuucagguuuucuguuggaauuuccuaaaaacuggauuauuugccauugaagacaagugggugguauuaguguagagaaaauucauauucucucucccucucccucucuucugcacacacauacgcugauauggucugaauguuugugucucccccacauucaucuauugaaauuugacucccaaggugauaguauuaagagguggggcuuugggugaugauuaugccuuaagggcaaaacauucaugaaugagauuagugcccuuacaaaagaguccccagagaguuugguugucccauccaccauuugucgaggcagcuagaagguaccaucuaugaaccagaaaguggcccucaccagaauugaaucugccuacaucuugaguuugaacuucucauacuccagaacugugggaaauaaauaucuguuauuuauaaucuacccaguuuaugguauuuuguuuuuguccugaauagacauacacaugccgaguguaauuaggauugaucuuuaauuuccucuaaccaugugaauauuauauuacgugauuccuugguuugugcuuaaaaacagcauucuuaggucccaucccggauuuccccccagugccccuaaaggccccugguuugucuuuccaaaguuggaaaacgccuucaaacacaugucaucagguuuaacuggugggauuuuuugguucccucaguuuuccccauuugccaaagauguugaacugucuugguggcaugcccucugcagggcgcucaccagggagcauguugcucucuaagcaccuugcaagugcuccugaccaguacccacagucacagguacccaguaaaucucugagaccaggaggcugggguaccucgcaauugcucuuuugcucgaggggagcagggccccuugaguccacugcagccugaaaucccugugccuaaaugugaccuucucuaauugaggaggagauaguacagagggguuuuggcaccaccugugcugaccaccagacugugggauuuaggcucauuaaccacacaaggagucauuucaucaucccuaaacugaagaaauuucagcuagauuaacaguaugguuccuucccaauguaaaauucuguaagaaaguauugaacucaaaagagaaaauaagcgacuguuuuauaaucaaaauggacuagauaguacugaguuaguaguacuaguuaggacugagaaugucugguggcauauuagggcauguguucagagagacccuucugcaccaguuugccccuuuugagcacgagucugucauccaguacaugugugccacauauaacaaggaaaagccaaaacauuucuuaaaaaauuauuacuauucacgaaaaguaccuuggcaacacuucccaggggaggcugugggugaaggggcaggaagggcaauguuucauauauaaaagauagucuauucuuaaguaaaaaauguuaaauuauauugagugaugcaaucacuuuaacauuuuucccuagggcuuugugcccuauuuuuaguaacaaaagaucagcuguuuccaaccaugccccuaaaucagcuuuaaagaaauaaaagaaucuucuaaaauaucaggagggaauaaaggaauagguuguccuuauaaggcaccaauaaccucauuugaaaaguaauuuuauguguuagaggagcaauucuucccuugucugugugucaauuuaacaagaauguaacagauuuaucuagcaacuuaaacaagugacaauauccagagugaguguuggcaauugaggugcauuugggaagaugugaacauacagcgaaauccuagggugcauuuuuuucuuuuccauggucuugggguuuuuuacaaaaugguuguaugcucucaaucuguggaucugacaaaguaagggcuuuugaaugucucuuuauugaaaugcgaucuuugcccuguucuucaugaacugcccacuugggaugaaguaauauggaaccuaguugguggaacagagcccuaaacauggauaaaugaccaggacaacgccaagcugggcaaugguaguagcagguguagauguggucaaacuaugcccccaguuggcaaacaagaugaacucccucuggcucaaaaguuaaaagcagaacuaagaggccaugucaaggugaggaggcagucacgcucucuguguccuuggaagguguuucagaauuuguuuuucugcaaccaagucaaagaacaguuuuugaaaacaacuacaacuggaaauuccuccaucugaccaccaacaagaccaccuagcaccaacaagccaaccaaccaccuggaaccagccaauuaaccaccagagacuggugaucuggggcugaaaggccauccagccaacauucuuccuugcucccaacacuccucaccugcccugcccugcaguuuuggccuuugucaucuccuuccccccgccacccuuccugggaguguacuuuccaaagcugcaucucccuaaucugcagauugcuuuugaaaaauaaaguucuccuuuggccuccccacaucucauuggucuuccguuaacaauauuaacacaaauuaaugcauacauaucauaaaauuauaaaaucaaccaaaaucucuuucuugcccuagaauauuuuaauagcuaguguuuucaugugauauaaaaaguauucccuuguuuggcuggggcuggcaccauguuuccacauaaaucucugucuauaucacagccuucuggcucugcagccauccugauuccauaucaccuucuuauguggaaucaugaguuuauaaagcaggacuugguaaaaagacacucuacacauuaucucgugcuuugcucuaaccaauaauugaucauuuugcuugaccaauucaaaugauagagaaccaugauuuacaaagaaacucaaucaaucuuuagaauauucuacugguuuuccauuuuuccauaaaaaucuguuuuuugguuuguaaccuauuaguucuagucccaugcucuugagucacugaaaauagaucugccccugauucuuguugaaaucagcuaacauguuccucccuguccaugaaucuauauacucaacuauuucauccauuucucauagaacacagaaaugauugaaauuauuaacauuucaaaauucugguguaucuguacagcuuugucucuguccugaaguaggaaagcuguuuuuaugcuugucuccugauggaaauccaucuuaguuugcugcucagauccucaccuuugccuucuccccuacccacccuacugucccccaccucccacuccuaaucaacacccagugugauggugcagauugcccagaggaucuuccacaggaucuaccgucaccugccccuccacuccuagucucuacuggucauaagcucccuuucuggcaggggcuaaggcucccucacaaaugagaagucaaggaaauauuuuuguuuggcugaauucuaaacacuagugcauuuauuuguuuugguuugcuguuaauguuauauaucaaaaauccuccaguggauacucuucugauauguugaauguuuaacuuauauugaccaucuuuaauggcaucuuugugaggaacucuguugaaaggugaaauuacgucugugauuucuguuccaguuuagaggcuggagugucacauggaaguuauuacaguguacugauguaaucugaucaacaagaucaguacucuucuuagguugugguuucaaaaaaaagucuuuaggcaaaacagauuguggagaggguuauucugugaaguuucuaggaguuauugaaauuguuauguuauaaaaacuuuugguuuggaaaagucaugagauuugggguuuuuauagcugugacaagaagucccagaggaaauugaaauauaagcaaucuagauaaggcaaagaauuaguuccuuucugagacgaaccucaaaaaaaacaagagucauuaugaggugcuccaccaggcccuuuuucaguccaguaaagccagaaucuucccucuagucuuuagaaagaaacuggaaguuaauccgagaugaaggccuugcagugauggauaaagccaaaggucucuuccugccugaggaugaaaaccugagggaaaaaggggacuggagccaguucacgcuguggcagcaaggugaguuucugacuucuagaugguucucugcagcccaaaccugaugggaaguggguacugacaagagucuucuggugaugcuucccagagcugggauucccaggcuuaaacgaggggcccaaaaaaaccuagauuuuugaaauccauucauuguuuuugaaaacuacaucugagcccuuauuuguauguguccagguauauugcuguguguguauauccauguguguauuuggauaaauauucaugaauaguguucugauuuuucuggucuuuccuguugaaugauguguuacugacuguaacccuacuguguaggcauaacugaaaaaucuagcagguguuaucaguguauuagaaaguuaugucccugagcaucauuugcuccuauaaaauggaggugacguugcauggcaaaaugauaucaacacggaugaugguaaaaaugguaacacaccagcugguaaaaaugguaacacaccagagugacaagacaauaauaacugcugucucagcucuucaggaauaggaaguggcucauacugaacuucauauuuuuuuagcuuaacccagguacaggcacacauauggagcuccagcguguguguaugugugugugugugcguguguguguguuuucagugaauugauauauucaucuaucuuuaaaaugaggagcauuuaagacuccaauuuucuccuugaaaaguggaguuagccuggauuaacaauaacuauauaaaaguaaauuuauuuugaagacuaaacagcacgugcugcauaucuucagcuacagaaaacaaauucagauuguaauaugcaucuaauuuacacuaaaggacaaauaaggacagugguuuaucucaauuaugcuuucagaaugguuucuauguaagaauaagaggaacuacuuuaguaauguuuucagggauacuuccaucuaaagagagagaaccauaaagaaaagugucuauccacuuuuugccaacaagaauuuuuuaaauggagcuauacaauccauauuugggcaauaugcuaauuuaccucugacaugucacuaagaugaguccauucuauuggcacuuauguguucaccuuguacuuugauuccauuaacauccuuaugcaucacagaaccuacugggccuccuagagcaaugcuucagaauagcaggcauccuagcacuaauuucuagaaacuguaguuucugccaaaaaaaaaaaaaaguauuugauaaaauuaauaugcaaaguauuauaggauauaaaaagcauuaagcaagaaagaaaauaaauuauggagucaauaauguuguuggagguaacauuuugucuucuacauuuucacauagguggaauauaccugauuuuccaugaacuacuuaacuucuuagaauguguuuuacuuucuuaguaucuuuguuaaauucuuauucccauugaauggaauuuacauguucuuucuuucucuuucuuacaugugauagaauugugucuacccuguuguuuaaaaaacucauaaaauuauuucucacuuacaugauuaugauuauauuuucuaauuccugaauuuguauuuucucuuccuucuccuguucuuuuuuguuuuguuuuauuuuucuuuuaaauauuuugauuggaauuccuuaguaaauuuauuuucauucuuucuuauuaauaauagcauuuaaagcuaugcacugaccuacaguuacagguuuggauguauucccuacacuguaauauaugguauuuuuaccugaguuauuuucaaaaaaagacugcauuucugcccugguuuccacauugacuuaaaaugaucuauauguauaugugccugugugugauugagcauguguuuuccaaucuguuguaguugcuucaacauugauugauugauuggcaggaucuugcucucuugcccagguuggcgugcaauggugcaauccuagcucauuacagcuccaacuccuggccucaagcaauucuccucccaaguagcuaggacuacaugugugcgucuacauaccuggcuaauuuuuaaauguuuuuauagagauagggucucacuauauugcccaggcuggucuugaacuccuuggcuucaagugacccucuuaccuuggccucccaaaaugcugagauuacagguauaagccacuccacucagccugcuucaaauuuuaaaacugaauuucuaguuuuauuuuauugucauaaagggauaaaauucacauaguuucccuuuuaggaagauuuuuuaaaguucuuuauggucuuugguuugugauuccaugcuucuagugggggaauccaguaacuauuuucuagaaacaaauucauaguuuaaagaauaaauuuggggcucggugugguggcucaugacuguaaucccaacacuuugggaggccgaggcaggcagaucauuugaggucaggaguucaagacaagcuugaccaacacggugaaaccccaucucugccaaaaagacaaaaaauuagcugggcauaguggcacgugccuguaauuccagcuacucgggaggcugagguaggagaaucacuugaacccaggaggcagagauugcagugagccgagaucaugccacugcacuccagccugggcaacagagcgagacugucaaaaaaaaaaaaaaaaagaaagaaagaaagaaaauaauaagugugauggcaaguacuaucguagcuuaugcugaagcaggauggcauccaugucaggugcugugguucagaaauagaggagaagaauucuggaguggaagggacaggggcggacgucauagggagggaggugagugaccaguuugcuuagccacauugagaacucagauucagagaaaaaggugaugaauaucuggcucaguaaagauuuagccguugucuaguuagcaaaucaugcugcuggguagucgaaugccuaaggcugaugcuggaaguuuugggaaguaaaauuacgguaggucucuucuauggacugaacuguguaccccgcaaaauucauauguugaagcccuaacccccagugugacuguauuuggugauagggccuuuaaggagauaguuaagauuaaaugaggucauaaggaugaggcccugacccaauauaacugauucccugauaagaagcggaagaaacacuggguguguuagucuguucucacacugcuaugaagaaacacuagguaauuuauaccaaaaagagguuuaauugacacauaauuccacaugacuggggaggccucaggaaacuuacaaucaugguggaaggcaccucuucacaggacagcaggagagagaauaaguaccaagugaagggggaagccccuuauaaaaccaucagaucucgugagaacuaacucacuaucaugagaacaggauggggaaaaccacccccaugauucaguuaucuccaccuggucccucccaugacacauggggauuaugggaacuauaauucaagaugagauuuggguggggaugcagccaaaccauaucacuagggaugagaaaaugacgugugaggacacaagaagaagguggccaccuaggagccaagaaaagaggccucaggagaaaccaagccuggccacaccuuaauuuuggacuuucagccuccagaacugugagaaaauacacuucuguuguuuaagccacucagucugugguauuugcuuguggcagcccuagcgaacugauacaguauccaaguaguuucauuaggacugaacuauguuuuuuuaaaggacuggcuuuuuagaguugaaggaaaaaaccagaaucagcaaauauaaauaaugauuuuguuccccaaaaauaacuuuuuaaauuguuaugugaauauuauggaacgucuauuuugcucuuaucuuaauaagugccaccaacagugauuaaaauaugccacacaugugcagucauuuuuuucuuccagagcccaugggaaaggugcuaacugaccccaacagccuuucugaauaagcugaggcugaaccucuaaguccuucucaacgcaguguucuagguggcugcuagcaacugaucagaauugucaugcaagauggaaccuguuguugccccagaagcagagccuugaaauuuauaaaagauacaacccaggauaucaguuccaugaauagcccucacaaaguauauucauguguaagaagugauaaauuuaaaugauucuuccagauuugcauuggcuguuagaucucuuucuagagcuauuuucccaaagaagcaagguuuauuacuucuugaggguuaguuuaacgcuggugagaaauaaucaaacgacaacaaagccacagugaguugcagaugcugggcauuccucuucaggcugaguuaacugguuugcuccugcacagcugccuucuaacuuacaaugcaacaaaaugagaaauuaugcuuuaaagcauaggcuuuggaaaccaacaauccuagguuagaguccuggaugcaccgcuuguuagcugugugaugugugcaugucccugaaucucugagcuucaaaucccucaucugaaaaauggcaaauagugccucaaguaugggguuguuacuaggaucagugagcacuagaugaaagacuuggcacaguuauccaauauaugauaguaauauuauauuuuuauggucuaacaauagcacaugauguaauaacaguaguggagagguggucucuggucugguuaagagcaugaacacuggguccagucuggcugaauugaaauuccugcucugcuguucgcuaugugaccccucuguggcucaauugccuuucuauaaaauacaacacuaauugagccuucuuaugacauguuguagacaucaaaugaggcacucucaucaugcagagugguuccuggccugucgugagcaucaaggaacugccguugcauuccuuggacccucaugaucagacgugaagaguuaaaaugaccagugacagugcaugaaugcccagagucuacugcacagagaaucuggguuuacagaccagaaagauaaaugugucuaaagagcuagagguguucucuaauuccuugaaaaucucagggacacaacccauuugguuacccauucaucaccugucauucagguaaggcacaucuguucuccagguagcacaugcucagccaccuggugcuugugagaacuccaggccaccuaugguuguuccccaagccaccaguuucacuuaacugcugccuggacagcacagagcucagaauuggggacuccugccaagcagccccaggcccugcauaccagaagacuuggaaagcccaggcucaaaaacacuuuacggugacucguagguuuauguaauauucacccaaacugacauuuauuguucauuuggggaacuccauuaauaacuaaaaauagcaauuaacauuuuauucaauuaagagccaaaaagguuacuuagaaaaagcuaaguuguuuucuaaaacauugagcuccauuugauuggggugaauaccuuuuaguugcguuuuuuguaacucuuauuuuauucucaguaugugauuaucuuaggacacaauuaacauuaauuaaauaaaauuaaacucagcuuuagauguagcagucucuuuuaggaaucuugaauagggaauuaaaaugucucugacuuuuaaaaaucccauuguuuuacucccccguuagagcagaugacauuguguacauucugagcacaucuucccuaauaagcaggggcuuuauagaguguaaagaaauuugcauaguucaggauacuuaaaugacaugucccagaaucugugcucuugacaguuaaucauagaauauguccccucucaaagacgccuucuucauuuaaauccuauucuuuaucaucauauaaaggaugaucuggauauggaaaagacauugaaguccaauaaaaauaguguuuuggcaacuaauauaguccuagaaaugcauuucuaaguuagaaauauaauauaagcuauuuuccuucuuuaggggauguauuaguuuccuguggcugguguaacaaauuaccacaaaacuuaauagcuuaaaacacagacacauuuauuaucuuauaguucuagaggucagaagucuacaauagaucacacugagcuaaaauacaagugucaccagggcuguauucccucuggagucuccagcuucuagaggcugcccacauuccccggcuuguggcccccuuccaucuucagagccagcaguggccagucaagucuuucucauacuguaucacucugacacuuacucaucugccuccucccacauuuaaggaugcugugauuaccuugggcccauccagguaaucuuggauaaucucccuauuuuaaugugagcugauaagaaaucucagugccacuuacagccuuaauucccucuugcaugaaagacaacauauucacagguuaugggaugaggguauggacaucuuuugggagcuaacuauuauuuuuccugucacaggggaaaaaauaaguacaguuggccuuugaacaacgugaauuugaauguuauggguccgcuuauguaagaauuuuugucaauauauuggaaauuuuuuugagauuuguggcaaucugaaaaaaauuugcagaugaaccuuauagccuggaaauauuuuuuaaaauuaagaaaaauuagguaugucaugaaugcaugaaauauauauagguacuaaucuauuguaucauuuacuauauauauacaaaucuauuauaaagaaauaaaauuuaucaacauaugcauggaagcacuuacagaccauacauagcaccauucauagucaagagaaauguaaacaaacaugaagaugcaguguuaaaucauaacuccauuaaauuaacuguaguacagauuauacuacuguaauaauuucauagcugcuuccuguugcuauucggcaagcucaaguguuuucaguaucugcuuaaaauaccaugugauacugucgucuccaugugagcaguuccucucucugguaaauugcauaucacggugaaaaguggucucuuaugguucuuguguauuuuuccuuguguuuaaugcaaugcugcaaaccucgaauaacaccaugggaccuauacaaagagcaacuaaugaugauggacacgcugccaagaagcagagaaaagucaugacccuacaagaaaaaguugaauugauugauauguacuguagauuaaggucuguaccuguaguugcaggccauuucagacauucaauucaucuuguaaacagaugauguaaacuuaugguaucgauaaaauaccguacaguacuguaaaaguauuuucucuuccuuauuauuuucuuaauaccauuuucuuuuuuucagcuuacuuuaguguaagacuauaguauagaauacauauaacauacaaaauauguuaaucaacuauuuaugauauaggguaaggcuuccagucaacaguaggcuauuaguuguuaaguuuuuggggagucaaaacuuaacaugcauggaggaucgaagccccuaaucccuguguuauucaaggucaaaggccuuuaaccugugucuugucuguuagacauucuuagucaaauaguccaacaccgagugaagaauuuggaucccugcucugccagucacuaccuauuggagcaagacacgucuucuuuauugauaaauuuuuauuuauuuccaauaagccuuuugcauuccuacuucaucuucucauguuuacucaaucuucucauuccugcagugaggaugacauauagcucucaccucaucuaaaugggauaaguuuaagcuuuacugugauuuguuuccaacaauuauguuauuuauucuaggaagaagaaaugaaaaugccugcaaaggagcuccuaaaaccuguaccuuacuagaaaaguuccccgagacaacaggaugcagaagaggacagguaccaagagugucgugcuggggagaauacaauuaauuguuaggaauaagggcguguugaccuuuacaaagaaaugguuguuuccuuuggcccaaugaaugccucuuuuuacaugcccuuuuuacugaaacauaauuuuaugugguugacgucagaauugaggguggaaaauguucaguguuuauagcuuuguggaaaaugugagugcuuauuuuuaguuccuucacaaagaaauaagacuugaauauaaauauuaaaucuuacaaaggcucuaauccaaacugacaguaauuuuguacugucaccuuaacuuagcaguuccuccacaccuugauaaauggcugaauggagugucauguuuucuaugcagaucaaauauuccaucaugcaccccgggacucacguguggccgcacacagggcccacaaacugcaggcuccgaaugcaccugggcuuggugauucccaaggaaggcugcaagauucgaugugccaacgagaccaaguauggguccucuguuauccgucauauccgucaccucagaggaugagaguuuguuacaacacaguuguguuccuuuggauuacuuaucuucuuuuguagcugaaguagacuggagcaaagugauauuaauccaaacucuuaagucuauaucccuucuuggugcuuucuauuagccuggagacauugcccagcucuagggcugcccuccuccauuauuucucggcagaguacuuaucuaguugaggagcugccuuguuucucucucuggguagacagaugugcauucagagucagccaacaugcauugagcccugcagauguuaugcauugugcuuccugcuuugcaacuugacuuauucaugacuacaagaaguaccccuaacugaagaacucaccccaugauauuuauacguuuugauauagaggagaugguauggugcaauggaagcuggcugccuuuuucaaaucccagcucuaacaccuaaccuguguaaccuuggcuaguuacuuaaucccuucaaacaucagccuucuugcuuauaaaauuggcagugauaacaucuacuuugcaggguuguuguauggauuaacuggaauaaugccuauaaggugcucaguccauguucugguaucagucgggacgugaugaauguuagaucuccucucccucccuugcguguuacuuuccuaauccugacauguuuauucaugaucuuuugaacaaaccauacuugcucuggcuucuguaccuaugaugcugauaaucucugucccuagaaugcccgucuuuucaccuguccaaaauaaaccuauuacuaagauccaauuuaguuuuauaaaaauagaaccucucagaguauauauccucaguaaucccauuccuaucuucuauuacucuuuauucauuaauauauauuacccuuaucuccauagcaagcuguauguaagcuccuggagaucagaaagcaaguuauuguugucuuacacauuucuuauuguucuuaguagaggucugaguggaggaugaguguucaggggucugcagaauugucuauuugauuauuggcagauaacugcccugggcagcccauggugcugugggaaauucagagaugacucagaaggggccguccucuucugaggacaccuagcaaggugugucugcucaggaagauaacacaagauugaaggccaccguggucauagaagagguacuacagauggccucucuacagauaagcuaaaaauacuacagauggcuccaugagcaggagccucaccugcucacagacacucaacuugcagaguggugguuuuuaaagacaagaaggauucggacauugaaagcuaaagagggguauucuggaacaguauccauuaaaggcacagaggccaaaaauuauggccacauaugaagaauauugaauaauaauucagcagccagcaguguaugguacauaaagaauaagguugcaaagugaaagagucuuuuagaaacuaaaucauaggaggcuuugaaucccaaacuaaugggaucagaccuuuguuaggaaguuacuguggaacccaugggugaauccuauggggacagugggaagaacaauuagcaggcugucacagcagcccacccaaaagauaaacagagcuggaauugggaugcuggaaagaaauggagacuagagagcagaugcaagaggugacucuugaaugugugauacaggaauggggcauccaagaugcugcugcaauugcagucuuuggacaguggaggguggcgaugcuugagcaaaccuugggaauuugggaggcaugaggcaaguucaaggaaaggaagaugaauuuagugcuuauguauuuuauuuaguugcuauuggaacacacuuguagaaccauccaggagguggcuggaaauagagaccuggcacucaggggagaagguaagucuagagauaaagauuugagagucagacuuaucaggaacuucuagaggaagcuugagacaaucgaaggaugacagaaaugaaaagguuccaugaaaacaucuguauuuagaagacggaaggaggaaggagaaccaagaaggaaauggggcaagaaaggcaaaaucggguagaccaggaggaggaaucagggaucacuggacaggcagaaguuucuucaggcauggaaugaaucuugucuuacacugggaacucgguuugggucuucagggucucucugccaaagugaaaaggagcagggacacauuggaggaugcaaggaauucagagaggagguuggagaaugcuggagcaggcagagauugacaagguaacuccuuggagaucacaugagagcaugaggcaguggagauggagaagagcacccagccucaugccucagugcuucuuaggcuuuuacagccuauuuguucuuucaccagcucacuugcucucucccucaccuccuaccuccuauuuuuucucucucccucccucccucccuucuuuccuuccuccucccucccuucuuuccuuucugccugccugccucccucucucccucccuccuucccucccuguccacccgccuccugccucccugccuuccugccuuccuccuucucuucuauauucugcuuguagauacuuggaacaaaaucacuagagaaaaauccacuuaggaccaggcaaggugguucaugccuauaaucccagaacuuugggugcccaaggcaggaggauugcuugaggccaggaguucaagaccagccugagcaacacaguaagacccugucuccacaaaaacaaguuuuuuuguuuuuguuuuguuuuguuuuugagacagagucucgcucugucgcccaggcuggaguacaauggggcgaucucggcucacugcaagcucugccucccagguucacacuauuuuccugccucagccucccaaguagcugggacuacaggcacccgccaccacaccuggcuaauuuucuguauuuuuaguagagacgggguuucaccguguuagccaggauggucucgaucuccugaccuugugaucugccugggccucccaaaauucugggauuacaggcaugagccaccacgcucagccacagaaacaacuuuuaaaaaauugcccaggaguucaaggcugcagugagcugugauuacaccacugcacuccagccugggugacagcaagacccugucuaaaauuaaaaaaaaaaaaaaucuacuuaggcauaggcagggagaggaagagagauggaacugagccuagucuucaguagccugaugcagaaagagaaagccaagauuggaagaauggguguggcagccaagaaugggagcagguggauggugccaggaggcuuagcacaaagucacagagggcuuaagaugcauguugggcaugguggcaugggccuccaguggcugaggcaggaggaucaccagagcccagaaguuugaggcugcagugagccaugacugcgccacugcacuccaacaaacauagugagaccccaucucuuuaaaaaaacaaaaaaacaaaugcaggagugaugcugggagaccugccucaggagcacauuuguaggugcauuccccaccccaggcucccagcaaacaccuuguguccaugcuugauaaagaaaacaaccaccaaccccuccccuaaagcuuaaaacauaauuagguuaaccaucuucaccuagcagaggcagaggaggguuagaaggaccacuccagccuacucagaggggggucuugaaugagaauauuaacuuggcagccccucaguuucugcugagguaaaacacaaccuacuuugugugacaggauggagcugcugauaauaauaauuugcagacgauguauuuugcaaauccacagugauuauuuaaaagugcuugcaacucaccugccuauuguugggccagggagacugcaaugcuucuguccucuccucccugaagaguugcugagcacagggguccuucugccucaccaugacugcuggucagcagcccuucuccacguucuuuuuauuuuaccagcuuuauguuguguuacauucucauccuuaauauuucuuaauucaagggugguugaguugggcuuagcacuucauuacaaaauagugcuuuucauaagagaaaugggucaauuaaagugcugugcaaugcuuccagugaaaagagcuagaaaucugauaguagacaguuuauaaacucugaggacagaaagagucuaguaugaaaucuggaaguucugugcuaugauuguagaaguacuuuuggcauggaaagaaaaacacacaugccaagaaaucaguuuccuugugcuagccaaaggcagcaauuuuucagacugucucaacuucuaaaagaggagguuaucuguagcaauuuguacauuguucuuuucagguauuaauaaucggauuaagauuuccaccaguguguauacuguuuaaauauuccaucccugcaaagcguagcauagcucucugaggaugaacuggcagguaugcagcccuuaccacuguaaaugaaauuauuauuucaaauuaauaaaugccuucugauuagaaaacugauacacgucccucacacauaauuuguauaacacagagaagcucaauaaaaauguauuguuuuaucccaauacccagagcuauugccaggugcuucucaaugucuauauauguguauugaugauaaugaugauaguaauaauauacauuguuccaaaauuauaucugugucaaacacagcucuaagcacucuacauacguuaacugauucaugcuuauggcaauccuguauaauuaggauuauuaaaauuccuguuuuacaguggaggagacugaaguauaaagauaaguaacuugccugaggcugacauuuauauauguuuccuaaggcugccacaacaaauuaucacaaacugaaugacuuacaacaacagaaauguauuauuucgugguucuggaggccaaaguauaaaauuaggguguuggcaggguuguuccuucuggaggcucuaagggagaaucuguuccccuguccuagcuucuggcugcuggcagcccuugguguucuuugguuuauagacacgucacuucagucccugccucuguguucacauugcuuucucccugagucuucuccucuuuucuuuucuaagaacauuuaucauuggauuuagggccuacccuaauccagguugaucucaucucaaaauccuuaacuuaauucaaucugcaaagaucuuuuuuccaaaucaggugauagucucagguuccagauggaucuaucguuuuuagcagggaagggggacagggcggcuuauggggacauucagcccacuacaauauuaguaguggguucagucccaggcauucuggcuugaaaguuuguguucuagacaugaucacauagccuugcuugggcuuuuuggauuuuguuguaguuuauaaaauuaggaucaugcuguacuuauaaggugaucacuucaaaugcuggguuuuguuuccagacaaguagagaaagcagcugggaguuucccuuucugggccuucuguucaugucaccucagggggaccaugcuuuguggucuguaaaauaagcucguuagagccgggugugguggcucacaccuguaaucccaguacuuugggaagccgaggcaggcggaucacuugaggucaggaguucaagaccagccugaccaacauggugaaacccagucucuacuaaaaauacaaaaauuagccgggcaugguggcuaaugccuguaaucccagcuacuugggaggcugaagcaggagaaucacuugaauaauggagguggagguugcagugagcugagaucacaccauugaacuccagccugggugacaagagugaaacuucaucucaaaaagaaagauaagcucauuagcaauuuugauccggagcugaguaaaccugagucaggggauaaacauguccccagcaagugggaauuaauuauuauacucaggagguggcugaguuugugagcuuugaaugaucccagagagaaauucauucuucugaaucuccaagggcauuccacaaugugcuggaacugugcuaagagaaggaaccgugaccuuggagcucuccugcagauucagcauuauugccugccaauuacuagccugaaauguugaacaagacugauagguugucaggaaagcacacaucuacauuagcgucacuuagcgacagacugaaaaaaugaauuggcaaucaaucauuuaauccuauagaauucuauauugcuguagaaauaauggccuuccuccauagaccucaaguauuuuauaacauauauuuucauucauuucucaagguuccaauuaggaagauugugugaaagucaugcuaaaauauuaacaguaagagagacuuaauuuuuuuaauucaucaugaauuccucauagacaauaauuguuuaguuuucauaaaguguccaaggagauaauuuuaagacugucuuaaaauuuuugaaucacauguggaagcugcaauuuaccaaaucauuuagagccaaauauuuucaucccuccuuucuccuuuuuuuacuauucucccugaaaucauaaaccuucuguuccacaagauauucucccaucuucaucugcauugcagugugaccuuauccacaggucaucacugaagccugcccaucuaggacaaaaaggacaguuuuuaaccagauaggauguuuuccugaagguuuguuguugaauaguaacauuuuuuccucuucuuucauuugagcaacuuggugaguuaaacacauccauaccaugucuugaccccugcucugugacccaauggugugucuguggcuguuccuacacaugaguacauagaaagugcacacauacauuucucuaccuccacagggaauggcauuucccauauggaaaauggauuauguuccaaacauuuguuuguugaaccgauuggugaaaaggugggauccauuuuucucuggcaauaguaaaugauguguggugguuucuaggucagcucccagaagcuuuuuaacuaauaaucuuuauuaauagggcucuagaaccagugacuauuuauaguaauguuucugcaggaaaaaaugcauccugagcuuuuauuucagauuuuaguguuauguaucuucauaaaaacauauucagaacauugaagucucaugacuuggguucaaauccuggcuuucccucuuguaaagaguaacucuauacaacuuacauaaccucauuaagccucaauauccccaucuguauauuaggaagaguaaaaguaugucuuuguaugguuuugaguauuaaaguaauccauaugaaugcacucagaacuguauuuauaaaguguugugugguaaaugcacucaguauauuugagcuuuuauuauccuccugucugauugcugcagaaauggagacuucuguccuuacguuccagggagugagaucaagcacucucauaacacuggagguggugcuuacagccuggagugaguacuuugacagcgaugggggaagggacuuuaaggaguuaggaaggaggagugaaauaggagcuggucaugugggccagggcaggugaaggaaugguacagauaggggcgugauuugauaggccuggagcugggagggacccuggagaagggaggugugacaagaaugcagcagagacccucccccccuacucacaucucuccuuuuucucucugugccccuacccuggaacuggagagguaggggaaaggaggaaggcaucccaucucuacagcccuauugucagaggcauuugaaccagagcagcuccaucuugaauaggggcuggguaaaaugaggcugagaccuacugggcugcauucccagaugguuaaggcauucuaagucacaggaugagauaggaggucagccaaagauacaggucauacagaccuugcugauaaaacagguugcaguaaagaagccggcuaaaacccaccaaaaccaagaugaccaugagagugaccucuggucguccucacugcuacacucccaccagcgccuugacaguuuacagaugccauggcaaugucaggagauuacccuaugugaucuaaaaaugggagacaugaauaauccauuccuuguuuagcagauaaucaagaaauaaccauagaaaugggcaaccagcagccuauggaguagccauuggaguauccauucuuuuauuccuuuacauucuuaauaaacuugcuuucacuuuacuccauggacucgcccugaauucuuucuuguuugagauccaagaacccucuuuugggcucuggaucagggcuccuuuccaguaacacuaugacuuuuucuuucccuuuuccccuucuuuuuccuccuccuucagugccuucaucugaguuacaaaccccuuaaauacuggugaccuggaacuaagaggaggaaggcagaaguuguuuguguguguuagaaggggagagagagaagaagaagugugacaaugcaguuuuacguuuugcuuacagugugugccaucccagggcuuucaauggagucugaacuggggaauuucaguagaucagaaugaguaagagcugugucaaauauucuuauugacacaguaagagcugugucaaauauccuuauuccugagcucucugacccuuuucuguuuucaacucagccuguuucaugccuugcaggccaccucagcaugucaucuacagacacuaagaaugucucuugaccauggucuuaagucaauguguugggcuguaaugacuuucugcuucugccacagaaucacagugucacugcagacaucugaaccuguuuccaugugauuccuuugcgugaaaaucacagucauguccuuugccuaucucagaacauuuuagcaaagauagcuaagauauuaucuauaaaauuuguagguagaagacucuauaagcaccuaguaucauuacuuagccuuauuaauaucaaugguaauucugugaccaaauuauaguuauuaaauaugcacugccaccauuuuaucauuaucauuauuuauaauuauaauaauuugagaaguugacagauuauggaauacuguuuuaucuuaggacgagauauucuuauaucuuuugacaacccagagagagacuuucuucucuuagugguaagaaauucuaacagaaggccaggaacaguggcucacaccuguaaucccaacucuuugagaggccaaagcaggagaauuguuugagcccaggaguuggagagcagccugggcaacauggggaaaccccaucucuacaaaaaaauccaaaaauuagcuggaugugguggcacauaccuguaguccuagguacucgggagacugaggugggaggaucaccugagccugggaggcggaggcugcauugagcugugauggugccaccacacuccagccugggugacagagcaaauccugucuugaaaaaaauaaaggguuaggugggaggagagaaagagagagaggaagggaaggaggaaguuccaacagugagccaagcuuccagggauggagagcagugcccacccccaaugcugcuucucuggguccuuagacaaggcuguaacaguacuuccaggcagaccucugucacaggccgcucugaagauuguuucuccaaagggcugauuguaugucguaauucgaguguaacuuaaucuuauuugauggagcuuuguucacaaagcaaguggccugaaaacuaguucuuugcauucuaaugagagucuuugguuuucagucagaagcgauuugacaucuuuaugcuccucucccuuuguuguggaaaaaaaacauccuuucccaagcaugugauacaucucgaauuuaaccuggagucacuuaagucuggacauggcuuguaggauguuuuauuguucuucauuuuccccuuuuaggugaaucgugacuacaguuuuagucauucuaucucuaauaacugauugaaagacaccauuuuuuuaagaauucagaagaaaucuacauuaaaaaaucuacauuauguuauugacuaucuuugcuauuuucuggggaaauguaugaaagaaaguggaagggcaaauaaguccgacagcacucacuuuccccauagaguuuuaugacccugaaacaggccaauuaacaacccuuugguauaccuccccaaauuucuuauuuauacaauugguuaauuaaugguuuacacugaucuguauuguacuuaauguaucuggaaagcugcaagccugugguucuuaaguucuacuuuuauaugcacugauguuccaugagugaccagcguguuccggugcuaauaacuuuucccaguucucaggaauuuaauuuaaugaauggaaugcuuaaggccuuuuucccagaaaacaauucuagaucuuuggcuuuguuauacguaucauaaucuagugaaaaaugucauuuugugugggcuagaauuuucuauucaguuauuuuaauuacuucuaguguuuuaaguaguuuccagguucucugccacccaaaaaacuuugaaaaucacuugucauugcuguacaaacuacauuucacagaugcucugaagauguuuuuauaucucaucucccuuggaaguuuuuaguugucucaaaggaaggcagacaacaucauaaagagugaugcauaugucauuuuugauaacauaccacuucccaacauuucaccucugucuuuuaucuuuucccuauuuuucuuuauauuuucauuuuucugucauuaauugaauaucuacuauugccaaucauaugcuaauccucacaucaauuaugccgaugaagacacaaagaaucaauuaugcuaaguagcucaccuuaggucccauaaguaauaaaugccaaggucaagaggauuccccucaaagaccauaaauuuccaucuuccuguauugcuucuuucuuucuccucuaccacaugcucuccuuugccuuucccuuuuuucucuauuuaauuguaguaaaauacacauaacaaaauuuaccauauuauccauuuuuaggugugcaguuuagugacauuaaguacauccauauuguauaaccaucaacaugaucuauccucaaaacucuuucuaacuugcaaaacugaaacuauacccauuaaauaacucccauucccguccucccaccggccacuggcaaccacucuucuccuuucucucucugugaauuuaacuacuagucuaggaccucagauguguagaaucaacuaguaauuaucuuuuugugucuggcuuauuuuacuugacauaauguccucugaguucauacauguuguagcaugugucaaaauuuccuuccuuuuuaaggcugaauuaauauuccauuguauguguauaccacauuuuguuugucuguucauucacugauagauacguggguggcucucaccuucuagcuguugugaauagugcugcugugaacauaggugcacugccuuucauuuugaguacacuuccucccucaucuucuacauaaauuauaggcucguuugugguacccacugacauugcuuaaucccggugacaacacugagaccuagaaaaugccugccuaacuguggaagcuguggacuguuucacugauuuuucuugucagcguauuuccccgccuugguuuugccuuucuucucaaguuagauuuugcaugguaaugaaugcauauucugucauuuucuccuaaguccauagauuucugucuuuugcuacccuugauggaacuccaauggaacucuaaaaaccuucagaggaguuguagaagagccaaucaacauguguguguugaaugcaagagaugaggcaagguguauuaguccguuuucaugcagcugauaaagacauaccugagacugagaagaaaaagaaguuuaauugcacuuacaguuccacauggcuggggaggacucagaaucauggugggaggcaaaaggcacuucuuuuuuuuuuuuuuuuuuuuugagauggagucuugcucugucacucagucuggagcacaguggcaugaucucagcucacugcaaccucugccucccagguucaagcaauuuccugccucagccuccugaguagcugggauuacaggcaugcgcuaccacgccuggcuaauuuuuguauuuuuaguggagauggggguuucaccauguuggccaggcuggccucgaaccccugaccuugugauccacuguccucagccucccaaagugcugagauuacaggcgugagccaccgcauccagcugaaaggcacuucuuaccugguggcggcaagagaaaauaaggaagaugcaaaagcgggaaccccugaugaaaccaucagaucucaugauacuuauucacuaugaugaggacaguaugggggaagcugcccccaugauucaaauuaucucucaucggguccuucccacagcaugugggaauuaugggaguacaauucaagaugagauuuggguggggacacauccaaaccauaucacgaaguguaugagauagcacacuggguggaggugggaggguggguaguagaaguagagguucaguucccaacuucagugaacuuucaacuugcaaauacucaguacuuuaucuguuaguuuacauaacuuggaaauuuuauuaucagacuuauucaguaugucaguuauuuuccacuggaaugauuuuugcuccugcucccacccuggacauuuggcaaugacuagagauguuucugguugucacaacuauggcaaaaacuacaauuacuuuugcaccaaccucaugguauagggaaugcuacugccauacaguggguggaggucaggggugccgcuaaauaucucauagugcauggaacagccccuacaacagagaaugauccagccuagaugucaguaguaccacgguugugaagcccugcaauauauguaguauugcucaguuuauauuaguuaaucaccugauauggaacauaaaaauucaccacuaguuuucgcacagaaaaccucuuuaugauaauauaguaacuugaaaucaagcuagcauuucccaugcuauaauagucauuauuugcuaauccaggauguaaaauuuugaaggcuuaaguggcauuuuaguaucuaaggaaaauuuucuagcaaaaauuuuauuuuaaaaacauaacuugguauuuaauauauuggcaguuaauaucuauuuuuaaaauaaggaaccaucagugucccucauaaacucucuuuggauuugaaaagcauuguguuacugccuccuguauguuucucucuuaauagacuaacacuauauuuagaucgcagucccuauacagauaucuuaugagguaaaguuggaagcucuauaggguguuuugcagcauugauuuaaaauaucccauggauaacccacuugcauagaagaugauacuaaaaauauaaacaaaauuuauucccaaucugcccauuuucuucagcuggaauacuagcuaggaaacuccuaauuuaguuuucugcuuuaugguacuguguuuaagcagauuccuuucuuccauaaaaugaaacuugaacaaguggagugagcugaaaagacaauugauuggaagugucuugagaggcauagagaugccugagacccagucacugcccauaugucuaaaccagaauaauugcaagacauguaauaauauacagaauaauugcaaggcauguaaugagaccaauaugucuucaucacaaauccucuguuguuuguacaucuccagcacugagcaaugaaaacugauguucauagcaagauuucugaaauucuuuccuaaucaucaagggaagaauaaacuugggcuugauguucuaguuauuugguuaugucccaaagguuguuaccaaagguaguucucgcacauggacaggaaucgauccucagacaucugaaccacacaaaacuauauucaggaauccuugucuuucugcugcaggaccugggaggaaggcaaggugcucaucuuugaugacuccuuugagcacgagguauggcaggaugccucaucuuuccggcugauauucaucguggauguguggcauccggaacugacaccacagcagagacgcagccuuccagcaauuuagcaugaauucaugcaagcuugggaaacucuggagagaggcugccuuucugguuccaucuccuugggugugaggauagaauuucgaacaccaagagucaauucccuugacuugcagcccgaguaauucaaagccuccuccuagggucagaagacacuaaagggaauauuugccucgcugcaauucauuuaggaaacacccugcugugugucaucucaugacagcacuggucuucugccaguauuuaaggugaacauuugauagcuucuaccuuaccagccaaagauauuuuuuccacauagaauaggucuaauucaauguauaaugagaacauauguagaaacugugaauggauugcuuuaguuuguaauuuuucuaugcaguuauauuuuucuaguguagcuagacuauuuugucaucauguaccacuacauuuuuguuuauuuuaaugacaagcuguauaaaugcuuuacuucuagcuauuuaaugguagcauuacuggggaacucagacuucccucuuuuaauucuucuuaguaaaagauacucaugaaaaaagcaguuuuauuuuccuaacaaaaaagaaagagcucauuaugucagugucuaugaacuguacccaucccaacucucaaaucguuugguuuuuuuuaucuugauugagauccucuucucacuaugcuagugguggagauauugacaaaauccuauuucuuucaaagaggaacuuuucacaccgaaaaaagagcauggaauuauuuuauauuguuauaaaaaucccagaugcaaauuuuuuuaaugccaauuauuagagcuucuggggaaaaaguauaguucacggaaauaaaacuauguucuuucaggguuggguggauagguggcugcuagggugucuggcuccuggcggcuuugccauccaugaggcaagggcugggaacacagugucuuugccuaugguagauccaugugaaugucaggaagccagcucuucagucuuggagaugauuucugcuacaauucuguagaaagauuaaggauggcagaguaaaagguuaccaagaaugccaggauguuuuucuugggcguaggagguccagauuacuuuccuuuuugaugaaagaguuuggaagacugucccaucucucuggcuugagaaaucucugccauuuuaaacaucacugugaaauagcaauuauuaucaucuguauuuaguuuuaacauuacccacaacauagaaauaauagguaaaaaucgucuugccuacucauuccaaagaugaucaagucauuaaucuagcaaaguauucauguaucagauuuuguauauuuugaaucaaagcuaacuaggaauguuagauauaagaauguaaugauauucaugcacugaauucuaagccaauaugaacaaaaaugcugcaugaauggcacauauaggucaccaaaguucauucacagguagaaaaaacuugugcuuucuuuuccaucuaaaaacaaaaggagacuuucuuuaucucauuuaaagaacagcucuuugaaauugaaauugacccuuuuugcuugaccuuaaggagauuagcuuccaguagaugaguuugcaaaauacuuuuccuguucuuuuguuuugcugguauugaaaacaucccacuaaaucagaugaagaggcaugggaggaaaaauauccaaauuaauuacuaaaaucgagaagagaaggcaaacucuugaaaaguaaaaagguguuugugaccuucaguauuuauugaacagaggaaauaacugacaagggcaauacaauucaauguucauguaguaacauucaugucacuuguugaauuugguucucauauguauauugcauacacauaaauucaaacuauaagucgucauuuuugagccaucaucuuacauucauguaaugaaauuauggaagagaguaaaaacuagcucuuaacuuaguaaauauaauaugguauuuaaaaucaggucacuacaguaagguucuaaguauugccaauugaaaagcuagaaaugguauuacuguugcaaaguguugucaauaauugacuccaauagcauuguaaauacuuguaucccacaacuauuuuaaacccaagcaauaaaauggauuuucuaauucacuucaauucuuuauuucucuuaccuaucuaugucuugguacauaagaaaaguguuuccaucacugcauugguagaauuauuucaguguuauuauuuuugugauuucguaugucuacacaaaaaugaauuaguuuaauuuauauugugauacaguuguuugagaaauauuuuuaauucuguuucaacuuuauuucuccaaguguauaauauaaaaauuacuucuguuauuguucucuaccaauaggggaaaaaauuaaaacauuagauccauugagaaagagaugauguaauaaauaauuaagauuaguaauaauauuaucaggggugauuaugaccaguugaauaaucucuuucccuugaauuauuuagcuaacaaauuaacucucccaaauauuuaaaauaauguaaaaucauauuuuacugcccauuauuaacuaaaauauuuuuguuugacuuugagcaccaacugguaauacuaauaaauacccaugucaugcagauggcugggcgaauaagagaugucuaaaaauaugcacuggucuuggaaaacauggcacaaguaaggauaucauauaugaugucuguuuauuuuaugucugauuucuuuugaaugaguaguuggggacuccauuucuaaggagacuagguaaauaaaaugaccuuugacauuucauccugcauuucuagucuucucuuacuucaguacuugcauauuuagccauccauaugggucaugcuccaugauugaauauuuacccucucagcaacaaccauggucuuucuccacaucuuuaaugguugcaggaggguugugggggcaaggguaaaugguuugauagcacuuuucuuugcuguagugacccaguugaggcaacuggaauggauucauuaaucacugacaugugauuuucaugagacaucuccucugcagacacaugcugcacuaaugggcuuuugagcugccugugguaacucacauugcucagaugaaauaaucguauuucacguccaugugucuuccuuuaacgucagcucaugacagucagcuagugaccugacaagagaugugacaucaaaauaauuuuuugcaggauaucaucaaaauaagcaaacuuugcaaauacccagaccuaugagaacaugcucuuaggcugaacaauucgaugcuggugaugaggucaaaggaaauaauucaguaagaauggaaauuacuggagauacuauugucucagggcuuuguacuacaugaaacuugacaguggugucuguacaguuuaacucugauacauuuacuuggaaaugcacuuaauuuucaaaaacuggagagggucccugugugauaccucagaaaaauucuuguccuaaugcaguguguccaucaaauuuagucuuuauuuuuucaauuuacuacaauaaauaugaaaggagggagaaucuuuuuuacauaaaugccuugcaucauccuccaguccccucacugggggaaaaaaaaagcaucucucaagucuuuguccaacuuuggcugcucagaccgauggcuggugacagucacugcagggguucaggaguggaggaccuugugucaagcagaacacacgugucugcaugggucaguugugcaugugcuuccuggguggcugauaccacugaaggccagugugcaggagcauuggggugacucaggguucaguccagagccaggaguggcuggguguucucauucucucccuucuccucauguuucagggucccagcuucuaccacagacugagaucuaacaagaggggagggaaaaagacagaauuacaaacaauucauggugacaauuuuggaaccuuugaagacauccggauuuuauauuucucuuuuuaauagacacucaaaaauuaacugggugcaguggcacaugccaguagucccagcuauucaggaggcugaggugggaggaucgcuugaguccaggaguuugaggcugcagugagccauauugugccacugcacuccagccugggugacagagguagacccugucuccaaaauaaaaauaagaaauaaagacacucaaaauaacuacauaauauauucccuuucguaucucuguuuuucuuacuucuuuugcuugcuaaaccacauuuuuacggcaaaaaagcauuuuggaguacuggaauaaucuuugcagugaucucuucucuugguaaaagggacauauguauucuagccacacucugccccagcaucuaaauauucuguguaccuucagauauauaaaguuuguugaauuuuuaauguuuuaguguaccuuuuaaaccuuuugucucucagagucauuggaaacuaccaugcaugauguuaagaccaugaaucagaugguaaaguuagacucugucccuuacuggcugggaagcuugggggaguucuuaaaacucucuggaccuugauucucucaccuguauacuagaaguauuaccuacuucccacaguuguugauaaagacgacuacaacuaauaauaugcauagagcauuuggcauggaauuauaguuaaaacuuaugaagcacucuuaugaccaaccacuauugcaauacuaguaaugaucauuaguuuuugauguguccuuuuauacuggaguaauaaugauuuuuuucuaagaaguuuauaauaugaauuaaaccaaauuauuuuccagcuuacagagaaaagguuauaaaaagagcuacgcaguagauauuuaauaaauguucacaacuaaaaacaaauuaucaugaaaaugguuaaauuguucaaauaaguaaaacuuacauauaugugcaguaaauuguuaacucgguagaccuggggugcccaaacccuacacauuacaaguuuucaagacuggccuuuggcuccucugagcccuuagaguagucuaccugauaaggagaucuuuguauaucugagaccugacuucaugccaaguaguuuaugcuaacagugugauuuauagugcaugcuugguuuuguaugucugggcuuuaggucacacuguaucaguuugacccuuuuaaggcaguaagagugucagaggugcuugaaccagagcaacuccaucuuaaauaggggcuggguaaaauaaggcuaaagccugcugagaugcauucccagaagguuaaggcauucuuagucacagaaugagauaggagguuagcaaaagauacagaucauaaaguccuugcugauaaaacacguuguaguaaaaaagccagacaaaacccaccgaaaccaagacggcgaugagagugauuuccagccaucuucacugcuacacucccaccagcaccaugacaguuuacagaugccauagcaacaucaggaaguuaaccuauauggucuaaaaagcggaggcaugaauaaucuaccccuugcuuagcauauaaucaagaaauaaccguaagaaugggcaaccagcagcccucagagcugcucuuucuaugguguagacauucuuuuauuccuuuacuuucuuaauaaacuugcuuucacuuuacucuauggacuuccccugaauucuuucuugcaugagauccaagaaccccucucuuggggucugaauugggaccacuuucugguaacaucuuucugaugaaccaugaagggacaauacugaggaaaccccugacccaaagacuaacuuugaguaaguaagugguggggccugguaacaagagggaaugguggaaggcugaggacugagcuguuaaggucagucacaaagguacugcaugcccaugagacugacaccccccccccaauaaaaaccuggacaccagggcacagaugaaccuccuugguugacaacacuuugcagauguugucacacaucauugcuaagagaauuaaguucuguucaugugauuuuacuggaaggacaacuggaaacuuacagcugguccuuccuggacuccuccuuaugcauggcuuuccauuccugauugcaaucuauauccuuuucuguaguaaaccacaacugucagucuuaacaacuuuucuguguccugugggucuuucuaguaaguuaggaagacauuaucaaaauuaucaaauacagaaaaggguggucuugaggacccccucaacacaacauacuaaaacacuauguuugugcaugguauuguucuaagaaguucuugaccuauauuagcuuauuucauuuucauaacccauaguuguauauuaacauguauuuacauugacauauauuaacauuucauuuucacaacccuuaguuuuuuccaucuaaaaaacuaagggacugagaagucauaugauguauagaaggcaacacaaauagaaaguggagauguugacagguuuauuaccaacccacaguuccuggguauaccaaaggccacagaagcguuuagcuaaaacaucgaguguuccuuccaccucaccauaaaaaucacuguuguuuugccuaagauuccugucuccuuucaagauauguauguacuguagaaaggauaaaauuaagaaaucaagaagcaaaucaguacaagugucucaaaaaaauuuauuucuacuguaacuaucaauccauucaaacaguccaaccuuauauaccaagcugaaccuuugaaagcaaaauggacucauggacucacuuauugcugggauagggcagaggaaggaagcucuagguuguaguuuagccccagcccccuaacacauuuccagugcauuuuucucuuuguuuuaguuuaaggcccagugugcauguggggaagggagaaguguagguuuguacgaggaacaggaaagcagaaaauccagaggcauuaaaacaaacagcaagcaugaagacaaccaagagagcacaaccagagacacaggccaaccucccuccagcaccuuggacagcugccuuccugcuuugaccuacggacccuguggaaaaggaaaauacugauggccaucuacuuuuacagaccuuaaacuccauuuaccuucugucauaugacuucacuuuauuucacaacauggcaugagaaccacagccacagaguuagagggaaacagugacucaucuagaccaaccugauaggaaaucuucaguaaggaguugugcagccucuucuugaacauaacuaacuugaggaaccugcuccuccaugccccuaaacagucaacucagcuagaaaauucuuccuuacauugaacucagcucugcccuuucuaaacuucuauguacaauuuc

SEQ ID NO: 13888 - RNA, 1645 nt, Homo sapiens
gguuuuaguugguauaacacuuggauaguuagcugcauuguuuacauguagaucuuuuuacauuauaugguaauguacacugcugauacauauaguucacaaaauaagauccuuuggaacaauuaugcacaagacauacgauauuggauuuacacacuggaucccaggaugugacugacugggaaaaaacguuggacuaggcauguucagugaaggagccaggaaguuauauaacacacgguaaacauccaccuggcucaaggggcaaaugcagcauguacagcauuggcaguggugcaucagagguggcagaacuacuucacacuaaccaguuuaggacuacacaagauuaauaccauccagcaucaggauauagcuguggauuuuacaaaucauuccuauuucuaacuugaggaguugauguuuuucccaguccaucuuaaaauauuacugcuuuaaucacagaucagauaaaaaggacagcauguacaaccuccaacuagaauccuguuguagccuagacaguaaaaugauaugacaucagaagacuuuaaaauugcagcucuuuuuggaucccccaaaguguaucugcacucuucuucaaacaggccucuuccucaggagucagagucacuuucacaaggucugagauuccauucugucccaaaaugcaaggaacccuaaggacgacaucauccuuuauuccauagagacccuuaaucauggugaaaacugggugcaccugccuaagauucuucacuguaccucugccaaaucugcuacagagaguccaauggcccaggauguguagccuuugaguuugaucaccucauaagcacucucaaccaccaguuugugaaccucuuuccacuguuccuuauguuuaucagucucuaaaucugggugcggagucuucagggagacaccagcaacauucuuuccacuccauacaggugcacuggaaucuccauguuccccaaggacccacccaugacagcuuaaugggugaacucccagccuuucccccaucagguaacggaauugggcugaauccagauugcaaccacuuccaauaacaugguuuuugggaaaaccacuuaucuuccaagccacguaggucaagauauccacuggauuugaaacaauaagcaacuugcaguucgggcuguauuuuacaacauuaagaaugaugaacuuaaagauguucacguuacgcuggaccaaauugagacggcuuucuuccucuugcugacaugucccagccaugauaauuaccaguuuggaguuugcaguuccauuauagucuuugccagagacaaucuuugguguucuaaggaaaaggcugccauguuggagauccaucaucucucccuucaauuugucuucgaugacaucaacaagaucaaguucaucugccaaguccuucauuaagauauugauggcacaggccaugccaacagcaccaaccccaacaacuguaaucuuauucugggcggucuguucuuccuuuagaagauuaugaagcagcugauccuugagaguugccacauuggacuuggaaccaaaaggaaucaggaaugcacaucaggcagucgucggggcguguggcaaugagaucuggaaucagcggcaguggcugcagcac

SEQ ID NO: 13889 - RNA, 1981 nt, Homo sapiens
ggacaacacuucuuugagcugagucgaaguggacgcuuugagcguagccgccccacagccgccgaucccugcgucgcuuccuguagaacccugggccugcuuugcagcuuuccucccuuugucucacaaccaugucuaccaacgagaaugcuaauauaccaguugcccgacuuaacagauucaagaacaagugaaaagacaguacagaaaugaggugucgcagaauagaagucaaugugaagcugaggaaagcuaagaggaaugaccagaugcugaagaggagaaaugcaagcucauuuccugauguugcugcuucuccgcuggagaaaaaccgcaaaaaccagggcacuguaaauuggucuguugaugacauugucaaaggcacaaauagcaacaauauggaaagucagcuccaagcuacucaagcugccaugaaacuacuuucuagagaaaaacagccccccauaggcaacauaaucugggcugguuugauuccaaaauuuguguccuucuugggcagaacugauuguagucccauucaguuugaaucugcuugggcacucgcuaacauugcuucugggacaucagaauaaaccaaggcugugguagauggaggugccaucccagcauucauuucucuguuagcaucuccccaugcucacaucagugaacaagcuguaugggcucuaggaaacauugcaggugaugguuuaguuuuccgagacuugguuauuaaguauggugcaguugacccacucuuggcucuucuugcaguucccgauaugucaucuuuaguaugugguuacuuaugucaucuuaccuggacacuuucaauccucugcugcuacaagaauccugcaccccaguuagaugcuguugagcaaauucuuucuaccuuaguuuggcuccugcaucaugaugauccagaaguauuagcagauagcuguugggcuauuuccuaccuuacugaugguccaaauaaacgaacugacauguucuugaaaauaggaguuuugccccaacuugugaagcuucuaggagcuucugaauugccaacugugacuccugcacuaagacccauagggaauauugucacugguacagaugaagagacucagguugugaucgaugcaggagcucuugcugucuuucccaaccugcucaucaacuccaaaacuaacuuucagaaggaagguacauggacaaugucaaacaucacagcugacccucaggaugagauacagcaaguugugaaucauggauuagucccguuccucacaauguucucucuaaggcagauuuuaaagacacaaaaggaagcuguauggggccaugaccaacuauaccagugguggaacaguugaacaggcuguauaccucauucauuguggccuaauaaaaccauugaugaaucucuuaacuucaaaagauaccaagguuauucugguuauccuggaugccauuucgaacaucuuucaggcugcugagaaacuaggugaaacugagaaacuuaguauaaugauugaagaauguggaggcuuagacaaaauugaggcucuacaaaaccaugaaaaugagucuguguauaaggcuuuguuaagcuuaauugagaagaauuucuugguagaggaagaggaagaucaaaaugcugugccagaaacuaacucugaaggcuguaccuuccaaguucagaaugggacuccuggaacguuuaacuuuuagaucauguagcugagguauguauuuguuguguacuauauuugguauuuugucuuacuguuucucuacuaagaacucuuuuuaaaugugguugguuauuguagcacuuuuuacacugaaacuauacuugaacaguuccaacuguacauacuguaggaagcuuguccucugaauggguuucuuauuucuguguggaauuucuuaucuugcagcauccuauaaauaaacaauaaaguccacccuuuacuucaaaaaaaaaaaa

SEQ ID NO: 13890 - RNA, 569 nt, Homo sapiens
cuuuuuucaguggccgggaagauggcggacauucagacugagcgugccuaccaaaagcagccgaccaucuuucaaaacaagaagaggguccugcugggagaaacuggcaaggagaagcuccugcgguacuacaagaacauuggucugggcuucaagacacccaaagaggcuacugagggcaccuacauugacaagaaaugccccuucacuggugaugucuccauucgagggcggauccucucuggcguggugaccaagaugaagacgcagaggaccacugucauccgccgagacuaccugcacuacauccgcaaguacaaccacuucgagaagcaccacaagaacaugucuguacaccuguuccccugcuucagggacguccagaucggugacaucgucacagugggcgagugccggccuugccggccucugagcaagacagugcaccucaacgugcuccaggucaccaaggcugccagcaccaagaagcaguuccagaaguucugaggcuggacaucagcccgcuccccacaaugaaauaaaguuauuuucucauucuccaaaaaaaa

SEQ ID NO: 13891 - RNA, 569 nt, Homo sapiens
uuuuuuuuggagaaugagaaaauaacuuuauuucauuguggggagcgggcugauguccagccucagaacuucuggaacugcuucuuggugcuggcagccuuggugaccuggagcacguugaggugcacugucuugcucagaggccggcaaggccggcacucgcccacugugacgaugucaccgaucuggacgucccugaagcaggggaacagguguacagacauguucuuguggugcuucucgaagugguuguacuugcggauguagugcagguagucucggcggaugacagugguccucugcgucuucaucuuggucaccacgccagagaggauccgcccucgaauggagacaucaccagugaaggggcauuucuugucaauguaggugcccucaguagccucuuugggugucuugaagcccagaccaauguucuuguaguaccgcaggagcuucuccuugccaguuucucccagcaggacccucuucuuguuuugaaagauggucggcugcuuuugguaggcacgcucagucugaauguccgccaucuucccggccacugaaaaaag

SEQ ID NO: 13892 - RNA, 1696 nt, Homo sapiens
uuguuguuuucauuucuguuauaaguaaaacuaaaagcacagaauggugggaaaggggcuauaaugugguucauuaauaauguuagcagcuuuuuucuaaccauccugucuaaugguuaagacaccaguaacaaaaacacaugauuuggaaauacuuuggcuuuuucauauaccuaguggugccuuaucauaauagcacuguuacaugaaauaagccccuaccuucuuacuuucugguuuguugaaaaaauacacuggugcucuuugaagugauaaaaugaguguuuaugaauggguguaauuaggaaauacuucucaucugacagcuacaaauaacuaaguuuggagguauuuucacucuauaugaauaaauauuuuuccauaaaauaguugugauuauauuuuuguuuuauauaggucccaaauuauaauugucaaauauauauuuuaaauuaauaaaaguugucauucuuaggaauuugguuugaaauuuaucaguuauacagaauugucauacugcauuagcuucuaccuuuaguaagacauauuuuuuagguauaaauucuuaugcuuuaacauuauuucuggauugaaaaucuuauaaaacccuugaaaauaaacagucucuuuuuuacaaagccuguguuagagcacagauuuaccuaggcuugaagauuuggaagaaauaauauguaagaauggccucaaggcagaccacuuuaaguuuggcuagacuucauaucguggaaguauugucuauuucagugugaaacuaucuugaauuugcaaauauaguguuauauuuuauaaaguuuuguaaaaucccaaacaauauuucuauuuuuguaaaacaauuguauguauaaucuguauuugaaaucauuuugcaaucuauggaaauagaguagcaauugcuauuucuaaauugugaacuuuaagucaaucuagauuuauuuugagaaguaauuguucacucuuuacuuuugaggcagccauuagguugaaaguauauauuuaucauauaaaacuugaugcguuuugcacuacucuuuccauuuauaugcugcaaacaacuacagucuuugaaauauggaaaaucagcagucuaaaguuuguuuuaaauucuaaauuuaaaaaaucuucaaaucugaauauaccgcaaaugucaugagaaguuugauucaguaacuugugauggaggauucuuugguaucuuacuguuugguuaaggcacuaauuuuacuuaccuauuagauuuugaaaguaucugagauauacaaaucucccuguaggaaaugugaaagaaaagcacaacaaaacuaggguuuuuuguucauuugcuugcuuuuaugauuuuuuuugguuuguuuuaauaucagguggauuuuuguuucuaagcaauauauacauaaaaucaaccaacauaucugaaaaggaucaugaaaccugagaaaugcuaauggagauuugcugguacauaggaaucuagcaaauucaggaaccaaggggaaauguugugagauaacauuuacauugucaaccuuuauugacuuuguuuuuacaauaaaaaauauuuuacaacuuacuuucuguucucuguauauugugacuugaggauuuacccccucugcuaagauaauaaagauauuaugcauauuuugccuaauaauucaacaacugugagugccugcuaugu

SEQ ID NO: 13893 - RNA, 16383 nt, Homo sapiens
cuuucuucccacccggccagguccccggggaccaccgcgcucagggggaggaggaaugccguucccgggccccgcuccggagagggguuuuacccucugggaucccggaauuggagguggagaagagaggaagcaagggagggcgcggcguggcgcgagcguuuccugcgcggggacugcgggguggcagcuggaggccacugcaggggcagagcggcggguugggggagcgaccgacccauggggagggaaacccgguagggggagcagggagccggaaagcaggguugauacauaccugggugggcgggcuggaaaugccuucccugggcgcgccgcgcaaggccggcggagcgggcuccggguggucgcggaccgggacuggggagagcagagccgcacuuggccaggcgcguggcugagugguguuuacauucugcagccacuccacguugugcugccgcccgugccucccauuggccagcucuucagccaacgcuuugcuccuccccgaggggcgggcccucggguccccgcgucgcucaggaaagaccuggguucccugaggccuuggcgggacagcuagggcgcgccccuggacggucacuucccagccacccuauggucgcccgagucgugucccccuguuaugcgcccgggcugagccgcaggcugacacccccgaaauccaggaguugcagugggaggaagcaaaagcaaacuggcgggagaugcgcgagccaggcggcggggagaacagccgcggagaaggagccccugagaguuucccuaccgccgccggccgcgccguggagcgcgguggacgcgggcagaaggcccgguagaguggaccccacggccgcuccggguggcgggcgcgcacugagagcagggcgcggcgcgcgggcacgcgggcggacgggcgggagaggggagcgcgcuguccggaggugucagucugaggcgcaugcgugcggggcgggaccggcccggccuauauauuggguuggcgccggcgccagcugagccgagcgguagcuggucuggcggugaggaguugcugcgcguaggggggaugugggaggaaagaaagcccaguugggccgaucacuuaccacaggcgggagccucagggaggaaaaucgggagggcugagaacuagacgacugggggucauggguucccgcguuccgucccugucaggaaccuuggcaggggaccgggaagcggcugggcauggagagccgccccucauucuaggggcuucucuaucccacccucauuuggggagcuaucccgugggagagaggaugggaggccggguccccuccauggggagaaaaguucccagccagcccagucuccccuuucuuuagcuccuuuuccugcccucccccacgcccuccgcuucccaucuggaguuggggucccggcgccccuccgagcggcgguagggcggcagggccgggaaggagggaaaggagacuggaggccgugacaccagucuugguuccuccgcccccugcuuccccgccaccgccgcucuccaaauuggcgcggaaccggcuucuccacagcauuucgccuccacaacccccucuccccgcugguccaggagggaggcgggacgugggggcgcugcccaagccccacucccgguguacgggggagaggguggaggacccagaaaaacccguuugaggaagaugugccucccugcgcguucaaggugucaggagugcuugguaaauuuuuggacacucgcguuccagcuguacauucaguugaggaaaugcaggcuuguauccaaaaugaauuaccaugagcuagcuaacauagcacagaagauggcagggucacagggcccaggcccccuucggagggacugagcuuucaccugcgaaucagcgucuuacuggcacuuggagaaugugaaugacaauguacuugacugcggcuuuuccucuccccccuucagagguuuuauacaccugaaagaagagaaugucaagacgaagguaacauuaucugucuuagagacauguuucaaauuaguugcugccuuuaacuuacuaauuacacuuccuuuuuaaaaauucacuacaguagccguuuacaagcuaagcagcagccccagcccagccagacggaauccccccaagaagcccagauaauccaggccaagaagaggaaaacuacccaggugauuuaaggagaaagagggaggaacgaaauuccaugcugggacuuuaguuuaccaauggucuuuucuauuuuccaggaugucaaaaaaagaagagaggaggucaccaagaaacaucaguaugaaauuaggguaaugcagaacugggcuggguggguuugggggaaaaauggaggauagaugaauaagaauagaauuauguguuuauugcuuugcgauagauuccucugacacuuuuacuuuuaaugccccuagaggucagcaggaaggcgccuaucuuugggugguuucuaugugcccgaauccuacuacagcugcagaauaagugccuucaagcagcugguuccuuuuuguaaaucccucccucuuggaacugccuggugcaccagggcccgccuaaucuguccaauauacugcucuuuguucccucgcagacucuaguagacgguccuaauagcugcuucuugggcauaaauaggaugugagaucacugacagccuggcacgcagcccuuugguaccucuucuuccuauguguuuuacagaaagcagcacuuuggagauagugauugcguuugaaaccagcauuauugggaaaagaaucguuuaaguaaucgauuccauuuuuaagguuuugcuuucaaauauucaaaaguaucagagcacacuuuuuuuaaaaagagcuuauuugaaaaaaaaaaaaaaaggucccugcuacuauugcuagauacagagaacgauucugugaucuugaaagugauuaguauuuuagacugcagaugcauuuuguuauuacuguccuucuucgacaccuggugucuucuauuaccagaauugcauuuuguugucuaaaacauccuauuacucuuuauaaaaaucaauaugagcuauauggcuuguuuauaaaaugugaaugucaaauuagcuauauugccaucuauguuagcuaaaauuaugauucuuuagacauauuagcuuucauuuaugaaagauccauuacaaaaacuaagguuuuccuugcacaaauugauauuuuucuuuuuuuuuaugacagaauuguuggccaccuguauuaucuggggggaucaguccuugcauuaucauugaaacaccucacaaagaaauaggaacaagugauuucuccagauuuacaaauuacagauuuaaaaaucuuuuuauuaauccuucaccuuugccugauuuaagguaagaaaaauuucaguaauuuuauuucaaagauauaaaguugugcugauuuaauacauggcacuauuuugucuuuugcuuucauaaaguagaaaaacguguaaaaauuguuuacuaauauuuaaucauaugucauuuuaucugagaguagugcugguugcaaaugauauggguauuuaaaacacugauucuauaaaauuauuuucauuugcuugcugaguacuauaaagacuuaacaggacugaauuaguuuuuuguuaagauagaaacauuuuuacauguacagcuuuuuccuuuaaaauuuuuauucguguuucuugcagcuucaacucaaaggaagcuuuuccaauugauguaucaacccuauuuauuucuuaccaaacuuaauaaggucuauacuuaauucuuuuuucuaguccaugaguguaacuaagagguacagcuuauacaaaacauguacuguauuaauuuaugauuggccuuaauaagcaauuuaauggaaucagacacuuaaacucaccaaucccccuuucccugcauucugucccaccuuacccaccccauaggugauccugcuguagaugaucuauuuagaggugauugagacuucucuugacugugaucacaugccuuauguguuuaacuuuuuuguauugcucuugagaaaacauuuuuuuucacuuuuaauugcauuuauuuuagugcugaauuuacuccugugccauaaguuuuuguuucuucaguuucuucugggauaucuuuuucuucugggcaaccgccucuucugguuuaggaacaauuuguuccuuuucacuaaagaucauuucgauguggcagggagagaucacgugugaguuaauccgaccaugagcucuguagguccguuggcacaucguaggugcuuuguucacuuggagaugcucaaugaccagagaaucuacaucuaaacucuuaaguucagcauuacucucugcauuuuuaagcaugugcagcaaaaauucagcacucuuuuugggccaccaaccuuguguccagucccacugcuuggccuggguacaccuaccaacuccaccauuguaaugucagaauggcacaugcuguuucuguaaagugacauuuuaaaaauacuucaugguguuuuuuuuuuuuuuuuuuuuuggagacagagguuugcuguuguugcccaggcuggagugcaguggcacgaucucggcucacugcaaccuccaccuccugggugcaagugauucuccugccucagccuccugaguagcugggauuacaagcaugccaccacgcccagcuaauuuuuuguauuuuuaguggagacgggguuucaccauguuggccaggcuggucucgaacuccugaccuuaagugauccacccaccuuggccucccaaagugcagggauuacaggugugagccacugugccggccacuuugugguuuuucauauaugcauacccuugauagccugggcaguuucacgaguguucuuacagugaacacaaagauuugaaccucuugauuugcaugauuuugugggguuuuccagguaaagugaauagccagcuauuuucacagauuacuucagaccacuuaugggaaaagcaacgugguuaucuuuuaacagcaaccuuuguaaaguauaaauaaguggaacuagaaagcacucccuugaaaucugcagguuuggaugaucauaguccagguucccacuguguuacuucaggcuucuauuuauucaugcaaaggaaauuguuuccaaaaauuaaggcagaaguuuuuuuucuuauuuacuuuaagagcuucuuccaaguucuaauuaaaaguugcauuucaaugucugaaaguugaauuuuaucuaugugaaacagaguuuguauauuacauggauugcacaauuuaaauuauguuuuuuagccgggcauggugggucacgccuguaaucccagcacuuugagaggcugaggcaggucgaucacuugaggccaggaguucgagacuagcccagccaacauggugaaaccccaucucuacuaaaaauacaaaaacuagccaggcuugguggcaggcaccuguaacucccagcuacuugggaggcugaggcacaagaaucgcuugaacccaggagguggagauuacagugagccaagauugugccgcugcacucuagccugggccacagagcgagacucugucucaaaaaaaaaaaaaaaaaaauauauauauauauauaugguuuuuuuccucucuuuccauagcuggggauguucaaaagaagucuggcuaaacauguuaaaaaaggagagcagauauguucaugacaaacauuuugaaguucugcauucugacuuggaaccacagaugagguccauacuucuagacuggcuuuuagagguauguuacagcaauacaaauuuccuuugucucuguaugauggaaacauauuuagcuguaaaugugcuuucuauguacucucaagaguuuauuguucauccccaggaagcugucuuuuuugagguacuuacuguaguugauugcacccaaaguggaaagugacucuauaagaguaaaaccaugacaaagcuacuacauauaacuaaacccaauucagaauuccuguuaccuguggauacugcuguguaccaaccacuuucugggugccacagauacucaaggugaauggaauguauaguugauuagguuuugaauuaugcuauacaaagugaagaacuagaacuaggcuucagggcccucugaagucuuuuucuguauuaacaaaaucaugaugaugaggaauccugauuucuauauccuaaaccauaaugagacuauggauaucuggaagcucuacgcccucuauuguccagauaccuucucuuuauuauauucuucuauucuuuuccgaaauauaccauuaauuuaaaggaauagugauccugaagccccuauagauuugugccagauuuuucucucuuguuuagguccauucccuuuccucuggauaauagcucuaaaaaaguuucuaaaauuauuauuaaggaaaucauuacuuauguugaugacaaacugauuuuuccuccaacucuuggauauuugcucuguagucugucuuuaagacaagagaugaagcauucuaagggaaaaagaccauagacuuuuuggaggaggaacacauggcagaauagaucucagaagcuaucagaacaguuuuuaagacuaaaauguuauccuuuugcaucaggucaucuuuuuccuuauucugacuagaaggaaagauuguauuuuaauugugggcacaagaaggcauuggguuuugacuuuuucugacugucuagugaucauggaaucaacuuaagcacaauuauguuaauuuuuaauuuguuuccuuuuuguuauacugauauucauccagugguuauccaauucaauuuguuccuguuuuuaccuaaauaugauuauguaugcaacagcauacagaauauaucaaauccagcaguguuaaacucuaucuuaguguauucuucagucuaggaaugcaaacuugauucaacauuugaaaaucuauuaauuuauuaccuuaacaguaaauaagaaaaaugcuaagaucucaauagaugcaaaagacauuuuuugaaauucgacauucuuuuuuuuuuuuuugagacggagccucgcuguugucacccaggccagaauggaauggcacgaucucagcucacugcaaccucugcaucucgcguucaagcgacucucuugucucagccacccacauagcugggauuacaggcgcaggccaccacaccugcuauauuuuguauuuuuaauagagaugcgguuucacccuauuggccaagcuggucuugaacuccugaccucaagugauccgcccgccuuggccucccaaagugcugggauuacagaugugagccaccgcacucggccagcaaaagagauuuucuuaacucauuauuagaaacucauguggccaggugugauggcucauaccuguaaugccagcacuuugggagacugaggcaggcagaucaguugaagccaggaguuugagaccagccuggccaacauggcaaaaucccaucucuacuaaaaauacaaaaaauuagcugggcaugguggcacacaccuguaaucucagcuacucaggaggcugagguaggagaaucgccugaaccugggaggcagagguugcagugagccacugcacuccagccugggugacaaagugagacccugucaaaaaaaaaaaaaacucugguauauaucucuauuuccucaccuccaaaauggggauaaugguaccuacuuacggaguuacugugagaauuaaaaucuuucccuaaaaguguagaaaugacagauacuauuuauuauuaauaacaauagugaaacaucagggcaauuccuauuaaagucagaaacaagggauaagauuuuguuuaucaccaauguuaaccauucaguauccuuugauaauuuuuaacagugcaguaaaauaugaaaaauaaaugagguaagaaaaacuauaaaacuaguaaaugugcauaguaauagauuuguuuauccuaauaguacaucuuaguuucuuuuuuuccuuuccuaucuuagcuuugcuaucaguuuggcuuaaacauauuuuaaagucugauaugcuaagagaugacuuucuaauuuggagaaauucagaagauaauauuuaaauguuuggauucuucucuagguaugugaaguauacacacuucauagggaaacauuuuaucuugcacaagacuuuuuugauagauuuauguugacacaaaaggauauaaauaaaaauaugcuucaacucauuggaauuaccucauuauucauugcuuccaaacuugagguaaguucuuaaaaguuuauccuuagauauauuuaucccaaacuuuuuuuuaaaucaacauauuaaucccaaagaauacuauguuuuauauuaacuccuuagaaaagugaauguuuuuguuucucaguacauuuucugaacauuaccacagggaugaaugauaaauuaucauaguucccucuguaaugucugagccuuauuacaaaucucuaguuuagauucugggauuaguaucuaagugaaaugucccauggcucauucugccaaacgaaacauauugaugcucuauuuauauacauaauuauagcauuuguauucaacagaaugaccuuugaaaacuaaacagcuaauaaaaugaaaugaaaugcauacuguguuggguuagaauaaugguuuauccagccuuuuuuuuuucuuuuuucgagacgaagucucacucuuuugcccaggcuggagugcaauggcgcgaucuuggcucucugcaaccuccgccucccagguucaagcgauucuucugccuaagccucccgaguagcugggauuacaggugcuugccaccacgcccagcugauuuuuguauuuuuaguagagaugggguuucaccauguuggccaggcuggucuugaacuccugacucaggcgauccacccaccucggccucccagcgugcugggacuacaggcaugagccaccgcacccggccagccuaauauuuuuguaucugauggugcagcccugauagaaggcaccuccuuucuuaagauuuuccuucacauaagcucaauuuacuuuucuuaauacaugauggauaucaucaauacuuucaucuaagacuuuuauagcugguaucauuuugagagaagagggauugugaucauauauuaauuuuuuaaguguuuuccuuuuucuuuuaaaugucuuuugagcuuuaagagccauccccaaauucugcugaauuuggcacauaaacuuguguucagucuauccuuacuugaaauuauacuguuuuagacaacuuucuagacugaaauccugaucuuuuagccuguucuccuaugugggagacaccuaauccuuugaugauucuaauucuucucaggagugcuaaaacagaccuguuagccaaacugcaugaaguauuuuuugauuaacuguauuuuuguacuaggguaaaggaaauguuuuuaguuucuagaccuuauuuguugggugcuuugcuuuuguuuuuugagacagggucuugcugucacacaggcuggaugcaguggcacuauugcagcucaguacagccucgaccuccgaggcuacagugauccucccaccucagccucuggaauagcugagacuacagggauccaccaccaugccuggcuauuuuuucuuguagggacagcguuucucuuuguugcucacgcuggucuuaaacuccugggcucaggugauccuccuaccucgaccucccaaagugcugggcuuauaggugugagcugcugcacugcacccggcagggugucuccuuuugaucugacuaaccauaucaggcaaucuuaaagcaaguuuggcuguucuuuaacugaaaugacauauucuaguuguauuaaugaaaauucaaagucaauucuaugaaaagaagucuugauaaucaauauaguuacuagauaccuagauaugaaaauaucuuccuuuguuuugacuuuagaauuauuuuacugagauuuauaguuagugaagcuguccuuaaaucugaagccugugugugauuuguauauagaugguccccuacuuaccacgguuugaccuacgauguuuugacuuuaugaugguugaaaacaaccugcauucauuaugccccuugacguacaacagggcuaugucugcuuagguugaaaauacuguuaaguugaaagugcacuuucuggccaggugcagugguuaaucccagcacuuugggaggccaaggcaggcaaaucauuugcagucaggaguuugagaccaaucuggccuacauggugaaacccucucucuccugaaaaugcaaaaaauagccgggcacaguggcacacaccuguaaccccagcuacuggggaggcugagacccaagaaucacuugagccuggaagguggaaguugcagugagccaagauugcaccacugcacuccagccugagacucugccucaaaaaaaaaaaaaaaaaaaaagaaagaaaauguacuuuuugucuuugcuuauuucuccaagaaaaugaaaaugcacuuucuacuuaaaugauauuuugguuuauugggauguaaccccauuguagacugaggaacauuuguaauuaauuucuaucucaauuguacucaauaaaaauauuacaauuuaaaggaaaucuaugcuccuaaacuccaagaguuugcuuacgucacugauggugcuugcagugaagaggauaucuuaaggauggaacucauuauauuaaagguaauaauaauuauguuuuccuaguugcaaaaaagaaaccauguuacuaaguaacauaaguaguuauaauugaaucucaaauacuacaauguaaaaagucaaaacugagguauuaggauccaguucuaagagguuaaugcaucaaaauauugacaaugguuaugguuggauggggaauguacuuaaccucuaagcucugcuguauaaugugguguaugugucuacauucauuaacaggcauuuuuaaauuuuguuuaauaggcuuuaaaaugggaacuuuguccuguaacaaucaucuccuggcuaaaucucuuucuccaaguugaugcucuuaaagaugcuccuaaaguucuucuaccucaguauucucaggaaacauucauucaaauagcucagguacugacauuuuuauugauucaaugguaauguuauuaauuacagguuuuaguguauauauagucuuaaauaggcuauaccacaaaaugacauauugacuucacuccuuaauucuagaacaaaacuuuugacgcauaaaguucuguccccaguguuuauguugcuuaauauuucuagaaaaacaaaguccuuacacuuuucugaguacuuucauucuuuaggaguccaaacuaaaguaucucuuuuugauauaaaauggggaaaagcauuuuuuucgccaguuguguuuaagcuuuauaauggcauagaauuauucuguaugaugucuuuacauuuggauacacagagugccuaucaaguuaaauaucagaauuaaaauuacuuuguuaaaaaaauuuuuuagaacauaaauucaaaguaaacuuuuccaggcuagcauauuuaacaaaguaaguaaguagaggaggaggaggaucuggccgggcacuguggcucaggucucuaaucucagcacuuugggcggcugaggcaggcaggcagaucacuugaggucaggaguuugggcggcugaggcagccuagccaacauguuacuugggaggcugaggcaggagaaucgcuggaaccugggagguggagguugcagugagccgagaucgcacuacugcacuccagccugagcaacagagcaagacuccaucucaaaaaauuaaaaaaaaaaaaaaagaggagaucccauucuuucuugcuuacuucucguaaguaaucuuaaggcugcuguaucugccauauaacaaaagugaagaaaaucuacccucuuauucuaugugggaugugaaaaucuaacauauggaagacauuuggggauaauuauuaagucaccuagguuaaaauuugugggcaguggugcuuaaaucuagcacauuaugaauacucaaauuggauaaccacuaaguauacugaaauugguuuauuuuauaaaacuuuuuauuaaaagcuuaauuuuuucauccagaauuccuagcaucccaaauuguccuaggcagcuauacccuucugauagugaugguaaaucuuugauaagccgauaaacaauguggacuuucuagagguauauaacaguaauauuucacuuccaauucccagcucuucucccauuucuccuaccuucuggaccaaugaggacaaacagaauugaaguuuaauuccacugcacaaguaucuucucaaaucugugaaaucuaccccuuuuacacuauaccauuccacugcuacuaguucagcucuuauugccuagauuauacagccuuuuaacuaaucucacugcuuaauaaacauguuuucuucuagucugucugcuucacugcauucuaagguaucuuucuuaaaauggaacuuugauuuaaaaaucuuccaguagcuucaagaaucagccuauaaaauucugacuucuuaaagacccuuugugauccaaucuagaccaugccucuuucuagccaccaccccucaucuuucuugauaagaaaugaagguacuccuuauuuauuuuucaccuuaggaguucugaacugugaacugaguuccaaguaaugucccuauaccuagaacauucucugccuccuacucuuccuggcucccuuaucuuuuaagacccauuuauggcaauuugaggccaucacuaucuuuuccaaucuggauuaggugcccuuccugcuaguacaugucacacuguauugcaacaguccuuccuugucuacuuccuucagguugguggcuuguuuuuuuuuuuuuugagacggagucucgcucuuucgcccaggcuggagugcaguggcgcgaucucugcucacugcaagcucugcaucccggguucacgccauucuccugccucagccucccgaguagcugggacuacaggcgcgugccaccaagcccagcuaauuuuuuguauuuuuuaguagaggcgggguuucaccguguuagccaggauggucucgaucucgugaccuugugauccacccgccucggccucccaaagugcugggauuacaggcgugagccaccgcgccuggccgggugguggcuuauuuaucucuagaucccuaagguuuuagcaagagacauuuaguacucaucuuucuccuaaauugcuuguacuuuuguuuuuccuguuagcuuuuagaucuguguauucuagccauugauucauuagaguuccaguacagaauacugacugcugcugccuugugccauuuuaccuccauugaagugguuaagaaagccucagguaagacucucuauuuguugucuucuuaccuuuucacaacuucuaaugggacuacagucucugaacuuuaacauucugcuaaacaugcauuuaaaacuuuggcaaaaaaaaaauuagcuguucaguaauuaucuuucuguuagaaguacuuuccaauccugaauguguaucaacaaaaagaccaaauggaauuuaaauacaguugaaaugaaucaacauuauaguucugcuuuaagaguucuuugggauuugaccauuucaauuucauauguagaagguacugguuaagaaguucugaaguccuuuuucccuucaacauagucauguaaauaguuugagagugauaaucuguuuugacaugcuaaacuucuugguuaugauuugguuucuuuuaaaauaucucaaaaacagcaacaaguacaucagacauauguaagauaguuucugauguacaaccuucaugcuuuucuaacuuuuuucuaucuaucuagguuuggagugggacaguauuucagaauguguagauuggaugguaccuuuugucaauguaguaaaaaguacuaguccagugaagcugaagacuuuuaagaagauuccuauggaagacagacauaauauccagacacauacaaacuauuuggcuaugcugguauguuuuuuugugaguuuuuuggcuuugcuaucugaaucuaguaagucaccaaaacugaugguaggaauagaguacuccuucaggcaguuucaggggaaagaaaguucuaaggggcacacugauuucaaaauguagaaaaguuaauaaaauuacuuugaaaucaaagcaagauuugugaagugucucaagaucaaugccaacagucuagauaaagaguuuaaaaaauauauaacguuacagaaacuuucagaauaugacccuucacacuugcaaagacauaaaaagacuauuaaaauuaggccuaaauaaucucaaauaaguacccagaagucugguuugacuuugauuuaugaaaucagugcaugauuucuucccauguauaggaggaaguaaauuacauaaacaccuucagaaaagggggacaguugucaccagugugcaauggaggcauuaugacaccaccgaagagcacugaaaaaccaccaggaaaacacuaaagaagauaacuaagcaaacaaguuggaauucaccaagauuggguagaacugguaucacugaacuacuaaaguuuuacagaaaguagugcugugauugauugcccuagccaauucacaaguuacacugccauucugauuuuaaaacuuacaauuggcacuaaagaauacauuuaauuauuuccuauguuagcuguuaaagaaacagcaggacuuguuuacaaagaugucuucauucccaagguuacuggauagaagccaaccacagucuauaccauagcaauguuuuuccuuuaauccaguguuacuguguuuaucuugauaaacuaggaauuuugucacuggaguuuuggacuggauaagugcuaccuuaaaggguauacuaagugauacaguacuuugaaucuaguuguuagauucucaaaauuccuacacucuugacuagugcaauuugguucuugaaaauuaaauuuaaacuuguuuacaaagguuuaguuuuguaauaaggugacuaauuuaucuauagcugcuauagcaagcuauuauaaaacuugaauuucuacaaauggugaaauuuaauguuuuuuaaacuaguuuauuugccuugccauaacacauuuuuuaacuaauaaggcuuagaugaacaugguguucaaccugugcucuaaacagugggaguaccaaagaaauuauaaacaagauaaaugcuguggcuccuuccuaacuggggcuuucuugacauguagguugcuugguaauaaccuuuuuguauaucacaauuugggugaaaaacuuaaguacccuuucaaacuauuuauaugaggaagucacuuuacuacucuaagauaucccuaaggaauuuuuuuuuuuaauuuagugugacuaaggcuuuauuuauguuugugaaacuguuaagguccuuucuaaauuccuccauugugagauaaggacagugucaaagugauaaagcuuaacacuugaccuaaacuucuauuuucuuaaggaagaagaguauuaaauauauacugacuccuagaaaucuauuuauuaaaaaaagacaugaaaacuugcuguacauaggcuagcuauuucuaaauauuuuaaauuagcuuuucuaaaaaaaaaauccagccucauaaaguagauuagaaaacuagauugcuaguuuauuuuguuaucagauaugugaaucucuucucccuuugaagaaacuauacauuuauuguuacgguaugaagucuucuguauaguuuguuuuuaaacuaauauuuguuucaguauuuugucugaaaagaaaacaccacuaauuguguacauauguauuauauaaacuuaaccuuuuaauacuguuuauuuuuagcccauuguuuaaaaaauaaaaguuaaaaaaauuuaacugcuuaaaaguaaaguuuugccauugcuuggagaaacuuuuuuuuccuucucugcgcugccagcuguaacacuucuucuggauugcuugcauucaacucugucuggccgauggcuuugaucuuccaaaacagaaaagugauguuauuagaggugugucaaaaauuaaguuuuguugguacaaguaauauaaagcuaccuacgugcuaacaacgauacaguuuaaugauuaacugaaccucuuaacuguaaaacccaggagucuuggaaaaaaauuaacauaaagauuaaccagggccacucucaaggaaagauggacugcugagccauaguuuauggaauuacuuaaguggcauuuuaauauauuaaguaaauucauguaaauuuauuugaaagu

SEQ ID NO: 13894 - RNA, 1760 nt, Homo sapiens
uuuuaaauaugauuaucauaaaaauauuuuaaaacagagaugaaauguguaaaggcagauauagaucauccaugguuacauugguuacaucacauuucuuuagaaacagaacuguuucuacuccuguagacaaacuucucucucacacauuuaaagugagguuagugcugacauaaaauuaucgcucuacucaccaucugaguguuugcacuguguuugagguacauuuucuucauuuucacagccccaccacucuugagaguaugagucaacagaaguuugcaggcuaaaaccauucaauaauauuuucaucaauacuggaaugauaguaaguaacauuacacaacaucagaggccaaaaauuuuucuuuguugaagcccaagauuuuaacuuauucuucauuaccugaaaauacugcucauuuaaccucuucaggaaaaaaaaaaauucuguagaugaauaauuccugccuuaaugcuucacccaagacaguuccuucauacuuauccuccaaugcuuuguucuuuucauccauuugauguagcaggcaacaagaaucaccuuuccuuuggugaucugacauagcgaucucuuauguuuuugcuaauuguuugauaaauauuuaguaaauuuuuccacgguauguaugcacuauuuuuuguaguuccaauucuaaagguuuuauuaaugaaugaacauugucaucuuaaaagaacaauuucucagugcuucauaaacagcucuaaaugcugguugcuuaucaucaugguaaacaccucuguucccgugaaaaauaaagauuccuucuucugcuucuuggcaacugcuuccauauagacagugaucuggacgacacuuccauugacacggaaagacaaaaaggcuuucuggauuaugaaaaaacaggauauccaacagaucuugaucgcccauguaauguuuaacuuguauauuuuaagccaugucauaaguauaucuccucauuguagucacacaguugucauauuauucuugaaauacuuccuucucauucaagucauguuugucaacauaacuccagaguuuacuccagcuuuuccacacuauggaugccuagcaaagcgacuauaccauccuauuugacauuccuuguguucuggggccauugcagaauuuguguggaauuaaauuucuuuaguaaagaccaaauauuaucagcuggucuuuuaaaaaggcuaucagugugagagucaacuucuuucaggaauaacggcaaggacaaucucugcaaaccacaugguuuaaagaguuuuuccacucugcugcauucucacuuggaaagguuauggaguauauuguauaauuaaauauuuguagaaaugaccccugucaagccuuccuuuaaagcuaugauguaguugaucuucagcaaaaaucuggaauugaagagguuugauccugaaaauaauagcugacuucaacauggucauaguuucuuccagucuuucaccuagauacauuuucucaacaggcuguauuuucagacuacaccugucccaccugcggggaugagcagcgggacaagcgcugcucgcgccucucaccgcaccgcauccgccucccgccagccaggaagccacugcggccugcggcuucccgccaccacggcccgcuccuuccuccggggacacggggagcuggcugaaggcguaaaggagcgagcagaagccucaggccagacacagagccaccacgcgcgguagcgccgcauggccccagc

SEQ ID NO: 13895 - RNA, 3472 nt, Homo sapiens
aaguaacauauuuaggaaaauguuugagaagccuuugguuuucuuuagaguacagcccaucuuuuuguaucuugaguuuucuaccuguagguuugcaccucaguugguaugugcauugggggaucccaagacaacccucagguuuaaugauucacuagaaggacucaacugagaaaagcagcuauacucacaguuauguuacauuauaguaaagaauacucaaagcgguaaggaaaagguacugaguccagggcagaguccaagagagaccaggcacaagcuuccaguuguucucugccaguggaguuuuauggacaacacuuaauucugucggcauuggugagugacagugcauauagaauauuguccaccagggaaguucauccacgucuugguguccagaauuuuguuuggggucaguucuguagucauggaacaccugcaugacugaccuuaguuaaucagucuuuagccuccagaaaucaaacuacaugauccaaggccccaccauauaacauuguuagcauaaacuaucugguguggcccaagugucugguaaacagacacucauaucaggcaggacauuccaaaggccuagagaugaucucuuagaaguugguugaaggccagauuuuuauuugaaaugugcaggguuugaacaucaacacuuuaaugcacaguaucauugauaaaucuuuaaaccacagggauccaccuagagccuuagcugauuacauguauccuagguaguucucaggggcaaaucuuuagcuauuuggacugagaaugaaccuccaagcccaugcuacacuugguucuuuccauucuugcuguccauacucacugucccauugaugaagaucuauucucucacucuugcaugauacucuuguaguuauuuuacaguaccauaguaaguguucacucaucccuuucuuucugccaagaaaaagcuaugaaguagggcaugcuucacacaccugagauuuguuuucugaagcuguauguaaaauauagaauuccgaauuuuaaaacauauuucugcaaauugcauguguggaaggggccauuaguuucuacuguacucucagaauucucacuuauuuucuauaggcaaugucuagaguauggagagauggucagaaauauccuguacauauuuacagacuccuaacuacagguaacaacccuucagugugacaaaaauguauacucuuugaauaauuaaaauuauuuuuuguuagccugugcuucagugucaggaauauauuguuauuuuauuaacuaguauguuacuaaacauuauacccaacaaaaauaaugaacauaaagaucugaaggaaaucuaauuaauguuuucucuuuagguacaauagaagaaaagaucuaucaaaggcagaucaguaagcaaggucuuuguggggcaguugucgaccucaccaagacaucugaacauauucaguuuucaguagaagaacuuaaaaauuuguucacauuacaugaaaguucagauuguguuacucaugaucugcuugacugugaguguacaggagaagaaguucauacagguuaguuauauuuuaauucuguuacuauguaguaaaguuaauuuauuucuuguuagcaguugaaaauauuuaaagaauaacuuuauaauauuuaccauuugcauauguuaguuuuauuuuuuucucagcucauagggcagcugccagauagagauauuugagaaaauauucaguagaaucuuuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggcccaguagacucuuauucucugaauuuuagcuuuuuauuucugaaucacuugugaaaaauugaacuuauuuaggaaaaucuuucaaguccugguguaauggcuuuggaguuagaguuuuuuuuuuuuuuuuuuuuuuuuuuuuuuuuuuuuccaagacagggucuggcucuguugcucuguugcccaggcuggagugcaguggugcaaucauggcucacugcaaccuccgccuccuggguucaagcagucuuccagcuucagccuccugaguagcugggacuacaggugugcaccaccacaccuggcuaauuuuuguauuuuuuguagagacgagauuucuucauguugcccacacuggucucgaacuccugggcuccagcgaucugcccgccucagccucucaaagugcugggauuacaggugugagccaccgcauccagccagaaaaaugguuuuaaucccuauuucucuuucgcaaaaaaacauacaguugacagaauaauccuguuguuuauguuguacagaauuuauucauaauggggucauauuuucugaggcacuuagaagcauaggucaccauacuucucaguacuugauguaagugcuagugcugcuuaaguaaagcugaaaauuuacccuccagaauagacaccauucaaaaaggaacuagaucaggaguaggacuugagcaaucaaugucuaguagcugaaaguuacuugaugaauuauauuaagauagguugaagaaguuagacuauauaagacugagauggaagaauuuagauuuuauauaaacauaaauauauuuuauauaaauguuucucuucuauggaaauguuucuuuauauaaauguuucucuuuagguacaauagaagcuuauuaguuuauuaguuauuugucauauaaauuauauaugauuauauuuauuaguuauaugucauauauaaauauauaacuaauaacuaaauauaauaaauauaaucaugcacaauauauaauuauaacaauauauaauauuuaugguaguuaaaauauguauauauuuuuauuuuuuaguggguagaauuuaaacuucauagaaauguuuucagauuuucuucauagccauuuugguaauuaaaaauauuaauuaacacuuuauccucccuauuaaauuuuuuccuguuuuaauaauuucucuucuuuucuccuuuuuccuuguauuuacucuaauguucuuuuuccaauauuuaaguuuaauacuuagcuuaaugauuuuucagucuucuuuucaaagaaguggauauuuaagacuauacauuuuccucuaagcugcccauaauuuugauauacagucuuucauuauucaguucuaaauauuuuguuuuuucauuaugauuucuucuuugucucaugaguuauuuaaaaguauguuuuaaa

SEQ ID NO: 13896 - RNA, 1912 nt, Homo sapiens
guagcacuguuaacugcuuucuggguagccucuuuagcuuggugggcuuguaguacagcuacagcuucaucaaccuuagaacggagugacucuggagacucgagcauauaaagaaguucugaauuaucaaucuccaacaacaugccagugauuuucccagcaagaguagggugcauggcuugaauaagaggaaagagccguucaccuaacauuugcuuuugcuuuugaggaggggcagaugccaaccuggaggcagucaaaguuuccugaccuuguacaugaacagcaagcuguugcauuguaacuuguggcugugcauuacgauguugcugaggauugcgaacucccgcagcauauuuauaccguggaaccgugcgcacagcagggguagcugcagcagcagcagcagcugcaggacguggacccacugucuguguugauguguuagcaacacgcugcguugacaugacucguggaaccugugaagaagcuggucucauaguacuaaaugguacucuaggagcaccugggcggauagcacugggcuuauuuuggaauggaugaggucuggcacccugagcaguccagcgaggacuuggucuuagucgagcaauuuggcuaggaggauaguaugcagcaugguucugagucugugggacagcugucaugaaguaaccugaaggaggugcucgcugguugggcacagcucguacacuugccauucucugcauauacucguuagugagguaagccuggcgcucuucuuugcgcugagcuaaagcuacauacaauggcuuuguggccacaauucuaccguucauuucuguaacugcuuuaguggcuucuucuggggaggagaaacauacaaaaccaaacccuuugcugcgaccaccuuccaucauaaccuuugcacuagugauuguaccaaauggagaaaacgcuuuccggagacguucaucaucaauaccaucaucaagauuuuucacauaaagauuaacaaccugguaucuggugauccuaucuugcuucaucuguucaaaugugcgcuuaaguuccgucugccguuccacuuuuuucugagcucgaccaacguaaauuuguuuuccauugagcuccuuuccauucaucucaucuacagcuuucugugcaucuucaugccuuucaaagcuuacaaauccaaauccuuuggauuuuccacuuucaucggucauuacuuucacacuuaaggcgggcccgaacuugccaaagagauccuuaaggcgcucaucauccaugucuucuccaaaauucuugauguaaacauuggggaacucuuuugcccuagcuccaaguucagcuucucguucuuuacgagacuuaaauuguccaacaaauacuuugcgaccauuuaggagcauuccguucauuuuuuuaauagcucuuucagcugcuucgugugucucaaaguguacaaauccauaacccuuggaaccauuuucaucacaaaccacguuacacgaaaggauguuaccaaaagcagaaacuguaucauacagugcuuuauuauuaauggacuuauccagauuuuuaacgaauauguugcccacuccacuuuuucgaagugauggaucacgcugagaccacaugaugcguacuggcuugcccuuuauaacaucaaaauucaugguguccagagcaugcuccgcguccuucguaugcuggaaguucacauacgcguaguuggaggagccgcuggugaucaagucccugcagauccggauggagaggaugggcccugccgggcugaacuucucguagagcaucgccucagucacgucgggguggaggucccccacguagagcgaggccguuggguagcugggggugcugggguucauucucggcacggcugcccgcaggcacacaagccgcg

SEQ ID NO: 13897 - RNA, 53113 nt, Homo sapiens
aggaguuuccucacuccccgccuggccgucgcuccuccgcugacuccgcgcccuucuacgggccgucucccacccucugagcggacgcagggagucgaugccgggcgaaccgggcgccaugaagggcagcugccuaacgggcgccgcggcggaggggcuggccggcugagggcccgcgcugggccgaggcaugcggagcccgggcgggauccugcuccaggcgcugccccggcugcugcagcacgccgcccucccgggccucgccgagcugccggcccgcugggcccugccgcggggugcgggcggggacggcccggcggaccgccuuccccgcgggggcggggcgagcgcggcggcggcagcagcggcggccucgggcgcccugcucggcgccuaucuggagcgccacgguccgcccgaggcuucggagcugccggagccgggcggggccuuggcgggcggccccgggaguggcggcggcggcgugguggucggcguggcugaggugagaaacuggcgcugcugcugccucggcagcaccuguuggugccggagccucgugcuggucugcguguuggccgcccugugcuucgcuucccuggcccugguccgccgcuaccuucaccaccuccugcuguggguggagagccuugacucgcugcuggggguccugcucuucgucgugggcuucaucguggucucuuuccccugcggcuggggcuacaucgugcucaacguggccgcuggcuaccuguacggcuucgugcugggcaugggucugaugauggugggcguccucaucggcaccuucaucgcccauguggucugcaagcggcuccucaccgccuggguggccgccaggauccagagcagcgagaagcugagcgcgguuauucgcguaguggagggaggaagcggccugaaagugguggcgcuggccagacugacacccauaccuuuugggcuucagaaugcaguguuuucgguaaguggggucccgcuggccuaucccucuccaagucuguuuuugagcggucuuguggcggcccuaggagggcgcucuaucagauaaauaccagcagagaagugacauugacggcaggaguuacgauuacuuuccaucgcagccugggaagucuguccuacacauaaaacauaccuaacgcggagccucgaaagagaguuuguuagauaaaaaacuaauguuucuuuuagggaugggaauguaauuaaaaaugaaaagcccucuuaacaauaggcaugcagggacaugaauggaaaugcccaucuuuaauacuugucaucuuuuguagcagcuuuggcaacauuuagggaggaaagcuuucucucuugcuuacauaaauacauccaggguuuugauucaaguuuuuagcgacauggaccaaaggaaguguuucaguaaacaguggaggagcuaguugcagacuccagauuuuggaguuugcuaaauuugaaaugggcuuuuucuucuucaaguaauugugcuuuaaugugauguaaagaagaaaauccuacuguuuaucuuucuuucuuuggaggaacuucauuucgaaaucacgggguggugaauaaaacagaacagauaaucuuuugcucaguuagcauauauuuuucuucuguaucugcaccauuauagacucuuuucuguccuuguauucauauguuuugcuuacucagguuucuauagcuagugugcaucuccaugcaacugauuuaggauagaaacacugcuagugaagagaucaucuuauuggaagaaaggaaucuggucuuuacaaacuuugugacuuuggaucaaguuacugacccugucuggcuucacuuuucucuuuucgaaagugaaggacuuaaaaaaguagauuaccauguuccccaaauucagugauucuaaacuaccaagaguuuauguagauucccaggaacuuaacccuucagcuagacuuaaagaaaacuuacugaaauaaagagauaauugcauucaaaaccauaggaauugauguauuuuaagugauucugaugcauuauuuuguuucaaaacguaaauuauuguuaguuucuggaaacuuucucauuuuguuuugaauuaggaauaauacuaaccaaucugccucuuugugaugaaauuaaaaccuuucucuuuuuucuuuucuuuuaaaugccuuuugcaaaccucuugauuccaagcaacagcagcaaugacuauggaaugguauuugguagaggcaguggaaacagauaagggguuuucuguagagauaaaguuuaguguuagcaguaguuugguauagucuuagucuuaaauuucuuuuucauacccuccuauaguaugaaauauaaacuugaacuuugacccagucuuggguaauaauaaauaaacugucccaggacuuugaaagaagguugggcuaaggaaccuaaauagauugauucuguuaguuuguguuucaauauagcauguauccuugggccuuuucuuguccaucuaccgugugccaacuacuguccucggcucuuuccacauauuucugauccuuaaaccagcccugcagaaguuaauuaugcacauauuauagacuagugucuacuaguugggagcacagggcugguguugugaaauccugcugucugcuuagaaucuagugaccuugggcaaguuguuuauucucucugggcuucaguuucuuauuuguaaaaugaggaaaguaaugauaccuacuuccauaggauuauugagaagauuacaugagaugaauacaugcagcagagccuggcuuaacaaacacguguuggcuuuugucguuucuguuguuaugacccaaggucaccaagguacuaaauuaaugguagagucaaacuuugaaccauggucugauggcagugucucaaccaaccaccucuuuauuucuugaauauauauuuaaugccugguguagucauggguaaauaguaagggcucauuauguauuuaucgacugacaauaagguaggcuuuucuuuugauuuugucucuuacauauuaaguauauaacuaagagguuguauuuugugcuugguaauaauuuaagguaaucauguaguugaaacugagcuugacaagggacaaaucucaauuuagcauuguguggucaauaaaaaagaagggaaaaaaaagaaaaauggccucuugcaauagguauuauugucaccauuucacugagaagaaacagaggcucaaccauccaggaacuucuucagucacccaccuaccaaguggcugagcuaggguuugaacccaggaucagcugauauggugcaucuuacuguaaaauuuugacucagccauagcaggguggacugugaagccccuggauauggucuguuauguccuguuuauaccuauuguucugaacugccugcuuacagaaguaguccuuucaacaaaaacaguuuacugaauucagccaagauaugugaaagaaaagaaagcuuaguuaaggcugauguugguuuuagucugacuugacuuucugccuucuagaacuccauucugccuccucauguauccucuccaccucauaccccuccugcugaccauagcugcccccuuuucuaggcauauuucuuguguuuuccacaucccucccuaucuuugaaaucauccuuuuuuuuuuaaagaaaaaaauuccaguuaaaacucauuuuuuuugugugcccauaauuagagaaauucaucugggcguaccucaaagaaguuagguguaguggucaugugaggcccaggcuuuggaaauagaugauccugaauuagucugugccaucuggccuucuccauuuccucaucuguaaaauaaaguaguuaugaggcuuaaaaaagcugauacagugaaggcauuaaguauuuugucuggcucauagucacuucccaguaauuguuaagugucauuauuguuuguagugguggagguaguuguauucacauuuuagaagcaggagcugauuguaaaggauaauauauggaagaaggaaaggugcuuucccuugcuuaucuccucugaaccauuuuuuccccuucucccaugcaugguagaaacuugaaaugagauugguuccaacauuuacagugucaucuugaaguaguuauaguuacucuuuugagcuauacuuucuguugugggauguguuuaauaauaccugcugcaaagcugugauaaaauauauaguuugcucauuauuuacuauuucuuucucaccauccucugccuuccaaaauaaggacagugaaguugagcuacuuuuuaaaaaaauuuaacaaauaccuacauuguacuuaacuaauuccugggcacuguuuaaucaugcacacauaacuuauuuacuguucauuucagcccugauccucaucuuauagcugaagcaguugaggcacaguggugaaauaacuugcucaagauuacacaguuaguaaauguuuagagucauuaacuuauccaggcacuaguguugguccaagaagagcuggauuucccagacacauccugauuccaguuauagaauacuugucuuagagcaccuuaaagaucagacauuauggaggacuggguaagguucuauacaguugacuuagguaucaucccagauguuagagcaggggucagaaaaccacagcccaauuuuguauggcauacaagcuaagauugauucuuccauuuuuaaaugguuggaaaaaauaccacaagaauauuucauauacaugagaauuauaugaaauucaaacuucagcauccguaaauaguguuacuggaauacagcugugcucauuuaugugugugcuaugugugucuccuuuuaagccaaaacagcaaauugaguaguuacuacagacccuacugccuacagagccugaacuguuuacuaccuggugcuucauggaaaaaguuugccaacuucugccuuagagucacaccaacaaaacagcuaccaaggcugagccccugcaacuguaggaagaggcccuuaauuucucacauauaucuuguauuuuuauuuaacagaaaaaaaauuuuuaaagcaauaaauggguacuguguguaaaaugcaaacaaaauagaaaugaguaaauuuuaaagugcaagaccuuacccaucacccuggcucacuucuuagggaacugcuuuauagaauugaauguuaccaaacugccaguuacuuugguuauuuauaugagcccaccauagguuugaagcaacaaauagauucuuuguuuuggagggagccggggagcugugaaacugguacugacugaaauaauaauagugaaagaugucaucauaacuuuaagcagauauaacuguucucaaguuuucuuugaguuugcauugagcuaucaagaagauaaauuacuuuuacuaauuuaguuuauauuugaacugaaauuuauuacaacuaaauaaaaguuuuuggcaaaugacucuaagaccacaaauacaguauagucuuagcuuaugcuauggggucuucugguucugucuuagcuccuuuguagcccuggcgaagugauuuaaugauucuggccuucaguuuuccuuauuuguaaaaugagaggguacagaugaggucagaguuugcuuuuaaaaagacaaauguucugagcaacaguguaacauuaccuuuuauuuuuuaacaguuuagugauaguauguguuauaaaaauacacauuuucucauuuucuugaguucuuauucuguaauauguuuucuuauuuucuuaauucuuauucugugcuguagauagagccauagauucaaaaaaagauaugaucggucauaauacuugucacuguaucaguguaucuaaugaugauuucuucuuacuauuaaaguguaaugauucgcugccagugguacaguucaggcaaaauagaaaggcagacacagucuguguuuugaaagaguuggagucuggcccuuaagggucagauaggaugaacaaguuguguaaugucaucucagugcacauccugagaccucacaauaccacugaaugcaguugaccuuuauuuccuugaaacuguuuuccccucuuugugucucuuuaguuaucucaucagcuucugcaguuuuugugucauauguaggcuuacaauucacuaaucuauaucucuagccuguuauauuaauguauauagaguauguuuuauuaacccuuccuagauuaaaaaaaauuuguuuaaaagcaacgagguuauuaaaacauguuuuaacaauguuuguuuuuucugucuguauguauucauuguaaaaacuuugaaaaguauagcaaguacaaagaaaaacaucauuaacauuuucguguuuauuuuucucuuugcauuuuauugauauguauuuuaauauaauauugaguuaaugauuuuugugaccuucuuuuacuugaaguaaugaacaucuuguuauuacguguauuacaacaugacuuuuaaugacugcacagucagcuguaguuuuccaucuuuguaucuuuuuuauucugcuuagaacugggucuuagauauauauagaaggcauaugauacauguuuuaguacaaauaauaaaccuauaguaugucagacuguaugaagaaaagcuuuucaacuuguguuccagaaauuauguacaauaagauauacauuuuuccccccuugagagaagauucaaggccucuguguguaugugggugggaggguggaagggggguuacaccagauucucaaauaaauuggugaccucucccuaagauauuugggaaccauuaaaagcaguuccuaauuuagggacagugaagucaugaaaaagcuugcauaugugaagaugcuucuguguuguagacagacauugaccuaaccauuucugucaguagaaaucucuuuacccugaagcccucucuagcuguuaggguagggucucagcacugcugcggccuucuuguucuuuuuuuuuuuuuuccuccaguagcaagacuuuuuucaguacucucaggguugcuugagagacccuaaccagagggucuuagccuugacauuagguucaccauggcgguuucuggaaauauuuuuaguauucauucaguaaauaauugguaggugccuaguaugugccugcugcuguuuuaaaugcuggagguguagccgugaauaaaagaaagucucucccuugaggugguagcauuccaguggagaaauagcauucuagguaaaucaugguguaaguuuugcugauaauaagcuaauuuucauuuauaacauuuuuucuguguguuuggcagaguguucuuaauuucugaaaauccgauuaaaaauggacauugcauuccaacuuguuuauaaacuggcaacuauucuagguuuccauauuuauaaauaaagcauuauugguguugauacauccaaccuccaauaaacauauauuuagcaacuaauauauaguaggcauuuguuaagaucuagggacacaaugaggaccaagaacgacagaucccuuuccucacagaauuuauagucugggaaaggacugaggggcaaacaaauggugaaaccuucaguuguucuccagugcaaaggggacagggaaguauaguguucugucagagcacuugaaagcacuuaacaaagacuuggggcaucugggaagguuuccuagaguaauugaugacugaguagugaaagacaguguaggaguuuucggaguaaauggagugggaagaaggaugugcuuguuguacuccccagaaggaacaacguagaaaggcccagagggaaaggggagcaaguaguguucuaggaacugagaaaauuuugaugugacugggacauagugugacagggugcaugaaaugcucagaggccagaucaugaagcacuuugcacucugaagaaccucauggcaguaggagggaguuuaagcaggauuaggcucacuuuuuaaaaagauuucugcaggguuaccauagguagugaguggggguagucuguguagucaggaccaaagaggagacugaauuagaaauaggcccagacgguggauagauuuccccagagaaggugcgguugacaagauguaguagauauugaaugugggaaauaaggaauuagcuaugugccugacugaugaggucuccagcuagggccgcugagauugggaacacagaaaagaugaagagguauuuuggggagcaaaggaaagagaauagguaguuaauguuuuucuugaaacugauuuuuaaaguuuugauuuucugagagugaaaaauaguugccgcuucugaauucuuuuucucuguuccccaauuuuucugaaauauuaauaggaaguauuuuggggauauguacaguaaaauuaucaguaaauauuaauuagaugaaaagaccaaacuggucauuuuaauuucucuugaccaauccuuucuuaacagucauagggauucaugauuuuuuucuauagggauucaugauuuuuucauauauaauauaauuaaauguauuuuaauuggaauuuauaauauuuuaacaguaacuuuguuaauaagcagcaucccaaauaccaagcaacaagucuauacaggaagguauaauuugccaaaauuaaugcuagauucacagagcugcacauaaaauuugaggucuucugaauacuggucaccuuuauauuuuuuauuacauccaugccaagauauucuauguaaaaacaaaguuucuggguggguuaaaucaaagugguaaagccauuguguaaaaagcuauaaucuuagaaagcagaagagcugggucagguuuccugagagcugugcuuggugcugugccuaagaggaccgaccacaaccccagcuucagugaaugaucugaagacagagguucucuguugucagcuccagaaaugcuguguucagaggugaaucagcucuugcucuucagaauuaguuuuuuuuccucucauuuuuuucccucccagauggaguacuucuuuguuuucaggaucuauuugguauaguggugaagugauguuccacauguuaaccccugcugacccaguuaagugaaucacaucuccaaguauaucacuguaccucugggaauaagaggauauauaauuuuauagugcuucuagaguuuuuaaaacaugagaugacagcaaucaguugguguuugccaucccuuaaacucuugcugugguaucucaucauagaaacuaacuagcaagauagcaucgauauccuagguugagaaguguagggguucuuugauuuggaauacaacuccugagccaaaaugcuggguacugcaagcaggaauuccaaugguauugaucuaggcucauguuuaaugucuuucuacaaaguagaacaaggagacagaauuuuauaacuuuggugcuugaagacuuacuggggagagaaggcuggaugcaucuccuugugggaacaaguauuccaaauauguuugucaaagacugagcuagauggagauucugaguaaaauuuuugcuuauagaaaaugccauauuaaaauagaccaggugcaguggcucacgcguguaaucccagcaguuugggaggccgacgcaggcagaucaugaggucaggaguucgagaccagccugaccaacauggugaaacccggccucuacuaaaaauacaaaaauuagccaggugugguggugugcaccuguaaucccagcuacucaggaggcugaggcaggagaauugcuugaaccugggaggcggagguugcagugagccgagaucgugccauugcacucuagccugggcaacagagugagacucucucucaaaaaaauauauauaaaacaaaaauaaaauaguuuggaggaagcuguucaucuuuaauaaaguuauuaauaguuuaaaaccuguguauauguauguuacuguguugcuccauugguuaaagcauugagcccuccagcaaaaauauuuacgauuauuaacuaaaauuauauguaugcauaguaacacuguuucccaaggguaagguuuggucaugaaagguuugauaaacuucaguuuaugcaguuuaugcaugggcaacggucuuguugaguugagugguggaguuguuucacauuuaggaaaucuguucuuaaauuaccaauuugaauauuauugaugucaucuaugaaugucaauuauguguucuauuuagagaagcuucauuacauuuaaagguaaagguuguggccagaaguguugcauucugaaauuuuugaacugagauauuuauuuuaaagauaacuuccauaauauguaauguuuuguuauuaacugcaauauaauuuuauaacauucauuuuugucauauguucucauuuucuuuauuugacauguuuauucuaaagaaauuucucugcuccuguaagugcucuaaauugaagaaggaaccuugcucagcuuagcuccauucacaucauucuuugacuagacucccugguaccuuuccucugaguauaggcuccuuccucuuuuauccaaggccccaacaaguaucaccccauguaguuuuccugucuuuauuuuacgggauuugugugugucguauaaacaauccuagcuguacugccaacuuuaugaauauauucuguacuuucccugccauugcacucuagccugggugacacagcgaagaguccgucucaaaaaaaauaaaauaaaauaaaauaaaauaaaauaaaauaaaaugauuuggaagcuguucaucuuuuguucauucucuucuugaaacaccugccuuccucauccuaucuaucuuugcuugccaaacucauacuaggcuuucagugucugccuugaaucccucucuucccaaaaaguuacgcuuugguuuccacuucuacaacuaauuuucauccuuuauucuuuaaugcucagcauguaggccuucucaaugcuccccauucugccuguuucugagguaguuuauguguauuugucaguguguaaauccaucagugguaggcauugugucuuuuuaucucuuccaagcacuucuuggagcaucucgcaugagcaguugagucagugaucgauaagguggauuguuaacaaccagucacuguaauauucuuuccaaaucagcagugaugcaucuccaguucauuaucuauuaauauaguugaauguaguuuuacugaaaaugugaaaugauuuuuagauuugguuguauuaauaguuauagauucaccuauagcugauuaaaguaucagauuuuaaaauuuguaaaaaaguuuaauauaguggccaguagcuuucuuauauaccaguaauacucagauggggauguggaaaaguuacuuucaaaaucaguaguaguggcaacaauaauaacaugaagugcuuagaaauaaacuaacaagaaaugcaugagauaugugaauaaagugaccaaacuuuaguaagagguauaaaagaagauuuugaguaauuauagaaaaauuucuggauaagaauaccuaauauuguagagauuucaggucuauccagauuaauuugcagauuugccuuaaucccaauaugaaauguacugauuuuuuuugagugacagaaugaucugcaagaauaaauauggccaagaacaguuauggccauuuuuaaaagaagcguaaagaaggaguuugaauagaaugggaaauuccuugccacguauuaacugguagucuuuauuacaauuugguuucaguacgagauuugagauacccauguuuuaguucuaguagaagauuuaaaauauacauggacaguauuagagcuccaaauaagcccuuuuuauauaaaguaacuuuuauuucuacugaaguauacauaauaaguccauggagaaguuauugauuauuugguaucuaaugcugggaaaauuggcuacuggaacggggagggaucaggcuauauccucaccuuuaauuugaauaaauuucagaaggaauaaguggugaaugcuaaaaaggaaaacauaaucagaagaaauauauagguagaaaccaacaauauacucuuaaaacacuuucuaaagcuaaaugcaguggaaaaauaagaggaaaaaauagauaauauuugauuauauaaaaauuuaaaaacauuuguaugucaaaacauaaaauuaagagauaaaggacacuuuagcgaaaacuauaugcuacauauaauagacaacagauagcccucacuauauaaauaguucuuacaaauaaacaagaaaaacacuuaacaucccaauaaaaaaagcaaaugugaacaaaugaagccauaaggaaaugugaauaaaaaacauauguagaaaaugugucaauauaaaauaguacagauuaaugaugaaacaucauuuuuacuccuaucaaaauaagaaagauuaaaauuuaauaccuacaguugguaacaguaugacacaauggacacauucauguaucacauacugacagguguguuaaaucauugugaacauuuuggaaaauaaguuuuuuacuauuugaaccaauaauucuacuucuagugaucuauccuaccagaguuaagauacgugugucauguauugcuguauaccagaucacuucaaaacuuaguagcuuaaaacaaucauuuauugucucacaauuucucugggucaggaauuccugugcaacuagcuggguaccucugacucaggcucccucacaaugcugcaaucaagguuuuggccagggcugcaucaucuuaaggcuugacucgggcaggauucacuuccaggcuauugacuggcuauuuuuccagacuauuuuugcuagcuauugacugaagacaucaguuccuugccacauugggucucuccaugggagcuacuuagagcauggcagcuuacuugcuugaggaagaaguggaaguccuauucauuuuguaaccuaauuuuggaaguggcaucuccucacuucugcucuugccuguuugcuagaaguaagcacgagguccagcccacgcucuaggggaagggaucacacaagggcaugaauaccaggagaucaagucauuaggaauauuuuagauguugccuaccacagagguuaauauccaaaagaugucauuguaauuuuagaauuuuuugauaauagccaaaaauaaauguguaauuacauauauucaaaaaauaaagcaauguaaauauucuacagcaggagugguuaaauugugcuacauccacacaaugguaguauaauugcauaauaaugauaauuuucaccuuuuuugagugucacucauaugccagguauuuccuagauacuuuagaaauauuuuugauccuaacaacagccaucuaagcuggugaugauuuucauuuuacagaugaaaaacugauagcacuuugggagacugaggugggcggauugccugagcucaggaauucaagagcaaccugggcaacacggugaaacucugucuguacuaaaauacaaaaaaguagggccuggcgugcuggcucacgccuauaaucccaguacuuugggaggcugaggcaggcggaucacaaggucaggauaucgagaccauccuggcuaauauggugaaaccccaucucuacuaaaaauacaaaaaauuagccgggcaugguggcgggcgccuguagucccagcuacuugggagacugaggcaggagaauggcaugaaccggggaggcggagcuugcagugagcugagauggggccacugcacuccaaccugggcgacagagcaagacucugucucaaaaacaacaacaacaacaacaacaaaaaguagcgguguggcggcaugugccuguaguccuagcuacuugggaggcugaggcagaaaaauugcuugaacccaggugguggagguugcagugaggccagaucgcaccacuccacuccacucugggcgacagagcaagacucugauccagacaaagcaaaacagauauuuagagacagaguagcauauugaauuaucagcaccagaaugccauucuaggguuaucuggcuucaaagcucagcgaccacacugcuaauuaagaaugcuuaugaagaauguuuaaugauaugaggaagacuuacaaaacuguuuuuacaaaguuaucaauguguggauuuuauuuacaugaaagaaaaaauagucacaaauguuaccuuucaaugguaguauaauagaauauuaaaauuuacuuuuauuucauucuaaauuuucuacauucugcauguauucucuuuauaaucauuuuguaaacucagaauacuguuguaaagaugucagcuccuucccgaggaaauaccacuaguuagacuuaauacacacauuuuuuuauguugaauugaaauuuuacuugguaaugaaucauucccuuuaaucuacucuucuagauuacugaucucucauuacccaacuaucugauggcaucuucgguuggacugcuuccuacccagcuucugaauucuuacuuggguaccacccugcggacaauggaagaugucauugcagaacagaguguuaguggauauuuuguuuuuuguuuacaggugaguuuaaggccaaggguugucucuuuuuuucucucuguuucuuuuuguauggcauugcugauuugacagauuucauugaaaauaaucagaggguuuuuccauuuuagauuuuuuucuugguucuuucauuacuacuacauauuuugacaacauuaaaauuuuuuaauuguguggauauaugcaaguguagaacugaauugauacagaaaaauccucuuaaagaggcaaaaaagaaugacaaaaauaggguuauuuuugcagugauuauuuucagagucaucacaaaucaaauacuguauuuugauuuugugugaaguguaucugaaaauaauuucaguaagauugggcagaguugagugcuuaucuuauuuauauucaaauuauugaaacucaccuauuuguauuuuuuaguguuauguugagaguguaaauuucuuucuaguacaauuugaugugaaacaaaagauuuguuuuaaaaaguauuaccucguaaaaaugucuaagguuuucuauuacaaguccaaauaagacuuguauaauggauuauuauuaccaugcagauuguaauauaguuuggggcacauaaaauuuuacauaagaaguugaugaaagagaaaaacacugccacauaggcaaauuucuuuagagccuuuaaauuugcaugcagaaauaguuaaaauuuauuugugauugauuuuauuccugagauuuaacaaaauagaaaaucauaauuuuucaugaacuaguaagaugaugaugauaguucaccuuuauuccaugcuuuauaugccacauauuuaagcucauuuagucccuaccaaaacccuaggauguacagauuuuuuuuuucagauguuuauuaucuugagcugguuauguauuauacaucucuucccaacucagcauucagugacaucacauugauagcuugaauugcccaugaugggaauauuuacaccaugggaaauggcaagugcuguaaaucaagcccccugucucugauccacaagaacugguucacaaagacaccauuagauaguaacuuguuuaaagucccgacuaauaagugguagagccaggauuugaaccaaggugguugguucuagagauuaugcucaaaaccaguagaauauagucagcccucucuauccauugguuccacauucauggauucaaccaacuacagaucaaaaauauuugggaaaaaaauuaaaaauaacaauacaacaauaaaaaauagcacaaaaaaguauuacaauaacuacauagcauuuacaucauauuagguauuauaaguaauauagaaaucauuuaaagcauggaaggauaugcaaaaguuauaugcaacuaucaugccauuuuauguaagggacuugaguauacacagauuuugaaaucuggggggcuccaggaaccaauaccccacagauacaggggacaacacuauacuccucuaagcaaauaauacuaaugaaaugguccuccagacuuacuggucuuuuaacuuguuaguuuuaacuuaacuguuauugaguauaugguaccguauuacaaauuuaauuuugguggcauuauucucaaguuuuugaggcccuaucuuauuuaaaauacuaugauaaaauaaagccagaguuaauuuucuuugcgcuuaugagguacaaguuuaguacauaaaguaaaaccaugaauauuuacauugaaauauugccuaaauaaagcuuaucaauaagaguacuugcuuuaagaaaaauuuuguaauauuuuugacaugcaaagagucaguuuuuauuuuucuuuacuuuuuuuccccagagcuauauuuucuucagauaaucugaaucuaaguuaaauguuuuuguuacaguugguuuauuuauauaauacagcaugcuaaucauauaaaguuaaacuuucuaugcauuauaucuauagcacaguauauaaauuaacauuuaugauugucccaaagaacuguaaaauuaucuaauauguauugcauucucagauuuuuuuaguaugaaguuaagcauuuuuuuuguaguuuccugaaaauaaguaaucuauuuguaacauuuuuuucccuuugacuuuacauuugaguaauuagaaucccucauuguuaguagcuuagagagaacuuuuacuauuugaaacuuuauauuuuuaugcaucuuaguaaauuacucaacuauagucaaugaaguucaugaugcuuuuuaaacuauagaaucuucuuuuauucagugauuucucacccuuuggcuaagcuggaaaauuuaagcuuagaauacaagacaguggggaaagcacauauuucuuagccuagggauuuaugaaaagaagugaagacauguuuacgcuuguuugauuuaauugauauuaguuacagcuuaauuuguaucaggaggcauuuaaugcagcuuacaaaauauauacaaaaggaaaaaaagagagcuuagguuaaagcuagcagaauaaguauauucaugagauuccucuuauuuucuagaaacgagccacaaauuugccucugaguuuuauggcugucagccuaaaauaaagcaauacaaaauaacuguucauaggaagccacaaccauuucuuguacaguuugauuaucccuuaucugaaaugcuugcagccagaaauguuuuagauuuugaauuuccucagauuucaguauauuuacauugugcuuaccuguugaguaucccuaauccaaaugucuggaaucuaaaguguucgaaugagcauuuucuuugagugucuuguuagugcucaaaaacuucggguuggagccuuugagguuuggaauuucuggguuaggaaugcucaaacuguacugaaauccagcuuagauucuguggucuauuuaguuacucuuccaugccuguuauuuuucuauguaucuacuaaccaaaaccccaaaccugaauacauccaaguuuuaucugcuuugccccuauucuuuuggggaagucauguaaccagacacauugauauuuaacucaugguugcaaaucuucaccuaguuucucgacacugccccacaucccaucucucuccuuugucuucucacuccccugcuguugucuugaaauaguuaauuauuuuaaacuaucuucacuucuccucacaauuuugacuccuucgccuguuuccaucuuuauugucagcagauuaccucucuugcuuaacagaaaaaucagaagccuucaacugagaaaccccugaauuugcauauaagaaaucuguuaacuucuuauguuccugccccugcuuagcuugcuuuccaguuagcauuaagagaugccugucuuucuguaugaggcuugaccuucugccuguguuugauucuuugauuucauuuuaauaaggaaacuuuuaaaacaauugucuguacuaucuauuuccauuuucuaaacccuuuuuaacacuucacucagcuaaggaagauggggaagguguguugggggacaguacaaaucgucaggcccugggaucagaagugcagcugggaaagucccacuuaaagauguaaccauuucacccuugcuaucuguggcccugccacuuccuucccucaaacugcucuucuuagggcugucaguaagcuugucuaaaugagauguacuuuccauuucucaucuagcuugaccuguuaguagucuaagacuccugacagugccuucauuauuaaaacacucuuuccuuaguuucuuugauaccacugucuuaacuuuuuuuuuccacuugccuagcuuaugcuuaacuucuuccuuucaccccuuauaucuguguuuuugaagauccuagcuuaaguuuucuaguccuacucugaaaacuuuuuuacagcaaauccaguuacucugaugguugcuaauauguguauuugggucaagacccuccgccugcccucauccuacuccccagcacuugucuuuagcucagcccucuuuccauagcuucagaccccuucacugacauccaugaacuuuuuuggauaucuaagaggcaccucgaauucagcaugucuuaaacagaagguagcaucuaauucacaaagcacccgcccccgcccccauauuuuuuucaucucuuuacaugguguuuccauuuguugauacauagcaaacuuaggaguuuucgguaaauauaucuuguuucuuuuaagagaaguaacagaaaacaguuacagaauuuaaagacccagcuuuaagaugccuaacuuauuuacgauuuuacugagugauggguacucauuuaauggcacccccuugugcaaguuccaaguuccuccccucucacacuuaccauacccccaguaugcucugcuucuguuaucuccucccccaaccacccucagcacuuggauuuagaauacuuucccuuuaaagcuuauguuauaauuauggguagauuucauugaaauuguauuauauuuccguaucacuuuugguuacagcagccuuuguaaacuugcugggacauuaaauaacaccugcuguguuugcuccaaauccuaaagaacugauuuacaaaugaacuuuggaauaaaacucauuuagaaaauguacacugcuuagacauucugaggagcuguacauagaaugcuaaaguuggccgggcacuguggcucaugccuguaaucccagcacuuugggaggcugaggcaggcagaucaugaggucaggaguuugagaccagccuggccaacaugguaaaaucccgucucuacuaaaaauacaaaaauuagccaggcguggggcgcaugcauguaaucccagcuacucaggaggcugaggcaggagaaucacuugaacccgggaggcauaaguugcagugagccgagauugugccacugcacugcagccugggcgacagagcgagacuccaucucaaaaaaaaaaaaaaaaaaagaaagaaaaaaaaaguacagagggaccacagcuuccuauaggacaaugagaaacugaagcuucccuaaaucacacaucacuagugaauagcuaagcuaagacuagaaaccugacuuucaauuugaucagugugaugauuuuucuaguaucccuuugacuaacauuuuuaaauaaucaucauguuuuccucugauuuuguuuuuuccuaaguacaggcaauuacuuguucacaaucucuuguuaauucuuuggaaguuuauuggcauuucauuuuuuuaaguggucuguaauacuuuuaauuuugucuucaccagguaguucauugcaaauaguagugcuucucacuaagugggcuuagaaauaccuauggacauuuauagucaugcaaagguauaauacuacauuaauuauaccaacaaaguuuagccagcuguuaccucuauuguagacauuuuuuauuccuugaagaaagcuuuuugguacaaagagacagguuuggcuuguaucaagugaaccaaaaggaauguguguuuuccuaauaccaugucaugguuaccuguagacuuugguccuccacuaccaggagaagcagcaaaggaaagaauaaacaauaacuguguguaaacuauuuaaaaauguauaacccuuuaccuaccaucuuugagaagcacccuguuugaagcauuucuaagccaaauauuuauuggauuuauuucuuuuuuuuguauaaaauauugauaacuguaauguuuuauuuuuauucacagauuauuauaaguauaggccucauguuuuauguaguucaucgagcucaaguggaauugaaugcagcuauuguagcuugugaaauggaacugaaaucuucucugguuaaaggcaaucaaccaaauaccaguggcucuucauucuacaacaagaggacccuaacauuuucuggagguggaaucaauguuguaugauucuaaugagauacgugauugucaagagccuagugugcuaucuaaggucuagcagucacuucacuagugggcagagacaaguucuaauuguauuacagcacaaacaaaacugacuaguuuuuaaauugcacaauuuuuuuuuuuuaaagcaagaaucauuuucuggguauguaaguguaaauguagaugcaaauuuggcugcaccucuuuaucaugccuguauuggccuauaggucugcacuuuaguguuuuuuaauuguuuuauuucuguguauuuacgaacagagaaauaacccaaauauuauuucugcuuagugucuuuauuuauaaagcccaugaguaguuuguaugcaucuuuccuacuuguaaagaugaguaaaaguaugcaguuuuaaauuuauaauauuauuggauguucuuugcuuugguagucuuuccagaaaggauaaacagugguuuuuguuuuguuuuguuuuauuguuuaagugggaccacuuagcuucccguuuccuuacuaguuaaagaacagacauuaauuuucaguugaauguauuuuugcaggcaucauauuguuacagggccauuuacaccuauucacaaagcuuaaauccuaccuugugggacugaagugcucuuaauauaacuguuuauuuucacuguguaauaugcaaagcaaaagggaaauuauuugguggaugguagcucaaaauuggaacucuuguucuaauucaguuacauuggcuuuacccuccuuagauuuuucaucaaagggcugucccauugcaaucuuacuaaaacauuuuguuaaaauaaacucuuuuccuuuuuauauuaauaauuaggcuuuuaaauaaagauguuauuccuuuaaaauggugggcuuaccaucauugaagaugucacucagguggccuuguuugaucaaaacgccuuuuuuaaaaaccaagcuuuaaaaacauguuuauaauuucaugaaguacauauauauuguucccauagucuucagcuuuaaaacuauaaauaugcccaaauuuuguuauuugcccuacuuuaaguagguuuauuguguuuguuuuuucaguacuuguuuuucucugauaagacucaggaauucugaaaugugaaauugucucaauucuuucucuuguagcaugaaucaaauguauuuauuaauagcacuuaugacuauagaauauaauuuggcauaugauucauauuacauauguauucguuuuauuuuuaaaauaguuuauaaacuuaaugauuuuuuuuuacaaaugagguuauagauauuaaugcaaauuuucugguagguaucucuuuuuuugcuaugaugauuccaacuuaucagagaccucccauuugccuuuucauuacggugaaagcuuugcccucaucuacuaaaguacaaaggaauucuuuggaagcagauuauucuagucuuaugcuagagaugaauuugaucauuuuaaugugugaucuuuuugcucuaucagguauaauuguuuuccuuuccuuuauaauggguaaguuuucucaccuuugaguaacaguaaaguucauuuauauguccauaccuagaagaccagugcaaauacuuugagagcaccugggucuacaggacauaauuggcaucuaaauccucauuucuugcuauuaguaggaaaacagauauaguauuguaauacccuuauucuuuuugaauccuaauuacucauuucgguuuuuuuucucucuuuugaaucuaguugcugguuuucguuuaaugauuuuaguuuaacaaucccaaccaacaauacauuugauuuauuuuuuucugucuaaccugacaaccuuuuucuugugcuucuuguuuguugguuaguuuuugugaaaggaaucauuguuuaagaucacuguuuucauacuuguuuuacacuucacguauuuugaaguacauuuauuuacuaagcauuugugacuugaauaauuucaccaaaugaauacauuuugguaguuuguaaugaguucuucuaauuguuacacuuugcuugguacuuaacaauaaauauguaaagguaaaagaaauaauuuucuguauucugccaaucuuaauuuuauauaauaaaucauccauuuuuuucuuaaaauaguauggauugacuguuucuaaaauaccaaucuguggcugugguuuuucuuuucuucagcauuuccagcauccaaguaaacaauagucccuuauaguccugcuacuugauggguaaauuugguugcuggguuuuuaaguugcacucacaauaaaucgugcaaagcauugucaugccuuauuuacuccauuuuuaauccugcaucccagauuuauggcagcaacacauaucuacaggauacuuuuauguuguccaaauauugcugucagucauauguacuuauaaaaugucuccacucauguauauuuauagaaaugaaaugucaaauuucucagacuguuaaagugcaguauaaaguugcuuaaugcacacuuaaaaaugauauauaauuucugaauccuaugaaauauguguucuuuuuuaauucuuugggaguuuucuuaaguuuuacauguuuuuugguuuauuguuaaugauuuuguuuacucuuugccaaauuuugucauguagguuauuuuacaauagcaccuuuaaaaaaaauguauaugcuaauuuacuaagcauauucauguccauuuuuauuugaucaucugauuugugaaauaacuugaaauuuguacuguuugguuugugaaaauaauauuaccaaaucucugucauuagaauguguacuuuauguucagaagugacuguggguuuauucagagccagccauucucucccuugaugcacuuuguaaccagcuacacaugcuuuuagguggcuuuucccugauagggucaaguauaugacuauaaaacauuuuucuugugaagcuauuaaguucauuaguuacucuuauuuccccuuguuguaacuaaguggugcagguauaagcauauccccagcauuccugugugugugaaugugcacugcugauuuggacuguucuugagaaaggugcugugacauaugucaauauuuguuagcucuggggauaucuuuagaaugcuugagaaaguugcuaggugugugccacauuggugcagguaaauccaugcuguucacagccaagcagcauuugcagagaaaaggagaguuuuacauagaccccaggaaaaacaguacuaaccugguugauggccuuggugguggaauuuuguuucagccagaggcuacucauuauaucagaaugauguucaguauaacacuaucugauuuuuagauuggucgauuucuguuguaaucaaguauuuaggauguaaucuuuuuaaagucauugcuuuaaucugaaaagccauuagaagggagaggaaucacuguuccacaggauauuuaaaacucaggaguucaaauaaccucacauauugaacauaaacuguuaacuuauuccacaacuaaauucuaaccugauacuuaugaauugcaaagugauugcugcaaacuuuuucuaagguggcugaagauuuaaaauagaucauucuaaagggaaaucaguaaaaugucuugauaauugguauccaaaucacuugugugccugagaaaauaaaagguaauauuuuacuuucuucucgcuuuucuuucuuugucuuuauacuuuaaugcauguagagaaaagacccuacaugucauguaggguggauucaggggauauccugaauccccugaaucacuccuugauugaggggauagggaggauguacuccuaaaaaugagaauguugauaauugacccuccauggggugcuuaugguucuugaagaagcuuuaaggagaaguuauucugacgucuuaaauuggcacucacuccaguuuuuuucuauaucuuuaagucaugaaaugccaacugccaaacaguuguuagucauuugucccagccaguggcaauauuuaugaugcuuuucauaaugucaaaggacuuuaacuaaucuaauuuucuguugaucucuacccuauuuccaugacuguuuccuaaaaggcacauuccauuugccauaacauuuucaucuuagcaccaagaacaauauuuguccuuguuuauuuguagaagcuccaauacuguuguacaccuuuuguuacccauuuuggaccacaauuauuugcuaguuuauaaaaugggccacaagacauagccacauguugcagacuacuuucaccaaggugguguagaggagcauucaucagauaagcauuuugacauugugguaugcuuguuauccaagguuguacgauacugucugccaugcuugcucuucuugguugacagugccuauuagcauccugaguguggggaaaguguauauuagugguauacuguauuuuaaguuaaauauuuaacauuuguagggguagcauuacaugcauggugauauuaaacaagauauguguauauaguaaauuuacauuuaagcacucugccaaguugauuauccaaauuacuaacugauaucacugucuuaaaagugacuuaguguucuauaagguagccugcuggaugaaagacuugaaaaucuuaaaauaugcagugaaguucaguaaggaagagugauuagaauauguauuggacaaaaaauaauaauuccaaaauuacaaaaauuuuagagugcaauuugggugguaugcuucaauguaaguacauuuauccuaggagacauaaaauucaugaccaccacaaaguaggagaagccaagagggaacucuuugguucugucuuuguugauuaucaagccauuuucaguaaagugauuugaaacauggccuguuucauacucuaacucuuacaguccuguccuaaguugaccuuggcaggcaaggcaggaacugaguuauuuuccacuaguuuuuguuuuucagcuaauuacucugauuuuugaguaaauuagcugguuuuguaucaucacauuucuacuuuaaauauacaauagaacagcuuuguuuggaaugagcauuucaaguagguuucauagcagagcauuaaauuauuagauggacuuggaauagguucugggaacauagaaccugggcuuuuccuucccucccuugcugccgagugcauauaaggccuugcucucuggugggggucuuggcagagaaaaccaggacaggauuuuuucauacacggggcagcaagugucaggggaaaagacuggagagcagaucuugaagaucucuuucgcuuucaaauuugagcuucugaagagaaguuugauauuggccccaccaaaauaugucacuucucccuuccugacccccaacaaauggcugagaaggagggaguguucccugcugcgugagaagagaauucaggaagaccagagacagagaagcuuccuccaaggaacucagccugccugcuucauguuccaccacuggcauuugugaugucuuauauuaauugcagcuuuguucuuagagucaaacaacuggaaacaaagugaacuuuguuuucagccacucccuuaugaauaaauugugauagauccacacaaggaagauugaguagccaucagaaaggaggaacuagauguauuccagugagagacguuaccaggagguauuguuuugugaaagaagaugcauaaaguuguaaaaauauugcauuuuuaagaaaaugcccuuucuuccuugguauauguauguauauguggguuuguaugcaugugaauaucugcaucuccucauauaggauuaaauuaguauggauaaaaauauggaagggaaacuacuuuaagauggauuacucugauggggguggaaagcuggguucagggguuugauggggauagaaugaagaggagggaggaagaagauaauaaagccaaaaaggaagggaaaaaagcaauuauuuuuaagggcaaaaugggccuguauuucuuucauugacauguuagaagucauucucuucuuaaaacaucccaguugauaguuguucugcgcaaggacuugaggugauguaguagagaauugaagaauguccuuucuuaaggccagcuacuaguauucaaacaccagggccauugcuucuuggauacaugaucuugagaaguuaagaaguuacugcuguguuucaguuuccucacuuggaugaugauagccuagcuuagcucauuggguugauugugaaaauuaaagaguuuaauacaguuauguguugagaguaacacuugguagguaguaaguacacaauaagcauuagcuauuauuaccuggcaccaacuuguucuuaggcauugagaagcucuuucaguauuugaguauuuggcagacuacauugaguuggucauuuaugggcuagaguagaacagaguauuaaaaguuaccuagcuccugucuuuacagagcacacaaugaagguagagagacaacaaauacaacaaaaaugacaaccauacaauacuuacaggguaaaauaucaauguaaaaauuacuauagcacaaacugaguggugaaaggaguacuuaaagaaaucauugcauguggggaugguuggggaaauuuucuaaaaaagauauguuuuuuaccuuguuuuugguuuuugcaggaagaaacuauaaaguucaugguacucaagggggucucugaccaaaaaaggauuaagaagaauugaggcaaaagguaaaagucaugcaaauaggaacuuuuuucaggguaguguaaacaaaugaguuuucagucuagugaguuuuuuuccucaguugacuacuaccuccaccagcagcuuuaaaaaauuauucagcuaacacauaacuuagacucauuugauucauaucuuuugaguuauccaaguucuuuccuucauaaacaguuaagguuaaguuuauugaauucuugugauuuuuuuacgucaauuuuucuguuauccauauaaucucuuauaucauuagugagaaaguaagauuuaaauuuucugaauuucuguguagucauuuuuugagcaaauagagaaaauaggcuagauaucaagcauuuguuaggcuuugggguuacagagauagaaauaacacuagagggacucucaguggggaagguagaaaagugaagacacaauuacaauaaaauguggccaaccaggucuauaauaaagguuucuacuguaaaagcagaaagauaagguagaaauagaagcugugguguaacuguucaguguauuuuucuugcccacugcccagauagagcugauuauuaagacaggagaauuaaagaguucaauacacauagagcuggcuaaaugggagacuggaguuuuauuacucaaauuagccucccugaaaauuuggacacuaggguuuuuaaaagguaguuuggcaggcaggggcuaggaagugagugcugcugacugguuggggaugcuaucauagggguguagaaaauggcccugugcacugaguccacuuucggguaggggccagagaacgaguuaagagucaggcucagguggggccauccuguugucagaagugcggaagccuaaaaagacaccucaaaaggccagucuucaguuuauaauagugauguuauuuacagaaguaacugaggaaguugugaaucuugucaccuccagaauaaugguggacaauuguuuaugccuguguuuuagcagaauuuaggccccuaacuugguggacauuuauuaguuuuauaaaggugguuuaguuuugggaagggcuauuauuauuugaacuauaagcuauauuuuuuuccaaaguuagccuuggcccauaccaggaaugaccaagggcaauuuggagguuaaaggcaaguuggaguugguuagauuggaccucuuuuacuguuauaaaaguugacacaaguuguucuaauuuuugcaaagauaguuucaauccucccuuuuggguuuuaccacacuuuauucuuaaggugugagcuuuggagauuguauuagucacuucucaugcuaauaaagauauacccaagacuggauaguuuauaaaggaaagagguuuaacugacucucaguuccacauggcuggggaggccucaaaauagugguggaaggcaaauaagaagcaaaguuaugucuuacauaguggcaggcaagagagugugugcaggggagcucccuuuuauaaaaccaucaaaucuugugagacuuauuuacuaucacgaguacagcacaggaaagacccgcccccaugauucaauuacccccaucccacaacacgugggaauuacgggagcuacaauucaagaugagauuuggguggagacauagccaaaccauauaauuccaccucuggccacucccaaaucucacauccucacauaaaaaccaaucaugccuucccagcagucccucaaagucuuaacucauuucagcauuaauucaaaagcccacaguccaaaaucucaucugagacaagucccuucuggcuaugagccuguaaaaucaaaagcaaguuaguuacauccuaaauacuaugggguacaggcauuggauaaauacauccauuccaaaugggagaaauuggccagaacgaagggucuacaggccccauacaaguucaaaauucagugggccagucaaaucuuaaagcucccaaaugauuuccuuugacuccaugucuuacauccaggucauacugaugcaaguggguuccuguggucuugggaagcuccacccccauggcuuugcaggguacagccccaccuccuggcuguuuucacaggcuggcauugaguaucuguggauuuuccagacacacgguacaagcuuucaguggaucuacccuucuggggucuggaagacaauggcccucuccucacagcuccacuaggcagugccccaguggggacucucuguggcaguuuccaccccacauuucccuucugcaguccccuagcagaguucucccucagggcuccaccccugcagugcaccucugccuggacauccaggcauuuccauacauccucugaaaucuuaaguggagauucccaaaccucaguucuugacuuuugugcaucuucaugcucaacaccauguggaagcugccaagacuuggggcuuucacccucugaagccacagccagagcuguauguugcccucuuuuagccacagcugggaugcagggcacuaagugcugagacugcacaaagcagcaagguccuggguccagcccacaaaaccauuuuuuuccuccuaggccuccaggccugugaugggaggggcugcugugaagaccucugacgugcccuggagacauuuuccccauugucuuggcaauuaacauuuagcuucuugguacuuaugcacauuucuucaacuggcuugaauuuuuuaaaagagaauggguuuuuauuucuauugcaucaucaggaugcacauuuuucagacuuuuaugcucugcuucucuuuuaagcauaaguuccaguuccaaaccagaucuuugugaauacaaaaaacugaaugucuuuaauagcauccaagucaccucuugaaugcuuugcugcuuagaaauuucuucugucagaugcccuaaaucaucucucucaagcucaaagcuccacaaaucucuagggcaggggcaaaaugccaccagucucuuugcuaaaacauagcaagagucaccuuuguuccaguucccaacaaguuccucaucuccaucugacaccgccucaccccggaccuuauuguccauaucacuaucagcauuuuggucaaagccauucggcaagucucuaggaaguuccaaacuuucccacaucuuccugucuucuucugagccuucuaaauuguuucaagcucugccuguuaguuccaaaguugcuuccacauuuuuggguaucuugacgucagugcgccacucucgguaccaauuuacuuuauuagucuguuuucacacugcuaauaaaaacauaccugaaacuggguaauuuauaaaagagauuuaauugacucucaguuccacaugacugaagagaccucaaaaucauggugguaggcaaaugaggagcagucaugucuuacaugguggcaggcaagaaagcgugugcagggggacuccccuuuauaaaaccaucagauuuugugagacuuauucacuaucaggaguacagcgugggaaagaccugcccccaugauucaguuaccucccgcgaggucccucccacgacaugugggaauuaugggagcuacaauucaagaugagauuugggugaggacacagccaaaccagucagagauggaaaaaagucagugacugcuccaacuuccugcugacagggggcuuaguggagauugggguuagucccaggguaagagaaauaaaacugcuuugcagcugucugcaugccuaauauaacaagcaaaaguucuggcugcaggaguucuuguagaauucaucugaggcccugagagauucuggugaauagcccugagagccagucagagaugaguuugcuaguagagagagauuugggucagagguuguuagaaagacaaauugggauaaacaggaaagaguacauuuaaauauaccauaucuuuuauagucaguuuuaguucugugacuagaucaguuaaacaacugugucucauuucaggagguuaggccucuauauaugaugggcuaggccucuauauaugaugaaggcaaaaguuuuuaauaaaaggcauuuuuauagaaauaaaagccaagguuaauguuggguacaauuuauccagauauuagacucaaagcauuuuuaguuacagaggaaaaaggugguggcagucugaucugacaugauuuucuugccuguauuacaaggaauaaguucuagcuuucaaggucuucgggaaaagguagucgcaaugucauugucagaaaaauggaagaaaaauuugaaaacguuaaguuuagggaccuguagccuggaaagaauucaagauucaguccaaauugcagaaaauaauaaaaaccccaaaacaguggacaagacuagaaccuaaaaacagauguauuauaguuuuuuuauuugaaacauaauguuuuucucucuccaguuucuauuuuauuaacgacaaaucauaguaggacaaauuuauuugcaaaaugagucuaguuuuuuaauacuuggcuugauuauuugcauuaagugcagcaagaacaauuauuugccauacaggcuuucuaaacauuggcuuugcuggaacuuuuuaaaauaaggaauugcagauuugaauuuuuaaagccuugagccagccauggauuuaucugugccugcaaauaguuguaugaauuggauaauuuuucuuuucuccaggucccaagauaacuugaggcucccaggccuaucagaaagugauuuucuuuuuuuaaaucauaggucggaacccuguauagggacuagauagacaagguaugaaguugauuuuuucaaggggcuuuuaucaacucuguaagucaauuugauuccuuaaagcagucucuuuauauuugaaagcaugccauucuagucaaagccuugguaaaauaaccagugguaucuugucauaaaagaaaacagauuuuuauugaacuuaugcauguaacuauacuguuauaaauuaaguauaugcuuacaaauaguuuuuaaauucuggagaaauaagauagaaagaaauguguuuuaacuuuuacuuccaugaguauacucuguaaauagcuuaaaagaaaaaagcuuucuagacucugcaaaacaaaagaauuagcaauauuuuaaacaaaaugucauaaauauuauuucagucuucuuuuuuuuuuuuuaagagacagagucucccaaaguugcccaggcuggucucaaacucucgggcucaagcaguccuccugccucagucucucaaagugcugugauuacagaugugagccacugcaccugauguuggucuuuuauuaauucaguccaugcaauuccuguuuugcccaguauuggaccagcaguccucaugaacacacuagcucucuaugacaguccuggaaguuaauuuuuuuuucuuuuucauuuuaauggcacagucucuacaauuaucagacaccugcauccaagagcacccauuagcaucuuauagcugcuuauaaaccgccuuuugaaaaggaucaaaacaagacaguuaucuguggaagacaaaagucaggacagccacaguuaaagaugcaacugaaaaggaaaccuggucauuuuuauggcacauaaccauauaguaauuauuauuauuuauaacauauacucagucauaucagaauuauaggaaaaguauauaauguuggaacacauauuaauaacacauuuauugacugcagccaaaaaaaaguugaauaccauuuuauauuugacaaugcucucuguaugauuuuaguauaccaaauaagucaaauacgucucuuuuggacuucaggggaccuaauacuuaaaaguuaaugaggucaaaaauauacuuaagucagaauuugauuuuggaauguuugucaaauaucuaacguuuaacacuugauaucacaaaauagaauucuaggucauuguaagucauuuauuuagccaaaauaauaauuuaaaauuucaaaaaggcaaaaaucuuuacuuguuaauagagaggagucucaacuuguuaagaccaauacagauagcaugaagccaacugaaacugucuuuucucucuccccuguauuuaaaugacaaauaaauuuuuuuuauuucucaauguuaugaaaaucuuauuuaaaagagaaagccaaauuuuaauuuugcauuaguguauucuuaauguuauacucaauuuuuaauauuuuguaaauaaaucuguccaauuuuaauuaguuugacuaugagguauaauuuuuaugucuauuuuuauaauccuuucuaauuuuuuauuaaagggaauaucaguguucuaaggaaacucuguuauuuagacagauggaccuagauucuggcccugcaucaguguacucuuauuuuaauauuuuaauuuauggaagaacuaaguaauauccuuuuaauuuuggccaacuugcuuauauacagaauuuuguuaaagccaauuaauuacaguucuuuuauguauuuugguaacaaaauauguucccagcauauauaaauagacagaagcagaucugguggggggauaagaugaugaugaugaugauuguuauuauuauuauuauuaauuaagacagugucucuguuguccaggcuagagugcacuaacauaaucauggcucacugcagccuugaccuucugagcucaagcaauccucccaccucagccucccaaguagcugggacuacaggugcacaccacccugccuggcuaacugugauaagauucuuugucaguuuuuaaguuuuccuuuuugaccucagaccauuagucucuugauuaucuguucucugaucuaaauaauugucagccaggcaauucuaaauuuguguuuuuaaauggauaauuuuuaggugaaacaaaauaaagaacuuauauuuuauuuaaaccaagggaaaaugguguggauaaaaguuuagucaagaugaccaggaaaaacagacacgcuuacacggggagauuuuuuuuuuuuuuuuuuuuugagacggagucuugcucuguugcccaggcuggagugcaauggcgugaucucagcucacugcaaccuccaccuuacacagagagacuuuuuaaagaucuguuucuugauuggauuauuggcuucagguuggagucuuuuagggaacagggucaggaaagcaugcaguuuuuaggguccaauaagcaggcacagcuggaaggcaaaacagauccccaagaucaaggaucucauuuuuacaccaaauccuggggucuccaaaagagggaaauacuauaagacaagacagugcaaucauuccacaguguaucucauugaaaggacauuucuccuaggccgcuuggcaacccaaugccaaucagccuacgcuauaaucaccccaucuuccauucuguaccuucuagguguuuacaagcaugcuuuccuuauuucaacauagaaagaaagacguacaacccuguggugaucaucguucacuguaagcaacugacaucagccauuuaaaaaaguauaucucuuaucuagcuauuauacauuaagguuaaauuuucucauaaugcaaauuaauccuggugcccccaaaagucagagauuagauacaguggaaggagggacaaacaggaguaaaugagaaacagaauucaguugacugaguaguuuuuacagagggagagcaagagccuuaaaacaauaucuguacccauauaguccaaauuaaaucaauuuuaacuacagaacuuucaaaaaaaauccuuuaaaaaaauuucuuauuaccagauuucagcaggaacaaacaguggauauuuucagcuuuugaauuuuuuaccaaagguaaccucccacauaaaauuaauaauccuuaacucaggcuaugacuuaaccacagacacaugaggugucuccaaagagauggcaagugagcuuuacaagaucuaaaaucacccuaaagguagcucagggaaagaaaaauuuaagacaggauaucagaagcuguacauggaggaaaaaauaauaaauggcaaaagucccacaauuuuuaaaccagaaaggacuuguucccuaaucugggaauugagcccaggccaccauugugaaagggcagugccuuagcuacugaacuacagcaugggacaauugucauugcucucccagaaggagucuagaguggucauuuuuaagcuuguaaaggauuuuaacugcucaagagaauucuuaaggcuagccaugacaugaaccugaaaauucuuucccgccaaauggcagagaccaagagagagugccuccauguagucacaaagucaaguuuuuaaggucauaagacaagagggaaaccucaugauuuuguuucagggaugugcagcaaaguuuguauccgaucagucuucagggugggcucgaacaauggguuuauaggggucuuaggccuacauucuauucugugguaccccucuccacaauagaacaacacagaaagacaaauuuugguacaaaauacaccagauuugcuacagccuaagucuagucucacaaaucuuuuuuccuauuaaucaaaaccuugcagaggagacuucuuuguuaccauucauucaaccaacugguuugcucagauagaggccagaagccugccugguaagaaauacuuacccuuuugccaguuugacagguuuccagguucccuuucucugagugacuuuggugacuauguuugcugugccauagauagaggggccaagcugcauuacaaaaggaagucauccuucuccacuucauggaaccauaggcaaaagccucucaauuuucaugggggagcugaauuaacauaucuuauucugacuggaacaaaauacacauaacaaaacacacaccagucaccccacucagcacuugaguaucgaccuggcaagccucaaaguugcuccuauuggaccuugacaucuuugaucuacucaaaguggagucagaugauuucugaccaggaauuucaacaggugguuucugggcaagauggaagagcagacgaucacccugaguuagaccuguugaacuccugcuaacaguuccuucagggcucaccgaaugugacccaccagacaaacuaggagaggcugcuagacuucaaccagcaauuccuucagcgaucuccuuuacauaaacacacgcaacaaauuaaagacauaagaccuuccaaaccagauuccaaaccagaagaauauuccuccaaacagguccccuauucuccauacauuuggggagaaauauccccacagcaaaacucuuccuacaaucuacggagagccaaacaguccucaugauagacuacacagccagucucugugaugggaaaaauggaggaaaaaauaauaaaugccucuagagaggccaacagaucgagagaaguaaggggguguugacagugccuggaauacucaccaauauuucuccauugcaauuagauccauccacuauaggucaacagcaccccgcugguagcugcagugccagaaauagcccuuaguccaauagacugagguggccacuugggcuggccuccagacccaucaccagugaggggcugccaaacugcaggcaggugcccgcaacaacuaucccagaugagcucccaaauauguaacuacccaauggguuccucuugcccucugcugagaugaagccaauuuaucaagacaggagaacugcaauagagaaagagcucaauacacauagacccagcuaaacaggaaacuggaguuauguuauuacucaaaucagccugccugaaaauguggaggcuaggguuuuucaaagauaguuugcugggcaggagcuagagaauggagaaugcugauugguuagggaugcaaucauagagguauggaaaauuggcuuugugcauugaguucacuucugggcaggauucacaggaccaacugagucagaaucacagauucagguagggacaucuggucaucagaaaugcaaaagccugaaaagacauuucaaagggucagucuucaguuuuauaauagugauguuauuuacagaaguaauugaggaaguuguaaaucuugugacuuuuagaauaaugauggguaauuguuuaacugugccuauauuuuagcagaauuuaggcccuuauuuuuuuaaucuaguaaauguuuauuaguuuuauaaaggugauuuaguuuugggaggggcuauuauuauuuaaacuauaaucuaaauuuuucuccuagcuagcuuggcccacacccgggaaugacccaguuuggaggucaaagacaggauggagcugguuagauugucauaauuuuacugucauaauuuuuucacgguuauaauuuuugcaaaggccguuuuggagguagggacagagggcacugggggugcgagggguugaaccagaguuggaagguaugcuacagcuagugguugcugaauugaauuuggaagaauaaacacaaauaguccaaggggaaaagaggaggaaggguguucuaaagacaaaagcacaggagagaauggcaaguaguucaguauagcuagaacauagagggcuagaggggguuauugaacugaggcuggagauuugcauauagggguguguguguguaugucugcguguuacaacauguauauaaauagaguaauguaaaauauuaagaauaaacaaguguggguuuuuauuuuuauuuuauuuauuugagauggagucucgcucuguugcccaggcuggaguacaguggcgcaaucucagcucacugcaagcucugccucccagguucacgccauucuccugccucagccucccguguagcugggacuacaggcgcccaccaccacaccuggcuaauuuuuucuuuuguauuuuaguagagacgggguuucaccauguuagccaggauggucuugauuuccugaccuugugauccacccaccucagccucccaaagugcugggauuacaggcaugagccaccgcacguggacaaguguggguuuuauauguauggaugaggugauauuaaagugacaauugugucuacauuuuuaaaucacacucauagaaguuuggagaaauugaagagggucaaaaguaccagucugaagacugacuacagaagaaauaaugaaggccagaaauaggacaugacaacaaauauagggagugguuauauuugagagccauuagcauaaagaaaauaaauuuggcaaggauaggaugaauggugucaaaagagggaagaagcugugauggcuccucaauuuuuggaauggauggugucuuagucuguuuugugcugccauaucagaauaccugagacuggguaauuuauaaagaucagaaauuuauuggcucaugguucugaagguuggggucuaaggucaaggcuggcagauuuggugucuggugaggccauucucuucuuccaaaacuaugcuuugcagacucuggaguggagaaaggcugguuacucagcaaaaggcagaagaaccaagagacaaaaagggguugaaccuguccuuuuauaacagcauuaauucuacccaaucacauguuaaaugucccaccucuuaauacuguuacaauggcaaugaaauuucaacaugaguuuuggaugggacacacauuuaaacuauagcagaugggauguaagcaugagcaauuuggaggcagaggagacaauauuuuauuugaaaugccuaugugccauggaaaucaagagacacuggguaaguggacuuacggagcugaaacucaagaagagauagaggcuggagauagagguuugaaaauuuaucaacauccauaggugauacaucaagcguuugguguggauuugguaccaagugagaagaaauggugaccaagacuagggccaggcaugagagucccacaaaggagucagauaaaaaaacagcuaagagaaaguguugagaaacaggacgcuguuaaauacuacagagaggccaaacguguuaacuuaaaaacacugauugaguuugacaauuuaagcagucauugguagcuugccggcaguaauuacacacaacuugggaacacagaagucuugccacagugcugaguugcgaaugggagaugggaaaauguagaccacucuagauaagcuuagcagcggcaguggaagaauacaauauaaacauugaggcuuguuagaaaagggccugcuuuucagagacuugaauuucuuuacccuuuacuguaaauuucaccucuuuugaaguuuuuaauauaguuauuaugucauuguaaguguuagaaagucagacugaguuaacgagaaagcaguagcucaggaaugggaaaagaugaaagagguaaugagaggugacaacaugccagcagcccucccucgcucucggagccuccucggccucagcguccgcucuguccgcgcucgaggagcccuucagcccgccgcugcgcugugggggcccucucucuggggcuggccuaggccggagccggcucccucugcuccuucugcucagggagguguggagcgggaggcgcgggcgggagccggggcugcgcaaggcgcuggcgggccagcgcggguuccaggugggcgcgggcucagcgggccugcacuccgcacggcuggcuggcgccuccugagcuugaucaguggucaagcucccucugggcugccagagugcccaggcuaggugccgcacaguccccaugguaagugccagugagaggugaagccggccgggcuucugggacggguggggacuuggagaacuuuugugucuagcuaaaggauuguaaacgcaccaauccguacucugucaaaacggaccaauccgcucucuguaaaguggaccaaucaacucucuguaaaauggaccaaucagcaggauguggguggggccagauaagggaauaaaucaggccgccccagucaacagcugcaacccgguagguuaucuuacucagcuguggaagcuuuguucucucagucuucucaguaaaucuugcugcugcugacuuuugggguccgugcugcguaugagagcuguaacacucacugcgaaggucugcagcuucacucgugaagucagugagaccacaaacccaccagaaggaagaaacuccgggcacguccaacugcggacacaccaucuuuaagaacuguaacacucgccgcgagggucuguggcuucauucuugaagucagcgagaccaagaacccagcaauuccagacacgguaagacuguaguucucucauauuaaagucaccuggagaacuuuaaaaaaaaaaaaauagccuauaccuggccauuaccaucaauuaaucauaaucuuuccagguaaggcuugggcguugacuucuauguaagagcuccagcuaauucugaugccuaguaagagggugagacuggaaaaccgcagaggaagggcuuuucaguuaagauaggagugagugaagccuacuuaaauacugagagagauaaaccuucuauaauuuauauuaguguguuguaacucauugauuagagauaccuuuagccuauaucacaagauacugguauuauacaaguaaaugcagcauuggucugggaguuaagaaacauaaugcauuuuaauucucacucuugccaguuagcuacauaauuuugugcaaguaaaugauuuccacaugggccgggggcgguggcucacgccuguaaucccagcauuuugggaggccgagguggguggaucacgagaucaggaaaccgagaccauccuggcuaacauggugaaacuccaucucuacuaaaaauacaaaaaauuagcugggcgugguggcgggugccuguagucccagcuacuuggaaggcugaggcaggagaauggcgugaacccgggagacggagcuugcaguaagccgagacugugccacugcacuccagccugggcgacagagcgagacuccaucucaaaaaaaaaaaaaaaaaaaaaaaaaaaaaaaaaaaaaaaaauuccacauguauacaguguggaggcugagauccuuuaccuaagguccauuucagucuaaauuuguuuuaguuuucaaccaccuuuuuagcagaaucauggcucucuagaacagguaacugauuuguccccgggguuaaauauaauuccaacucuaaucaaucuuaggaugcuuuaacauuuuuucuuuaauuuccuaaaaaaaaaaucaaaagauucaugugaugaaacacaucugauacccuccuuggagaacugcagggcuuagagaaaacucauucuguguucucuaccgucagcauuuuuauuccagugaaauuuauuuuaaaauuaguuuaauuuuagaaaaacauguuuuaaaccugaaaguaaugaagauuaucuaguucagauuuuucauguugaaaaaaggguauuuccuagggugagagaaaguuaguggcaaagcauuucaguauuuccuugucccauucugugcuuuccaugcuagucaacucaauggcaacaggaggccagcagaagcagugacagaacagcauccagccuguguugccuuggugauacgggaggcuccagagcaccuuuagaacuuccuaauuuauugaaaguuuuacuccacaacuacuuaaacuacauacaauuugauuaaagcugaauucuuuaaaaguauuaagcugggcugggcacaguggcucacgccuguaaugccagcacuuugggaggccgaggcgggcagaucucgaggucaggagaucaagauuauucuggcuaacacggugaaacuccaucucuacuauaaauacaaaaaauaagucggguguggugucacgcgccuguagucccagcuacucgggaggcugaggcaggagaaucacuugaacccaggaggcggagguugcagugaaccaagaucgcgccacugcacuccagccugggugauagagcgagacuccgucucaaacaacaacaacaacaaaaauauuaaguuuuggaaaauugcauaucuaauaauaacaaauaguuugagacucaugguauauauauauggggugugugugugugcgcgugugccacaauuccuuaguuuuaaaucuuugccauugaaauaaaaaugaauuuuaggguauuuaguuagugauacacagaaaaguuuguuacaugucaaaguagauacacuuucuacucagcaaaaaaagcaaaaucuugaaaaauacagagacauguauaagaaguaauugaaaagaaaggaaaauuauuccuaaggaauaguugcaagccuuaucauaucuccuggcuguauauauaggacauuaggucagacauaauuuuugcucuagcauuaguuucaaguuuaagaaaugauaaaguucuggagaugcauguauucauaauaugcuuucaggguuaaaaugugugcuaaacacuuaggagcagauguuaucaauggaauucuucgaauuuagcuuacaaaccuuuuguacuuauuaauuugauagacacaauuagaaacaaaggauuuauucaaacagaucaaaagaaacaauuguaauacuauggaaagauugaaguguauauaggaacuacuuucacuagucuuuuaaccuaagguucugaauuacagugcucaaugaguuaacucugaugucagagaagugaaacuugauuuggcuucggaucacaauuuuugugcuacauucccccccaccaccaaaaguuaugaagugaugauaacauacgcagacgaccuaagcuauccauuauagacacuugagaaacgugaauuucuuuccucacugcuuugcuuucuuuaagugacagaauuaaugaccauuucugcaggacacacuguauggaggaacauccagugacaaaagaggcucaaauauuuucacuaagguguaagagaccaaauaauuuacaauuacguggccaggcacgguggcuuacgccuguaaucccagcacuuugggagccaaggcggguggaucaccugucaggaguuugagaccggccuggccaacauggugagacccggucucuacuaaaaauacaaaaauuaucuggaugcaguggcgcgcaucuguggucccaacuacuugggaggcugaggcuggagaauugcuugaacccgggaggcagagguugcagugagccgagaucgcgccacuguacuccagccucggugacagagcaagacuccgucucgaaacaaacaacaacaaaacaauuacaauuagucuuuuuugagugucaguuacucuugacuaauaaguuaagaauuagcuuguuuaggugcagcuguuaccauuugguaacacuugaguacauugaauuucuuggcuucauacuucugacaaaugagcugauuuaauucgaggucuuuuaaccucuggauugauaaagcauuuuuuuuuuauuuuacuuuaaguucuggaauacauaugcagaacaugcagguuuguuacauagguauacaugugccauggugguuugcugcacauaucaacccuugauaaagcauuuuuaaauuuuguaaucaaauuagaacuaccuuucuuauuaugauuuacuguauuucauaucaccccuuuagaauaaaaaagaaaaaagaugcccuauugcuuuucuuacagggcuuauuauauauuuguuuuguauuuaaaugucuaacuuuuaguugggaaugaguagccaggacugugccuuuauugugagaugagagaggccaguugagucacaucacguauugauuucuuucaacuuauccuaucaauguaguuuccuuacaauaaauauuccaaagcauuguucuuguuuuuuaauuaacaaaaugaugcaaggaucaucugcaauaaaauuuugugaaaauggccaggaaagcuuuaaaauuauaaagaaggacuuccuguaccaaaauuuaauauguaaagucauggaaaucagaagaaauagacuaauggaaccgaagagaaagucuagaaugagaccuagguguacauagaauauauuauauuuaaaagguaauaucaauaaauagcauuuagaaaacaaucuuuugaaaaguuuaaagaaaaaucagagguuuaaaacgggaaaaauuaaauauaacaugcuacuaccagaaugaaggggcauggauaaauuuaaaauuuuuaacuugaaaauccaagccuuaauuccaccuccauaaaauacuuaauuuauucucaucuguuauucuauacauacugucuaaugcagaaacacguguuuauuacauuuuauauuccauuuuauuuaguauuaugcucuuucuuaggucaguguaguauuuuaaauuaccauuuuaauggguauuuuaacagucaucuuuuuuugcagguauagguaauucacagcuaacaguuugcguaaaauacuuuggaguuuuuucuuuuuguguacaaguauauaaaaauauguuuguaugcauuugcuucacugacuauaaugggauugugcuauauacauuauuaucuuuaguuuuuuuuucagugcacaacauauuuuggaaacaagaugaccuuuaaaaucacauuauuuacugucaacuucaaagaaacaaggucugcugugauuuuauuuggaaaucaaauuguaaagaaguuuuuuguucuaaauuaaugucuaggcuauauuuauaaaccuuccuacuuuaucuguuuugaagaauguacuguugcauauuauucuaauuucuaaaauucaaaaccuuaauagugaaaucaguaguaguauauuggguuacucgauaauauuuaccauuucacagagcaaaacaagccaaucucuuuucauuucuuuuccuuucucuguguagccugugcacaauugcuuucucuuuuucuggaguagaccagggacuccaauuaggguucagcugaggcagauauauggaaauagaauguuuuauggagcuuuagcgaugccuacuaagguacacucaaguucucuugcuucaacauccuugccuucucagaagcauuugucuuguucucugucuuggucauuaccauauggcaguaccuaguacauacagugccugguaccuaguagauauauuauacauuuguugacuugugaaauaguaaaauuauuauuacuuuuuacaguucaaacguuaauauuauuugcuuacuuuauuggauuuaauaaauauuuaaaaguguugauauuaaucauuuuucacuuuuaacguguuauguaaaugccaggguauauaauuuaauacucacaauuaugcuauacuaaggauguugcuuuuucuggguuacugaaaacaaaaacauuuaauuucuugugaauuugauagaaacuuucugaauuuuuaaaguaaauuuauuaaggaguguuauuauagaauucaauguaauaaauauggucauuaggauuuagaaauuaauuuucuugcuuguacuuucaguaguuccaguguuuguuuaaaaaucuacuuuuauguuagacaauuuuauauuucacaaaaaggagaggaguuuauuuuagauguauagacacagauuuuuagaaaugaggaaaaaauacaucaauuacccugaaaauaucuccccuaaaacaguauuuuaaaacugcaagcauucuuuguggaacuaaaaauucauauuaauuaaauggguuccaaagaaucauuauauuuaucaagaugauuucuaaguauguuuaaaugacacauaguaauaauucauauagauuauauaaaugaauaaauauugucccuuugccuuuguaauaagagauauuuuuguccucugaugauagaaauaauuuaguagaaagaacauuaugugauuggcuugacacuacucaauuaaaaauaaaugcuugauuuuccuaaacuuaaaaauaccuuuuucuaauuagcauggcuuguugccucuaaauuuuuauuaaaauuacaaaaaaauggguugggcaugguggcucaugccugcaaucccagcacuuuggaaggccaagguggguggaucaccugagaucaggaguucaagaccagccuggcuaacauggugaaacccccgucucuacuaaaaauacaaacauuagccagguaucauggcgggcaacuacaauuccagcuguucaggaggcugaggcuuccuugaacccaugaggcagagguugcagugagccaagaucaugccacugcauuccagccugggcgacagagcaagacuaagucucaaaaaaacaaaaacaaaaaaauaaaaauuacaaaaaaugcacuuauguuuccaggagaaauugcugcauaaaugagcugaauauuauuaccgucauuauauauguaacugggaaggaauacugacaauccagccaauauaaaacaaaaagucacugaaauguuugggacucagucaaagcauauuuggauaaauucuaucgagcaugucaugugauaucucuugcuucggauauaugaacuuauuccugucacuagaaauaaugacaauaaauguauccuaguauuuuugcccagguaccuugauaaauugauauugaaaauguguccaucuugaguuuucuucuuaggaaaaugcauaaaaaugcuucuugagauuuauauuauucuagaguagaauuauuuuuuaauuuuauaaagaaauuucuuugcagcaaauuaucgacgugaaaacacagaaaacucaaaauaauucucagcagauuucagauacugauuuuauguucuaauuuuaucuaguggaaaguaaaguacuaauuaaauauccuucuaucacagaacauacgaauucacuaaaugaugcuaauuacacauacaagguagagauggaaacuuugagaauuaaacucuaucuaauauuuaaguauuaacauuccuuccauauuaacaacuacucuguuuauuucauauguuauggccccuuucauaaguaaaauuaccuguugacuucauuaaauuuacauucaaucuuauaaaauuuucauauuaaguuguauugcaaagcccauguuauuuuagguuuacaugcugguauggucaaaauaaaaaaaaaaaauuuaaaugauuuuuuuuaauguagaacauagaguuauuucugaaauaaggaucuguguugugaauccuguaaguugauuguuugcccauugaguuauacuuucuuaaugucuggaguuauucuuuggaaaaauaaaugccaccaucuagcuuaguugugacuuugcucucaggagaagagcacugagauuuccacaguaacuacguagcauuuucucuccugauccacccacucaucuccugggaagcugugugccuuucuguuccacugcagcugaucuggcuuaaccauagucuuuugggauaaucccaggguuuggaacaaugcaacaggucauguuuuuuaagcuccaacucuccaggcacuuaagaggaauaaccuuaaccauaugagguagacuuuauuagaccuuuauggaugaagcaacugaagggcagugagcucuagugacugagaaguccuuuaguuugauucuagaacugaucuuaggaccacuaugaaauaugccuucccauuuucuagacuagagcuucucagccacgaaugugcuacagguauacccagguacugauccccucagccuuugacguugcuggacaggaccuggagcccagcauuccaggucucuucuucuaucugugagaagcuucauccacuuagaccagugugcuauacaaagaugaugguuuucucaugugcugugaagcaaaaaaguuugacaagcacacacccuagagcaaagaaaacauuuagaaauauauuaaauauguuuucuaauuuuuagcuaacauuaaaauaaaauuucagauucagcaauccucugacaagggauaacucuuauaccuuguauaauucuacuuuauuuugguuuuugucuaaguauuacauaugaaaaaugguuugaguacaaagacuuaauuuuuuccauugauauuuuguuaugcugcaugucaguuauucuuaacugcuaauuaggcaacauuuauccuaguuagaguuaaaaugaagucuuuacaucauuaaaauugaauucauuuaauuauuauugauacuuuuuuuuuuacuguucuuaugaacugucuacuucccaauuaucagaauuggcaaauguuuaggcuuaaauguugaaguaccuaagggugaaugagguuaauacgggaacacuuuguaaagaaaugauacuugcaaguuuaaaaaaauaugauggaaagaauguguauacugucuugauaaggaaugauuuguguuguucaggagcccuugaguagcacugaagugguguuggagacuuuauaucacuuaguaccauuaaugaagaaagauaaaauaguucagaauuucugacaccaaaggaacagcucaggagaacccaauugguaauccggauuggcuuaaaugagauuguagugacgcacgaacacuuacacucaaauguuuucauuguguuuaaaaugauuuuuuuuuucacaaugcauuaaucauggaagcucaucugaaagugugugguuugugguuuuccagaugucuucucaauagaaguuuccagguaaagauaaaacauguugcagauaaaucaaagaggaaaaauucauuuccucuugauugcaauagccagagaauguccacuuacauacaucugaucuaguuuagugacuugcuagggacuguuuagggagcuuugacuauuggugaucuggucugaauacccgaugacauaugaaauacaaggcagggggaagcaaagaaggugacucagagcuuguaaaccucauagaccuaauaaagugggccauuaucagggaaaauauuaccaggaagacgaggugaauggaugugcugugagguggagaggauguugaauucauuggggagcauggagaucuggagaaacuagggagagacccaagaggagaguuaaugaaagcaaucggaaauucuugcuuggagucgugugcggagauuaggacuggagguuuagaguuaggguacucuacucauagguacucauagcaggaagggugaaagagaccuacaaggaagaaaggauaaagauaagcuugauaaaaauaggccucaucacauuaccugguuaaccaccuuaacaggaggagaaagucaaaaguugggcagcgaaggagacaggccagcuggccuccuugguguuccuaaaccaccaagcacaacccuacuggggccugcaccuuccauccucagccugcagugcuccucccacagggguugaggugcuuccuuugugcucccguaauacucuauguuucugacacugcauuuaccagaauaucauacuuaucuguuuauguucuugugucauaagaacaaaauucagugauauaaaauauucauugaauaaauaaacggaagaaaugaaaugagaaaagauuguacuuaaggccucauuucagaaaucaagaucuuggaguucugauaaaguggucugaugaaauguuauuucaaauaaaauauaauuggacacccauuuugugccaaccauuccuggaauaaaggucagacauucuuagacaaugucagcaggacucucugcaucucucagcucuggugaucuagguacuggcuucuuuucaagcaagcucucucuaaguggcagcagaucaacaucuacuucuucaaaaugauucugucucuuggggucacuugccugucaaggagguagagccccuggugggacuacccaugggagaagaagugaguuugugaagcagggugugauauggggcaaaaacaaacuuaacagaaguccauucuagaaaucauauaagaggcccucaggaaguggaggugagaggauggcuuaagccagaaguucuuggcuguagugugcuaugccaauccgggguccacauuaagguuggcaucaauauggugauuuucugggagcagagucccauaagauugucuaaggaggagugaacuggcccagguugaaaaagaggcaaucaggugcucauaaguggcagcaugaucugaaaccaauaguggaggacagcuagggaaauggagugaauucgcuuuucucuucuucccucuuauugucagaauuacaacugacuaucagagaaaaggaugcuaggccuggaauugccuuuguuguauguuugagguuccacagaugaaggagaguuuaagaagagaaaaagaucagcugacaguaaggccacuuguuggcauuagaacauugaggcuuggugauuuuauuuauuuaaacauuguucuucauuugauaugaaaaaauaaaaaugagaguuucaccuaaacuuuaaaaaguucuauaaaguccuaaacauauaaugauaaugauauagugugggcuuugcaaauaaacuuagguccaaagccuacucugccauuuucuaccuguguaaagcuuaagcagguaacuuaagcuuuuguaucauguucucugcagugcuuaacuuagggguuaaauaacaaaauucaugaaaagcacuuagcauaucauauagcagggcauucaaggcuagugaauacuauuggugguguuauugcuuaaaaauuuuuuauuuugggaaaauauacauaacaugaaacuuacaauuuuaacuauuuuaaauguacggcuaagagacaguaaguacauuuacauuguuguaccaucaucacgaucauccaucuucagaacauuuuugcaucccaaauugaaaccauauacucguuaaacaaaucuuuauuucucucuucccuguacccugguaaucacuauacuaacucugucucugugaauuugccuauucuaaguaccucauguaaauggaaucauacaauauuuguccuuuugugucuagcuuacuaagauuuuuuuugguagcaaaggcugagugaauccggacugguuagucauugguugccgggcuuucuguacugcaugggucccaauccauaaacuuaaauucuaucaucuucgugauaauaucuacuaauuacaggcauaauguuccuaggagaaaagcagucuuuauggcacacacuuuagguguccaaauauauuucaacaacauuacaggagcagaacuuuuuuuuaagaagacuguauaaaaucugaaaacacuucugaaagguagcuuugaaaaauucuuggguacuuuaauugcaggugaggauaaaaaauuucagccuguggauagcacccuuuuauuuaucagccucuugauuccucucccaaagugacuguauauugugcaguugguaagcaauuaaauaguuggcaacacgguauaaauauuuaaaauuuauuaaaaacuaccaaggccuaaaucaagagaugugauuaauuauucaggaaaaguucuauuuaaaaaaaaaaaugugcucacagauguguaguaauuacacaaucuguuucuuuuuaucauguauaugagcuaaauguaauguuucccugccuugaaagucugcauucccucaguucuccauaaugaugccaauucauucauggaaacaaagcaagagucauuaagcuuauaaccaucagauaccaaggaaguuguuucuguagcaaugaaucagccacgugaaaucucuuaagauuuuuaccucuuuacuccagugacuuaucaaugcaaauaggccucuguccaucaacugguauguuuuaaaccuacaacuuaaaaaucaguuucuaguugguucagcuccuucacacuuggccuuucugauauccauggcacagauuaugauaacuguuacuacaaccaacaaaugccacuucuaacugcaauuuuugcuuucuuuauauaaucuugggugagcaguuuauugucuccaaaccuugguugauucaucuguaagacaggaggagaaagauagcuugugagaaugaguagcacaguauguguacagguaaauacuagauuuaggaaagaaauacgugaacauguacguuguacuuuuccagccuucuuccuccuggaaacuguuucucuuuugucuccuaguaacuauauuguagcugcuggcucccauauuugagaacugaaguuuccaccucauuuacccguccacucucaaggcuuuuucaaccuugggcacucuuccuggcauaagcaaagacugccgcuagaaaccacuacauuugguaauuuaauuacuuuuaucuuauccauccauccccuuggcccucaggacucugcucauuugcagagcaaguuugacagccuccuaucuguaccuuuuaaucuaaaaaaaaauggcauugauucagacagacaucugaaaggacaccgugaucaccaagggagacaaaaauucuguaagaacaagagcaaaaaaaaguguuuauaauuuacauuaacccugggcucuuuaucagaaaaggcaauguuuuguuucacauauccuuuuacuucuuugaacaauuaugcugguuuauugaguacuuacaguagcccagacaccgugcuaagcaccucacauuauauuauuuaauguaauacacccaggaauccuaggagguguaggugcugcuauaacccauuuuauaaauaaagaaucaaagacuuggguuagguaacuugccuaacaucacacaguaaguggcagagcuggauccaaaccggacagaccugacccauggucuggccacuacagcagaauauucagugguauguuuaaaggcaguuacucaauaagggaaagauaauacugaacuauuuauuuuauuuaggaagcuuauggagagguuuaaaugaugguccuuuuuacuacacauuuuuuucuucuuuccgucuuuauuuuucuuuuauugaggccuuuaguguuauuuuuuaaauauuaaaucuaucuauucuucucuguuccuugcaguaagaaacauaaggcuucgagaaggccauacaacuguacauguuugaaauuccuuguccaggauguggugacauaauacacugaauccauucaagagucaauggugaucucagugaugcuu

SEQ ID NO: 13898 - RNA, 53113 nt, Homo sapiens
aagcaucacugagaucaccauugacucuugaauggauucaguguauuaugucaccacauccuggacaaggaauuucaaacauguacaguuguauggccuucucgaagccuuauguuucuuacugcaaggaacagagaagaauagauagauuuaauauuuaaaaaauaacacuaaaggccucaauaaaagaaaaauaaagacggaaagaagaaaaaaauguguaguaaaaaggaccaucauuuaaaccucuccauaagcuuccuaaauaaaauaaauaguucaguauuaucuuucccuuauugaguaacugccuuuaaacauaccacugaauauucugcuguaguggccagaccaugggucaggucuguccgguuuggauccagcucugccacuuacugugugauguuaggcaaguuaccuaacccaagucuuugauucuuuauuuauaaaauggguuauagcagcaccuacaccuccuaggauuccuggguguauuacauuaaauaauauaaugugaggugcuuagcacggugucugggcuacuguaaguacucaauaaaccagcauaauuguucaaagaaguaaaaggauaugugaaacaaaacauugccuuuucugauaaagagcccaggguuaauguaaauuauaaacacuuuuuuuugcucuuguucuuacagaauuuuugucucccuuggugaucacgguguccuuucagaugucugucugaaucaaugccauuuuuuuuuagauuaaaagguacagauaggaggcugucaaacuugcucugcaaaugagcagaguccugagggccaaggggauggauggauaagauaaaaguaauuaaauuaccaaauguagugguuucuagcggcagucuuugcuuaugccaggaagagugcccaagguugaaaaagccuugagaguggacggguaaaugagguggaaacuucaguucucaaauaugggagccagcagcuacaauauaguuacuaggagacaaaagagaaacaguuuccaggaggaagaaggcuggaaaaguacaacguacauguucacguauuucuuuccuaaaucuaguauuuaccuguacacauacugugcuacucauucucacaagcuaucuuucuccuccugucuuacagaugaaucaaccaagguuuggagacaauaaacugcucacccaagauuauauaaagaaagcaaaaauugcaguuagaaguggcauuuguugguuguaguaacaguuaucauaaucugugccauggauaucagaaaggccaagugugaaggagcugaaccaacuagaaacugauuuuuaaguuguagguuuaaaacauaccaguugauggacagaggccuauuugcauugauaagucacuggaguaaagagguaaaaaucuuaagagauuucacguggcugauucauugcuacagaaacaacuuccuugguaucugaugguuauaagcuuaaugacucuugcuuuguuuccaugaaugaauuggcaucauuauggagaacugagggaaugcagacuuucaaggcagggaaacauuacauuuagcucauauacaugauaaaaagaaacagauuguguaauuacuacacaucugugagcacauuuuuuuuuuuaaauagaacuuuuccugaauaauuaaucacaucucuugauuuaggccuugguaguuuuuaauaaauuuuaaauauuuauaccguguugccaacuauuuaauugcuuaccaacugcacaauauacagucacuuugggagaggaaucaagaggcugauaaauaaaagggugcuauccacaggcugaaauuuuuuauccucaccugcaauuaaaguacccaagaauuuuucaaagcuaccuuucagaaguguuuucagauuuuauacagucuucuuaaaaaaaaguucugcuccuguaauguuguugaaauauauuuggacaccuaaagugugugccauaaagacugcuuuucuccuaggaacauuaugccuguaauuaguagauauuaucacgaagaugauagaauuuaaguuuauggauugggacccaugcaguacagaaagcccggcaaccaaugacuaaccaguccggauucacucagccuuugcuaccaaaaaaaaucuuaguaagcuagacacaaaaggacaaauauuguaugauuccauuuacaugagguacuuagaauaggcaaauucacagagacagaguuaguauagugauuaccaggguacagggaagagagaaauaaagauuuguuuaacgaguauaugguuucaauuugggaugcaaaaauguucugaagauggaugaucgugaugaugguacaacaauguaaauguacuuacugucucuuagccguacauuuaaaauaguuaaaauuguaaguuucauguuauguauauuuucccaaaauaaaaaauuuuuaagcaauaacaccaccaauaguauucacuagccuugaaugcccugcuauaugauaugcuaagugcuuuucaugaauuuuguuauuuaaccccuaaguuaagcacugcagagaacaugauacaaaagcuuaaguuaccugcuuaagcuuuacacagguagaaaauggcagaguaggcuuuggaccuaaguuuauuugcaaagcccacacuauaucauuaucauuauauguuuaggacuuuauagaacuuuuuaaaguuuaggugaaacucucauuuuuauuuuuucauaucaaaugaagaacaauguuuaaauaaauaaaaucaccaagccucaauguucuaaugccaacaaguggccuuacugucagcugaucuuuuucucuucuuaaacucuccuucaucuguggaaccucaaacauacaacaaaggcaauuccaggccuagcauccuuuucucugauagucaguuguaauucugacaauaagagggaagaagagaaaagcgaauucacuccauuucccuagcuguccuccacuauugguuucagaucaugcugccacuuaugagcaccugauugccucuuuuucaaccugggccaguucacuccuccuuagacaaucuuaugggacucugcucccagaaaaucaccauauugaugccaaccuuaauguggaccccggauuggcauagcacacuacagccaagaacuucuggcuuaagccauccucucaccuccacuuccugagggccucuuauaugauuucuagaauggacuucuguuaaguuuguuuuugccccauaucacacccugcuucacaaacucacuucuucucccauggguagucccaccaggggcucuaccuccuugacaggcaagugaccccaagagacagaaucauuuugaagaaguagauguugaucugcugccacuuagagagagcuugcuugaaaagaagccaguaccuagaucaccagagcugagagaugcagagaguccugcugacauugucuaagaaugucugaccuuuauuccaggaaugguuggcacaaaauggguguccaauuauauuuuauuugaaauaacauuucaucagaccacuuuaucagaacuccaagaucuugauuucugaaaugaggccuuaaguacaaucuuuucucauuucauuucuuccguuuauuuauucaaugaauauuuuauaucacugaauuuuguucuuaugacacaagaacauaaacagauaaguaugauauucugguaaaugcagugucagaaacauagaguauuacgggagcacaaaggaagcaccucaaccccugugggaggagcacugcaggcugaggauggaaggugcaggccccaguaggguugugcuuggugguuuaggaacaccaaggaggccagcuggccugucuccuucgcugcccaacuuuugacuuucuccuccuguuaaggugguuaaccagguaaugugaugaggccuauuuuuaucaagcuuaucuuuauccuuucuuccuuguaggucucuuucacccuuccugcuaugaguaccuaugaguagaguacccuaacucuaaaccuccaguccuaaucuccgcacacgacuccaagcaagaauuuccgauugcuuucauuaacucuccucuugggucucucccuaguuucuccagaucuccaugcuccccaaugaauucaacauccucuccaccucacagcacauccauucaccucgucuuccugguaauauuuucccugauaauggcccacuuuauuaggucuaugagguuuacaagcucugagucaccuucuuugcuucccccugccuuguauuucauaugucaucggguauucagaccagaucaccaauagucaaagcucccuaaacagucccuagcaagucacuaaacuagaucagauguauguaaguggacauucucuggcuauugcaaucaagaggaaaugaauuuuuccucuuugauuuaucugcaacauguuuuaucuuuaccuggaaacuucuauugagaagacaucuggaaaaccacaaaccacacacuuucagaugagcuuccaugauuaaugcauugugaaaaaaaaaaucauuuuaaacacaaugaaaacauuugaguguaaguguucgugcgucacuacaaucucauuuaagccaauccggauuaccaauuggguucuccugagcuguuccuuuggugucagaaauucugaacuauuuuaucuuucuucauuaaugguacuaagugauauaaagucuccaacaccacuucagugcuacucaagggcuccugaacaacacaaaucauuccuuaucaagacaguauacacauucuuuccaucauauuuuuuuaaacuugcaaguaucauuucuuuacaaaguguucccguauuaaccucauucacccuuagguacuucaacauuuaagccuaaacauuugccaauucugauaauugggaaguagacaguucauaagaacaguaaaaaaaaaaguaucaauaauaauuaaaugaauucaauuuuaaugauguaaagacuucauuuuaacucuaacuaggauaaauguugccuaauuagcaguuaagaauaacugacaugcagcauaacaaaauaucaauggaaaaaauuaagucuuuguacucaaaccauuuuucauauguaauacuuagacaaaaaccaaaauaaaguagaauuauacaagguauaagaguuaucccuugucagaggauugcugaaucugaaauuuuauuuuaauguuagcuaaaaauuagaaaacauauuuaauauauuucuaaauguuuucuuugcucuagggugugugcuugucaaacuuuuuugcuucacagcacaugagaaaaccaucaucuuuguauagcacacuggucuaaguggaugaagcuucucacagauagaagaagagaccuggaaugcugggcuccagguccuguccagcaacgucaaaggcugaggggaucaguaccuggguauaccuguagcacauucguggcugagaagcucuagucuagaaaaugggaaggcauauuucauagugguccuaagaucaguucuagaaucaaacuaaaggacuucucagucacuagagcucacugcccuucaguugcuucauccauaaaggucuaauaaagucuaccucauaugguuaagguuauuccucuuaagugccuggagaguuggagcuuaaaaaacaugaccuguugcauuguuccaaacccugggauuaucccaaaagacuaugguuaagccagaucagcugcaguggaacagaaaggcacacagcuucccaggagaugaguggguggaucaggagagaaaaugcuacguaguuacuguggaaaucucagugcucuucuccugagagcaaagucacaacuaagcuagaugguggcauuuauuuuuccaaagaauaacuccagacauuaagaaaguauaacucaaugggcaaacaaucaacuuacaggauucacaacacagauccuuauuucagaaauaacucuauguucuacauuaaaaaaaaucauuuaaauuuuuuuuuuuuauuuugaccauaccagcauguaaaccuaaaauaacaugggcuuugcaauacaacuuaauaugaaaauuuuauaagauugaauguaaauuuaaugaagucaacagguaauuuuacuuaugaaaggggccauaacauaugaaauaaacagaguaguuguuaauauggaaggaauguuaauacuuaaauauuagauagaguuuaauucucaaaguuuccaucucuaccuuguauguguaauuagcaucauuuagugaauucguauguucugugauagaaggauauuuaauuaguacuuuacuuuccacuagauaaaauuagaacauaaaaucaguaucugaaaucugcugagaauuauuuugaguuuucuguguuuucacgucgauaauuugcugcaaagaaauuucuuuauaaaauuaaaaaauaauucuacucuagaauaauauaaaucucaagaagcauuuuuaugcauuuuccuaagaagaaaacucaagauggacacauuuucaauaucaauuuaucaagguaccugggcaaaaauacuaggauacauuuauugucauuauuucuagugacaggaauaaguucauauauccgaagcaagagauaucacaugacaugcucgauagaauuuauccaaauaugcuuugacugagucccaaacauuucagugacuuuuuguuuuauauuggcuggauugucaguauuccuucccaguuacauauauaaugacgguaauaauauucagcucauuuaugcagcaauuucuccuggaaacauaagugcauuuuuuguaauuuuuauuuuuuuguuuuuguuuuuuugagacuuagucuugcucugucgcccaggcuggaaugcaguggcaugaucuuggcucacugcaaccucugccucauggguucaaggaagccucagccuccugaacagcuggaauuguaguugcccgccaugauaccuggcuaauguuuguauuuuuaguagagacggggguuucaccauguuagccaggcuggucuugaacuccugaucucaggugauccacccaccuuggccuuccaaagugcugggauugcaggcaugagccaccaugcccaacccauuuuuuuguaauuuuaauaaaaauuuagaggcaacaagccaugcuaauuagaaaaagguauuuuuaaguuuaggaaaaucaagcauuuauuuuuaauugaguagugucaagccaaucacauaauguucuuucuacuaaauuauuucuaucaucagaggacaaaaauaucucuuauuacaaaggcaaagggacaauauuuauucauuuauauaaucuauaugaauuauuacuaugugucauuuaaacauacuuagaaaucaucuugauaaauauaaugauucuuuggaacccauuuaauuaauaugaauuuuuaguuccacaaagaaugcuugcaguuuuaaaauacuguuuuaggggagauauuuucaggguaauugauguauuuuuuccucauuucuaaaaaucugugucuauacaucuaaaauaaacuccucuccuuuuugugaaauauaaaauugucuaacauaaaaguagauuuuuaaacaaacacuggaacuacugaaaguacaagcaagaaaauuaauuucuaaauccuaaugaccauauuuauuacauugaauucuauaauaacacuccuuaauaaauuuacuuuaaaaauucagaaaguuucuaucaaauucacaagaaauuaaauguuuuuguuuucaguaacccagaaaaagcaacauccuuaguauagcauaauugugaguauuaaauuauauacccuggcauuuacauaacacguuaaaagugaaaaaugauuaauaucaacacuuuuaaauauuuauuaaauccaauaaaguaagcaaauaauauuaacguuugaacuguaaaaaguaauaauaauuuuacuauuucacaagucaacaaauguauaauauaucuacuagguaccaggcacuguauguacuagguacugccauaugguaaugaccaagacagagaacaagacaaaugcuucugagaaggcaaggauguugaagcaagagaacuugaguguaccuuaguaggcaucgcuaaagcuccauaaaacauucuauuuccauauaucugccucagcugaacccuaauuggagucccuggucuacuccagaaaaagagaaagcaauugugcacaggcuacacagagaaaggaaaagaaaugaaaagagauuggcuuguuuugcucugugaaaugguaaauauuaucgaguaacccaauauacuacuacugauuucacuauuaagguuuugaauuuuagaaauuagaauaauaugcaacaguacauucuucaaaacagauaaaguaggaagguuuauaaauauagccuagacauuaauuuagaacaaaaaacuucuuuacaauuugauuuccaaauaaaaucacagcagaccuuguuucuuugaaguugacaguaaauaaugugauuuuaaaggucaucuuguuuccaaaauauguugugcacugaaaaaaaaacuaaagauaauaauguauauagcacaaucccauuauagucagugaagcaaaugcauacaaacauauuuuuauauacuuguacacaaaaagaaaaaacuccaaaguauuuuacgcaaacuguuagcugugaauuaccuauaccugcaaaaaaagaugacuguuaaaauacccauuaaaaugguaauuuaaaauacuacacugaccuaagaaagagcauaauacuaaauaaaauggaauauaaaauguaauaaacacguguuucugcauuagacaguauguauagaauaacagaugagaauaaauuaaguauuuuauggagguggaauuaaggcuuggauuuucaaguuaaaaauuuuaaauuuauccaugccccuucauucugguaguagcauguuauauuuaauuuuucccguuuuaaaccucugauuuuucuuuaaacuuuucaaaagauuguuuucuaaaugcuauuuauugauauuaccuuuuaaauauaauauauucuauguacaccuaggucucauucuagacuuucucuucgguuccauuagucuauuucuucugauuuccaugacuuuacauauuaaauuuugguacaggaaguccuucuuuauaauuuuaaagcuuuccuggccauuuucacaaaauuuuauugcagaugauccuugcaucauuuuguuaauuaaaaaacaagaacaaugcuuuggaauauuuauuguaaggaaacuacauugauaggauaaguugaaagaaaucaauacgugaugugacucaacuggccucucucaucucacaauaaaggcacaguccuggcuacucauucccaacuaaaaguuagacauuuaaauacaaaacaaauauauaauaagcccuguaagaaaagcaauagggcaucuuuuuucuuuuuuauucuaaaggggugauaugaaauacaguaaaucauaauaagaaagguaguucuaauuugauuacaaaauuuaaaaaugcuuuaucaaggguugauaugugcagcaaaccaccauggcacauguauaccuauguaacaaaccugcauguucugcauauguauuccagaacuuaaaguaaaauaaaaaaaaaaugcuuuaucaauccagagguuaaaagaccucgaauuaaaucagcucauuugucagaaguaugaagccaagaaauucaauguacucaaguguuaccaaaugguaacagcugcaccuaaacaagcuaauucuuaacuuauuagucaagaguaacugacacucaaaaaagacuaauuguaauuguuuuguuguuguuuguuucgagacggagucuugcucugucaccgaggcuggaguacaguggcgcgaucucggcucacugcaaccucugccucccggguucaagcaauucuccagccucagccucccaaguaguugggaccacagaugcgcgccacugcauccagauaauuuuuguauuuuuaguagagaccgggucucaccauguuggccaggccggucucaaacuccugacaggugauccacccgccuuggcucccaaagugcugggauuacaggcguaagccaccgugccuggccacguaauuguaaauuauuuggucucuuacaccuuagugaaaauauuugagccucuuuugucacuggauguuccuccauacaguguguccugcagaaauggucauuaauucugucacuuaaagaaagcaaagcagugaggaaagaaauucacguuucucaagugucuauaauggauagcuuaggucgucugcguauguuaucaucacuucauaacuuuugguggugggggggaauguagcacaaaaauugugauccgaagccaaaucaaguuucacuucucugacaucagaguuaacucauugagcacuguaauucagaaccuuagguuaaaagacuagugaaaguaguuccuauauacacuucaaucuuuccauaguauuacaauuguuucuuuugaucuguuugaauaaauccuuuguuucuaauugugucuaucaaauuaauaaguacaaaagguuuguaagcuaaauucgaagaauuccauugauaacaucugcuccuaaguguuuagcacacauuuuaacccugaaagcauauuaugaauacaugcaucuccagaacuuuaucauuucuuaaacuugaaacuaaugcuagagcaaaaauuaugucugaccuaauguccuauauauacagccaggagauaugauaaggcuugcaacuauuccuuaggaauaauuuuccuuucuuuucaauuacuucuuauacaugucucuguauuuuucaagauuuugcuuuuuuugcugaguagaaaguguaucuacuuugacauguaacaaacuuuucuguguaucacuaacuaaauacccuaaaauucauuuuuauuucaauggcaaagauuuaaaacuaaggaauuguggcacacgcgcacacacacacaccccauauauauauaccaugagucucaaacuauuuguuauuauuagauaugcaauuuuccaaaacuuaauauuuuuguuguuguuguuguuugagacggagucucgcucuaucacccaggcuggagugcaguggcgcgaucuugguucacugcaaccuccgccuccuggguucaagugauucuccugccucagccucccgaguagcugggacuacaggcgcgugacaccacacccgacuuauuuuuuguauuuauaguagagauggaguuucaccguguuagccagaauaaucuugaucuccugaccucgagaucugcccgccucggccucccaaagugcuggcauuacaggcgugagccacugugcccagcccagcuuaauacuuuuaaagaauucagcuuuaaucaaauuguauguaguuuaaguaguuguggaguaaaacuuucaauaaauuaggaaguucuaaaggugcucuggagccucccguaucaccaaggcaacacaggcuggaugcuguucugucacugcuucugcuggccuccuguugccauugaguugacuagcauggaaagcacagaaugggacaaggaaauacugaaaugcuuugccacuaacuuucucucacccuaggaaauacccuuuuuucaacaugaaaaaucugaacuagauaaucuucauuacuuucagguuuaaaacauguuuuucuaaaauuaaacuaauuuuaaaauaaauuucacuggaauaaaaaugcugacgguagagaacacagaaugaguuuucucuaagcccugcaguucuccaaggaggguaucagauguguuucaucacaugaaucuuuugauuuuuuuuuuaggaaauuaaagaaaaaauguuaaagcauccuaagauugauuagaguuggaauuauauuuaaccccggggacaaaucaguuaccuguucuagagagccaugauucugcuaaaaaggugguugaaaacuaaaacaaauuuagacugaaauggaccuuagguaaaggaucucagccuccacacuguauacauguggaauuuuuuuuuuuuuuuuuuuuuuuuuuuuuuuuuuuuuuuuugagauggagucucgcucugucgcccaggcuggagugcaguggcacagucucggcuuacugcaagcuccgucucccggguucacgccauucuccugccucagccuuccaaguagcugggacuacaggcacccgccaccacgcccagcuaauuuuuuguauuuuuaguagagauggaguuucaccauguuagccaggauggucucgguuuccugaucucgugauccacccaccucggccucccaaaaugcugggauuacaggcgugagccaccgcccccggcccauguggaaaucauuuacuugcacaaaauuauguagcuaacuggcaagagugagaauuaaaaugcauuauguuucuuaacucccagaccaaugcugcauuuacuuguauaauaccaguaucuugugauauaggcuaaagguaucucuaaucaaugaguuacaacacacuaauauaaauuauagaagguuuaucucucucaguauuuaaguaggcuucacucacuccuaucuuaacugaaaagcccuuccucugcgguuuuccagucucacccucuuacuaggcaucagaauuagcuggagcucuuacauagaagucaacgcccaagccuuaccuggaaagauuaugauuaauugaugguaauggccagguauaggcuauuuuuuuuuuuuuaaaguucuccaggugacuuuaauaugagagaacuacagucuuaccgugucuggaauugcuggguucuuggucucgcugacuucaagaaugaagccacagacccucgcggcgaguguuacaguucuuaaagaugguguguccgcaguuggacgugcccggaguuucuuccuucugguggguuuguggucucacugacuucacgagugaagcugcagaccuucgcagugaguguuacagcucucauacgcagcacggaccccaaaagucagcagcagcaagauuuacugagaagacugagagaacaaagcuuccacagcugaguaagauaaccuaccggguugcagcuguugacuggggcggccugauuuauucccuuaucuggccccacccacauccugcugauugguccauuuuacagagaguugauugguccacuuuacagagagcggauugguccguuuugacagaguacggauuggugcguuuacaauccuuuagcuagacacaaaaguucuccaaguccccacccgucccagaagcccggccggcuucaccucucacuggcacuuaccauggggacugugcggcaccuagccugggcacucuggcagcccagagggagcuugaccacugaucaagcucaggaggcgccagccagccgugcggagugcaggcccgcugagcccgcgcccaccuggaacccgcgcuggcccgccagcgccuugcgcagccccggcucccgcccgcgccucccgcuccacaccucccugagcagaaggagcagagggagccggcuccggccuaggccagccccagagagagggcccccacagcgcagcggcgggcugaagggcuccucgagcgcggacagagcggacgcugaggccgaggaggcuccgagagcgagggagggcugcuggcauguugucaccucucauuaccucuuucaucuuuucccauuccugagcuacugcuuucucguuaacucagucugacuuucuaacacuuacaaugacauaauaacuauauuaaaaacuucaaaagaggugaaauuuacaguaaaggguaaagaaauucaagucucugaaaagcaggcccuuuucuaacaagccucaauguuuauauuguauucuuccacugccgcugcuaagcuuaucuagaguggucuacauuuucccaucucccauucgcaacucagcacuguggcaagacuucuguguucccaaguuguguguaauuacugccggcaagcuaccaaugacugcuuaaauugucaaacucaaucaguguuuuuaaguuaacacguuuggccucucuguaguauuuaacagcguccuguuucucaacacuuucucuuagcuguuuuuuuaucugacuccuuugugggacucucaugccuggcccuagucuuggucaccauuucuucucacuugguaccaaauccacaccaaacgcuugauguaucaccuauggauguugauaaauuuucaaaccucuaucuccagccucuaucucuucuugaguuucagcuccguaaguccacuuacccagugucucuugauuuccauggcacauaggcauuucaaauaaaauauugucuccucugccuccaaauugcucaugcuuacaucccaucugcuauaguuuaaaugugugucccauccaaaacucauguugaaauuucauugccauuguaacaguauuaagaggugggacauuuaacaugugauuggguagaauuaaugcuguuauaaaaggacagguucaaccccuuuuugucucuugguucuucugccuuuugcugaguaaccagccuuucuccacuccagagucugcaaagcauaguuuuggaagaagagaauggccucaccagacaccaaaucugccagccuugaccuuagaccccaaccuucagaaccaugagccaauaaauuucugaucuuuauaaauuacccagucucagguauucugauauggcagcacaaaacagacuaagacaccauccauuccaaaaauugaggagccaucacagcuucuucccucuuuugacaccauucauccuauccuugccaaauuuauuuucuuuaugcuaauggcucucaaauauaaccacucccuauauuuguugucauguccuauuucuggccuucauuauuucuucuguagucagucuucagacugguacuuuugacccucuucaauuucuccaaacuucuaugagugugauuuaaaaauguagacacaauugucacuuuaauaucaccucauccauacauauaaaacccacacuuguccacgugcgguggcucaugccuguaaucccagcacuuugggaggcugagguggguggaucacaaggucaggaaaucaagaccauccuggcuaacauggugaaaccccgucucuacuaaaauacaaaagaaaaaauuagccaggugugguggugggcgccuguagucccagcuacacgggaggcugaggcaggagaauggcgugaaccugggaggcagagcuugcagugagcugagauugcgccacuguacuccagccugggcaacagagcgagacuccaucucaaauaaauaaaauaaaaauaaaaacccacacuuguuuauucuuaauauuuuacauuacucuauuuauauacauguuguaacacgcagacauacacacacacaccccuauaugcaaaucuccagccucaguucaauaacccccucuagcccucuauguucuagcuauacugaacuacuugccauucucuccugugcuuuugucuuuagaacacccuuccuccucuuuuccccuuggacuauuuguguuuauucuuccaaauucaauucagcaaccacuagcuguagcauaccuuccaacucugguucaaccccucgcacccccagugcccucugucccuaccuccaaaacggccuuugcaaaaauuauaaccgugaaaaaauuaugacaguaaaauuaugacaaucuaaccagcuccauccugucuuugaccuccaaacugggucauucccgggugugggccaagcuagcuaggagaaaaauuuagauuauaguuuaaauaauaauagccccucccaaaacuaaaucaccuuuauaaaacuaauaaacauuuacuagauuaaaaaaauaagggccuaaauucugcuaaaauauaggcacaguuaaacaauuacccaucauuauucuaaaagucacaagauuuacaacuuccucaauuacuucuguaaauaacaucacuauuauaaaacugaagacugacccuuugaaaugucuuuucaggcuuuugcauuucugaugaccagaugucccuaccugaaucugugauucugacucaguugguccugugaauccugcccagaagugaacucaaugcacaaagccaauuuuccauaccucuaugauugcaucccuaaccaaucagcauucuccauucucuagcuccugcccagcaaacuaucuuugaaaaacccuagccuccacauuuucaggcaggcugauuugaguaauaacauaacuccaguuuccuguuuagcugggucuauguguauugagcucuuucucuauugcaguucuccugucuugauaaauuggcuucaucucagcagagggcaagaggaacccauuggguaguuacauauuugggagcucaucugggauaguuguugcgggcaccugccugcaguuuggcagccccucacuggugaugggucuggaggccagcccaaguggccaccucagucuauuggacuaagggcuauuucuggcacugcagcuaccagcggggugcuguugaccuauaguggauggaucuaauugcaauggagaaauauuggugaguauuccaggcacugucaacacccccuuacuucucucgaucuguuggccucucuagaggcauuuauuauuuuuuccuccauuuuucccaucacagagacuggcuguguagucuaucaugaggacuguuuggcucuccguagauuguaggaagaguuuugcuguggggauauuucuccccaaauguauggagaauaggggaccuguuuggaggaauauucuucugguuuggaaucugguuuggaaggucuuaugucuuuaauuuguugcguguguuuauguaaaggagaucgcugaaggaauugcugguugaagucuagcagccucuccuaguuugucuggugggucacauucggugagcccugaaggaacuguuagcaggaguucaacaggucuaacucagggugaucgucugcucuuccaucuugcccagaaaccaccuguugaaauuccuggucagaaaucaucugacuccacuuugaguagaucaaagaugucaagguccaauaggagcaacuuugaggcuugccaggucgauacucaagugcugaguggggugacugguguguguuuuguuauguguauuuuguuccagucagaauaagauauguuaauucagcucccccaugaaaauugagaggcuuuugccuaugguuccaugaaguggagaaggaugacuuccuuuuguaaugcagcuuggccccucuaucuauggcacagcaaacauagucaccaaagucacucagagaaagggaaccuggaaaccugucaaacuggcaaaaggguaaguauuucuuaccaggcaggcuucuggccucuaucugagcaaaccaguugguugaaugaaugguaacaaagaagucuccucugcaagguuuugauuaauaggaaaaaagauuugugagacuagacuuaggcuguagcaaaucugguguauuuuguaccaaaauuugucuuucuguguuguucuauuguggagagggguaccacagaauagaauguaggccuaagaccccuauaaacccauuguucgagcccacccugaagacugaucggauacaaacuuugcugcacaucccugaaacaaaaucaugagguuucccucuugucuuaugaccuuaaaaacuugacuuugugacuacauggaggcacucucucuuggucucugccauuuggcgggaaagaauuuucagguucaugucauggcuagccuuaagaauucucuugagcaguuaaaauccuuuacaagcuuaaaaaugaccacucuagacuccuucugggagagcaaugacaauugucccaugcuguaguucaguagcuaaggcacugcccuuucacaaugguggccugggcucaauucccagauuagggaacaaguccuuucugguuuaaaaauugugggacuuuugccauuuauuauuuuuuccuccauguacagcuucugauauccugucuuaaauuuuucuuucccugagcuaccuuuagggugauuuuagaucuuguaaagcucacuugccaucucuuuggagacaccucaugugucugugguuaagucauagccugaguuaaggauuauuaauuuuaugugggagguuaccuuugguaaaaaauucaaaagcugaaaauauccacuguuuguuccugcugaaaucugguaauaagaaauuuuuuuaaaggauuuuuuuugaaaguucuguaguuaaaauugauuuaauuuggacuauauggguacagauauuguuuuaaggcucuugcucucccucuguaaaaacuacucagucaacugaauucuguuucucauuuacuccuguuugucccuccuuccacuguaucuaaucucugacuuuugggggcaccaggauuaauuugcauuaugagaaaauuuaaccuuaauguauaauagcuagauaagagauauacuuuuuuaaauggcugaugucaguugcuuacagugaacgaugaucaccacaggguuguacgucuuucuuucuauguugaaauaaggaaagcaugcuuguaaacaccuagaagguacagaauggaagauggggugauuauagcguaggcugauuggcauuggguugccaagcggccuaggagaaauguccuuucaaugagauacacuguggaaugauugcacugucuugucuuauaguauuucccucuuuuggagaccccaggauuugguguaaaaaugagauccuugaucuuggggaucuguuuugccuuccagcugugccugcuuauuggacccuaaaaacugcaugcuuuccugacccuguucccuaaaagacuccaaccugaagccaauaauccaaucaagaaacagaucuuuaaaaagucucucuguguaagguggagguugcagugagcugagaucacgccauugcacuccagccugggcaacagagcaagacuccgucucaaaaaaaaaaaaaaaaaaaaaucuccccguguaagcgugucuguuuuuccuggucaucuugacuaaacuuuuauccacaccauuuucccuugguuuaaauaaaauauaaguucuuuauuuuguuucaccuaaaaauuauccauuuaaaaacacaaauuuagaauugccuggcugacaauuauuuagaucagagaacagauaaucaagagacuaauggucugaggucaaaaaggaaaacuuaaaaacugacaaagaaucuuaucacaguuagccaggcaggguggugugcaccuguagucccagcuacuugggaggcugaggugggaggauugcuugagcucagaaggucaaggcugcagugagccaugauuauguuagugcacucuagccuggacaacagagacacugucuuaauuaauaauaauaauaauaacaaucaucaucaucaucaucuuauccccccaccagaucugcuucugucuauuuauauaugcugggaacauauuuuguuaccaaaauacauaaaagaacuguaauuaauuggcuuuaacaaaauucuguauauaagcaaguuggccaaaauuaaaaggauauuacuuaguucuuccauaaauuaaaauauuaaaauaagaguacacugaugcagggccagaaucuagguccaucugucuaaauaacagaguuuccuuagaacacugauauucccuuuaauaaaaaauuagaaaggauuauaaaaauagacauaaaaauuauaccucauagucaaacuaauuaaaauuggacagauuuauuuacaaaauauuaaaaauugaguauaacauuaagaauacacuaaugcaaaauuaaaauuuggcuuucucuuuuaaauaagauuuucauaacauugagaaauaaaaaaaauuuauuugucauuuaaauacaggggagagagaaaagacaguuucaguuggcuucaugcuaucuguauuggucuuaacaaguugagacuccucucuauuaacaaguaaagauuuuugccuuuuugaaauuuuaaauuauuauuuuggcuaaauaaaugacuuacaaugaccuagaauucuauuuugugauaucaaguguuaaacguuagauauuugacaaacauuccaaaaucaaauucugacuuaaguauauuuuugaccucauuaacuuuuaaguauuagguccccugaaguccaaaagagacguauuugacuuauuugguauacuaaaaucauacagagagcauugucaaauauaaaaugguauucaacuuuuuuuuggcugcagucaauaaauguguuauuaauauguguuccaacauuauauacuuuuccuauaauucugauaugacugaguauauguuauaaauaauaauaauuacuauaugguuaugugccauaaaaaugaccagguuuccuuuucaguugcaucuuuaacuguggcuguccugacuuuugucuuccacagauaacugucuuguuuugauccuuuucaaaaggcgguuuauaagcagcuauaagaugcuaaugggugcucuuggaugcaggugucugauaauuguagagacugugccauuaaaaugaaaaagaaaaaaaaauuaacuuccaggacugucauagagagcuaguguguucaugaggacugcugguccaauacugggcaaaacaggaauugcauggacugaauuaauaaaagaccaacaucaggugcaguggcucacaucuguaaucacagcacuuugagagacugaggcaggaggacugcuugagcccgagaguuugagaccagccugggcaacuuugggagacucugucucuuaaaaaaaaaaaaagaagacugaaauaauauuuaugacauuuuguuuaaaauauugcuaauucuuuuguuuugcagagucuagaaagcuuuuuucuuuuaagcuauuuacagaguauacucauggaaguaaaaguuaaaacacauuucuuucuaucuuauuucuccagaauuuaaaaacuauuuguaagcauauacuuaauuuauaacaguauaguuacaugcauaaguucaauaaaaaucuguuuucuuuuaugacaagauaccacugguuauuuuaccaaggcuuugacuagaauggcaugcuuucaaauauaaagagacugcuuuaaggaaucaaauugacuuacagaguugauaaaagccccuugaaaaaaucaacuucauaccuugucuaucuagucccuauacaggguuccgaccuaugauuuaaaaaaagaaaaucacuuucugauaggccugggagccucaaguuaucuugggaccuggagaaaagaaaaauuauccaauucauacaacuauuugcaggcacagauaaauccauggcuggcucaaggcuuuaaaaauucaaaucugcaauuccuuauuuuaaaaaguuccagcaaagccaauguuuagaaagccuguauggcaaauaauuguucuugcugcacuuaaugcaaauaaucaagccaaguauuaaaaaacuagacucauuuugcaaauaaauuuguccuacuaugauuugucguuaauaaaauagaaacuggagagagaaaaacauuauguuucaaauaaaaaaacuauaauacaucuguuuuuagguucuagucuuguccacuguuuugggguuuuuauuauuuucugcaauuuggacugaaucuugaauucuuuccaggcuacaggucccuaaacuuaacguuuucaaauuuuucuuccauuuuucugacaaugacauugcgacuaccuuuucccgaagaccuugaaagcuagaacuuauuccuuguaauacaggcaagaaaaucaugucagaucagacugccaccaccuuuuuccucuguaacuaaaaaugcuuugagucuaauaucuggauaaauuguacccaacauuaaccuuggcuuuuauuucuauaaaaaugccuuuuauuaaaaacuuuugccuucaucauauauagaggccuagcccaucauauauagaggccuaaccuccugaaaugagacacaguuguuuaacugaucuagucacagaacuaaaacugacuauaaaagauaugguauauuuaaauguacucuuuccuguuuaucccaauuugucuuucuaacaaccucugacccaaaucucucucuacuagcaaacucaucucugacuggcucucagggcuauucaccagaaucucucagggccucagaugaauucuacaagaacuccugcagccagaacuuuugcuuguuauauuaggcaugcagacagcugcaaagcaguuuuauuucucuuacccugggacuaaccccaaucuccacuaagcccccugucagcaggaaguuggagcagucacugacuuuuuuccaucucugacugguuuggcuguguccucacccaaaucucaucuugaauuguagcucccauaauucccacaugucgugggagggaccucgcgggagguaacugaaucaugggggcaggucuuucccacgcuguacuccugauagugaauaagucucacaaaaucugaugguuuuauaaaggggagucccccugcacacgcuuucuugccugccaccauguaagacaugacugcuccucauuugccuaccaccaugauuuugaggucucuucagucauguggaacugagagucaauuaaaucucuuuuauaaauuacccaguuucagguauguuuuuauuagcagugugaaaacagacuaauaaaguaaauugguaccgagaguggcgcacugacgucaagauacccaaaaauguggaagcaacuuuggaacuaacaggcagagcuugaaacaauuuagaaggcucagaagaagacaggaagaugugggaaaguuuggaacuuccuagagacuugccgaauggcuuugaccaaaaugcugauagugauauggacaauaagguccggggugaggcggugucagauggagaugaggaacuuguugggaacuggaacaaaggugacucuugcuauguuuuagcaaagagacugguggcauuuugccccugcccuagagauuuguggagcuuugagcuugagagagaugauuuagggcaucugacagaagaaauuucuaagcagcaaagcauucaagaggugacuuggaugcuauuaaagacauucaguuuuuuguauucacaaagaucugguuuggaacuggaacuuaugcuuaaaagagaagcagagcauaaaagucugaaaaaugugcauccugaugaugcaauagaaauaaaaacccauucucuuuuaaaaaauucaagccaguugaagaaaugugcauaaguaccaagaagcuaaauguuaauugccaagacaauggggaaaaugucuccagggcacgucagaggucuucacagcagccccucccaucacaggccuggaggccuaggaggaaaaaaaugguuuugugggcuggacccaggaccuugcugcuuugugcagucucagcacuuagugcccugcaucccagcuguggcuaaaagagggcaacauacagcucuggcuguggcuucagagggugaaagccccaagucuuggcagcuuccacaugguguugagcaugaagaugcacaaaagucaagaacugagguuugggaaucuccacuuaagauuucagaggauguauggaaaugccuggauguccaggcagaggugcacugcagggguggagcccugagggagaacucugcuaggggacugcagaagggaaaugugggguggaaacugccacagagaguccccacuggggcacugccuaguggagcugugaggagagggccauugucuuccagaccccagaaggguagauccacugaaagcuuguaccgugugucuggaaaauccacagauacucaaugccagccugugaaaacagccaggagguggggcuguacccugcaaagccauggggguggagcuucccaagaccacaggaacccacuugcaucaguaugaccuggauguaagacauggagucaaaggaaaucauuugggagcuuuaagauuugacuggcccacugaauuuugaacuuguauggggccuguagacccuucguucuggccaauuucucccauuuggaauggauguauuuauccaaugccuguaccccauaguauuuaggauguaacuaacuugcuuuugauuuuacaggcucauagccagaagggacuugucucagaugagauuuuggacugugggcuuuugaauuaaugcugaaaugaguuaagacuuugagggacugcugggaaggcaugauugguuuuuaugugaggaugugagauuugggaguggccagagguggaauuauaugguuuggcuaugucuccacccaaaucucaucuugaauuguagcucccguaauucccacguguugugggauggggguaauugaaucaugggggcgggucuuuccugugcuguacucgugauaguaaauaagucucacaagauuugaugguuuuauaaaagggagcuccccugcacacacucucuugccugccacuauguaagacauaacuuugcuucuuauuugccuuccaccacuauuuugaggccuccccagccauguggaacugagagucaguuaaaccucuuuccuuuauaaacuauccagucuuggguauaucuuuauuagcaugagaagugacuaauacaaucuccaaagcucacaccuuaagaauaaagugugguaaaacccaaaagggaggauugaaacuaucuuugcaaaaauuagaacaacuugugucaacuuuuauaacaguaaaagagguccaaucuaaccaacuccaacuugccuuuaaccuccaaauugcccuuggucauuccugguaugggccaaggcuaacuuuggaaaaaaauauagcuuauaguucaaauaauaauagcccuucccaaaacuaaaccaccuuuauaaaacuaauaaauguccaccaaguuaggggccuaaauucugcuaaaacacaggcauaaacaauuguccaccauuauucuggaggugacaagauucacaacuuccucaguuacuucuguaaauaacaucacuauuauaaacugaagacuggccuuuugaggugucuuuuuaggcuuccgcacuucugacaacaggauggccccaccugagccugacucuuaacucguucucuggccccuacccgaaaguggacucagugcacagggccauuuucuacaccccuaugauagcauccccaaccagucagcagcacucacuuccuagccccugccugccaaacuaccuuuuaaaaacccuaguguccaaauuuucagggaggcuaauuugaguaauaaaacuccagucucccauuuagccagcucuauguguauugaacucuuuaauucuccugucuuaauaaucagcucuaucugggcagugggcaagaaaaauacacugaacaguuacaccacagcuucuauuucuaccuuaucuuucugcuuuuacaguagaaaccuuuauuauagaccugguuggccacauuuuauuguaauugugucuucacuuuucuaccuuccccacugagagucccucuaguguuauuucuaucucuguaaccccaaagccuaacaaaugcuugauaucuagccuauuuucucuauuugcucaaaaaaugacuacacagaaauucagaaaauuuaaaucuuacuuucucacuaaugauauaagagauuauauggauaacagaaaaauugacguaaaaaaaucacaagaauucaauaaacuuaaccuuaacuguuuaugaaggaaagaacuuggauaacucaaaagauaugaaucaaaugagucuaaguuauguguuagcugaauaauuuuuuaaagcugcugguggagguaguagucaacugaggaaaaaaacucacuagacugaaaacucauuuguuuacacuacccugaaaaaaguuccuauuugcaugacuuuuaccuuuugccucaauucuucuuaauccuuuuuuggucagagacccccuugaguaccaugaacuuuauaguuucuuccugcaaaaaccaaaaacaagguaaaaaacauaucuuuuuuagaaaauuuccccaaccauccccacaugcaaugauuucuuuaaguacuccuuucaccacucaguuugugcuauaguaauuuuuacauugauauuuuacccuguaaguauuguaugguugucauuuuuguuguauuuguugucucucuaccuucauugugugcucuguaaagacaggagcuagguaacuuuuaauacucuguucuacucuagcccauaaaugaccaacucaauguagucugccaaauacucaaauacugaaagagcuucucaaugccuaagaacaaguuggugccagguaauaauagcuaaugcuuauuguguacuuacuaccuaccaaguguuacucucaacacauaacuguauuaaacucuuuaauuuucacaaucaacccaaugagcuaagcuaggcuaucaucauccaagugaggaaacugaaacacagcaguaacuucuuaacuucucaagaucauguauccaagaagcaauggcccugguguuugaauacuaguagcuggccuuaagaaaggacauucuucaauucucuacuacaucaccucaaguccuugcgcagaacaacuaucaacugggauguuuuaagaagagaaugacuucuaacaugucaaugaaagaaauacaggcccauuuugcccuuaaaaauaauugcuuuuuucccuuccuuuuuggcuuuauuaucuucuuccucccuccucuucauucuauccccaucaaaccccugaacccagcuuuccacccccaucagaguaauccaucuuaaaguaguuucccuuccauauuuuuauccauacuaauuuaauccuauaugaggagaugcagauauucacaugcauacaaacccacauauacauacauauaccaaggaagaaagggcauuuucuuaaaaaugcaauauuuuuacaacuuuaugcaucuucuuucacaaaacaauaccuccugguaacgucucucacuggaauacaucuaguuccuccuuucugauggcuacucaaucuuccuuguguggaucuaucacaauuuauucauaagggaguggcugaaaacaaaguucacuuuguuuccaguuguuugacucuaagaacaaagcugcaauuaauauaagacaucacaaaugccagugguggaacaugaagcaggcaggcugaguuccuuggaggaagcuucucugucucuggucuuccugaauucucuucucacgcagcagggaacacucccuccuucucagccauuuguugggggucaggaagggagaagugacauauuuugguggggccaauaucaaacuucucuucagaagcucaaauuugaaagcgaaagagaucuucaagaucugcucuccagucuuuuccccugacacuugcugccccguguaugaaaaaauccuguccugguuuucucugccaagacccccaccagagagcaaggccuuauaugcacucggcagcaagggagggaaggaaaagcccagguucuauguucccagaaccuauuccaaguccaucuaauaauuuaaugcucugcuaugaaaccuacuugaaaugcucauuccaaacaaagcuguucuauuguauauuuaaaguagaaaugugaugauacaaaaccagcuaauuuacucaaaaaucagaguaauuagcugaaaaacaaaaacuaguggaaaauaacucaguuccugccuugccugccaaggucaacuuaggacaggacuguaagaguuagaguaugaaacaggccauguuucaaaucacuuuacugaaaauggcuugauaaucaacaaagacagaaccaaagaguucccucuuggcuucuccuacuuugugguggucaugaauuuuaugucuccuaggauaaauguacuuacauugaagcauaccacccaaauugcacucuaaaauuuuuguaauuuuggaauuauuauuuuuuguccaauacauauucuaaucacucuuccuuacugaacuucacugcauauuuuaagauuuucaagucuuucauccagcaggcuaccuuauagaacacuaagucacuuuuaagacagugauaucaguuaguaauuuggauaaucaacuuggcagagugcuuaaauguaaauuuacuauauacacauaucuuguuuaauaucaccaugcauguaaugcuaccccuacaaauguuaaauauuuaacuuaaaauacaguauaccacuaauauacacuuuccccacacucaggaugcuaauaggcacugucaaccaagaagagcaagcauggcagacaguaucguacaaccuuggauaacaagcauaccacaaugucaaaaugcuuaucugaugaaugcuccucuacaccaccuuggugaaaguagucugcaacauguggcuaugucuuguggcccauuuuauaaacuagcaaauaauugugguccaaaauggguaacaaaagguguacaacaguauuggagcuucuacaaauaaacaaggacaaauauuguucuuggugcuaagaugaaaauguuauggcaaauggaaugugccuuuuaggaaacagucauggaaauaggguagagaucaacagaaaauuagauuaguuaaaguccuuugacauuaugaaaagcaucauaaauauugccacuggcugggacaaaugacuaacaacuguuuggcaguuggcauuucaugacuuaaagauauagaaaaaaacuggagugagugccaauuuaagacgucagaauaacuucuccuuaaagcuucuucaagaaccauaagcaccccauggagggucaauuaucaacauucucauuuuuaggaguacauccucccuauccccucaaucaaggagugauucaggggauucaggauauccccugaauccacccuacaugacauguagggucuuuucucuacaugcauuaaaguauaaagacaaagaaagaaaagcgagaagaaaguaaaauauuaccuuuuauuuucucaggcacacaagugauuuggauaccaauuaucaagacauuuuacugauuucccuuuagaaugaucuauuuuaaaucuucagccaccuuagaaaaaguuugcagcaaucacuuugcaauucauaaguaucagguuagaauuuaguuguggaauaaguuaacaguuuauguucaauaugugagguuauuugaacuccugaguuuuaaauauccuguggaacagugauuccucucccuucuaauggcuuuucagauuaaagcaaugacuuuaaaaagauuacauccuaaauacuugauuacaacagaaaucgaccaaucuaaaaaucagauaguguuauacugaacaucauucugauauaaugaguagccucuggcugaaacaaaauuccaccaccaaggccaucaaccagguuaguacuguuuuuccuggggucuauguaaaacucuccuuuucucugcaaaugcugcuuggcugugaacagcauggauuuaccugcaccaauguggcacacaccuagcaacuuucucaagcauucuaaagauauccccagagcuaacaaauauugacauaugucacagcaccuuucucaagaacaguccaaaucagcagugcacauucacacacacaggaaugcuggggauaugcuuauaccugcaccacuuaguuacaacaaggggaaauaagaguaacuaaugaacuuaauagcuucacaagaaaaauguuuuauagucauauacuugacccuaucagggaaaagccaccuaaaagcauguguagcugguuacaaagugcaucaagggagagaauggcuggcucugaauaaacccacagucacuucugaacauaaaguacacauucuaaugacagagauuugguaauauuauuuucacaaaccaaacaguacaaauuucaaguuauuucacaaaucagaugaucaaauaaaaauggacaugaauaugcuuaguaaauuagcauauacauuuuuuuuaaaggugcuauuguaaaauaaccuacaugacaaaauuuggcaaagaguaaacaaaaucauuaacaauaaaccaaaaaacauguaaaacuuaagaaaacucccaaagaauuaaaaaagaacacauauuucauaggauucagaaauuauauaucauuuuuaagugugcauuaagcaacuuuauacugcacuuuaacagucugagaaauuugacauuucauuucuauaaauauacaugaguggagacauuuuauaaguacauaugacugacagcaauauuuggacaacauaaaaguauccuguagauauguguugcugccauaaaucugggaugcaggauuaaaaauggaguaaauaaggcaugacaaugcuuugcacgauuuauugugagugcaacuuaaaaacccagcaaccaaauuuacccaucaaguagcaggacuauaagggacuauuguuuacuuggaugcuggaaaugcugaagaaaagaaaaaccacagccacagauugguauuuuagaaacagucaauccauacuauuuuaagaaaaaaauggaugauuuauuauauaaaauuaagauuggcagaauacagaaaauuauuucuuuuaccuuuacauauuuauuguuaaguaccaagcaaaguguaacaauuagaagaacucauuacaaacuaccaaaauguauucauuuggugaaauuauucaagucacaaaugcuuaguaaauaaauguacuucaaaauacgugaaguguaaaacaaguaugaaaacagugaucuuaaacaaugauuccuuucacaaaaacuaaccaacaaacaagaagcacaagaaaaagguugucagguuagacagaaaaaaauaaaucaaauguauuguugguugggauuguuaaacuaaaaucauuaaacgaaaaccagcaacuagauucaaaagagagaaaaaaaaccgaaaugaguaauuaggauucaaaaagaauaaggguauuacaauacuauaucuguuuuccuacuaauagcaagaaaugaggauuuagaugccaauuauguccuguagacccaggugcucucaaaguauuugcacuggucuucuagguauggacauauaaaugaacuuuacuguuacucaaaggugagaaaacuuacccauuauaaaggaaaggaaaacaauuauaccugauagagcaaaaagaucacacauuaaaaugaucaaauucaucucuagcauaagacuagaauaaucugcuuccaaagaauuccuuuguacuuuaguagaugagggcaaagcuuucaccguaaugaaaaggcaaaugggaggucucugauaaguuggaaucaucauagcaaaaaaagagauaccuaccagaaaauuugcauuaauaucuauaaccucauuuguaaaaaaaaaucauuaaguuuauaaacuauuuuaaaaauaaaacgaauacauauguaauaugaaucauaugccaaauuauauucuauagucauaagugcuauuaauaaauacauuugauucaugcuacaagagaaagaauugagacaauuucacauuucagaauuccugagucuuaucagagaaaaacaaguacugaaaaaacaaacacaauaaaccuacuuaaaguagggcaaauaacaaaauuugggcauauuuauaguuuuaaagcugaagacuaugggaacaauauauauguacuucaugaaauuauaaacauguuuuuaaagcuugguuuuuaaaaaaggcguuuugaucaaacaaggccaccugagugacaucuucaaugaugguaagcccaccauuuuaaaggaauaacaucuuuauuuaaaagccuaauuauuaauauaaaaaggaaaagaguuuauuuuaacaaaauguuuuaguaagauugcaaugggacagcccuuugaugaaaaaucuaaggaggguaaagccaauguaacugaauuagaacaagaguuccaauuuugagcuaccauccaccaaauaauuucccuuuugcuuugcauauuacacagugaaaauaaacaguuauauuaagagcacuucagucccacaagguaggauuuaagcuuugugaauagguguaaauggcccuguaacaauaugaugccugcaaaaauacauucaacugaaaauuaaugucuguucuuuaacuaguaaggaaacgggaagcuaaguggucccacuuaaacaauaaaacaaaacaaaacaaaaaccacuguuuauccuuucuggaaagacuaccaaagcaaagaacauccaauaauauuauaaauuuaaaacugcauacuuuuacucaucuuuacaaguaggaaagaugcauacaaacuacucaugggcuuuauaaauaaagacacuaagcagaaauaauauuuggguuauuucucuguucguaaauacacagaaauaaaacaauuaaaaaacacuaaagugcagaccuauaggccaauacaggcaugauaaagaggugcagccaaauuugcaucuacauuuacacuuacauacccagaaaaugauucuugcuuuaaaaaaaaaaaauugugcaauuuaaaaacuagucaguuuuguuugugcuguaauacaauuagaacuugucucugcccacuagugaagugacugcuagaccuuagauagcacacuaggcucuugacaaucacguaucucauuagaaucauacaacauugauuccaccuccagaaaauguuaggguccucuuguuguagaaugaagagccacugguauuugguugauugccuuuaaccagagaagauuucaguuccauuucacaagcuacaauagcugcauucaauuccacuugagcucgaugaacuacauaaaacaugaggccuauacuuauaauaaucugugaauaaaaauaaaacauuacaguuaucaauauuuuauacaaaaaaaagaaauaaauccaauaaauauuuggcuuagaaaugcuucaaacagggugcuucucaaagaugguagguaaaggguuauacauuuuuaaauaguuuacacacaguuauuguuuauucuuuccuuugcugcuucuccugguaguggaggaccaaagucuacagguaaccaugacaugguauuaggaaaacacacauuccuuuugguucacuugauacaagccaaaccugucucuuuguaccaaaaagcuuucuucaaggaauaaaaaaugucuacaauagagguaacagcuggcuaaacuuuguugguauaauuaauguaguauuauaccuuugcaugacuauaaauguccauagguauuucuaagcccacuuagugagaagcacuacuauuugcaaugaacuaccuggugaagacaaaauuaaaaguauuacagaccacuuaaaaaaaugaaaugccaauaaacuuccaaagaauuaacaagagauugugaacaaguaauugccuguacuuaggaaaaaacaaaaucagaggaaaacaugaugauuauuuaaaaauguuagucaaagggauacuagaaaaaucaucacacugaucaaauugaaagucagguuucuagucuuagcuuagcuauucacuagugaugugugauuuagggaagcuucaguuucucauuguccuauaggaagcuguggucccucuguacuuuuuuuuucuuucuuuuuuuuuuuuuuuuuuugagauggagucucgcucugucgcccaggcugcagugcaguggcacaaucucggcucacugcaacuuaugccucccggguucaagugauucuccugccucagccuccugaguagcugggauuacaugcaugcgccccacgccuggcuaauuuuuguauuuuuaguagagacgggauuuuaccauguuggccaggcuggucucaaacuccugaccucaugaucugccugccucagccucccaaagugcugggauuacaggcaugagccacagugcccggccaacuuuagcauucuauguacagcuccucagaaugucuaagcaguguacauuuucuaaaugaguuuuauuccaaaguucauuuguaaaucaguucuuuaggauuuggagcaaacacagcagguguuauuuaaugucccagcaaguuuacaaaggcugcuguaaccaaaagugauacggaaauauaauacaauuucaaugaaaucuacccauaauuauaacauaagcuuuaaagggaaaguauucuaaauccaagugcugagggugguugggggaggagauaacagaagcagagcauacuggggguaugguaagugugagaggggaggaacuuggaacuugcacaagggggugccauuaaaugaguacccaucacucaguaaaaucguaaauaaguuaggcaucuuaaagcugggucuuuaaauucuguaacuguuuucuguuacuucucuuaaaagaaacaagauauauuuaccgaaaacuccuaaguuugcuauguaucaacaaauggaaacaccauguaaagagaugaaaaaaauaugggggcgggggcgggugcuuugugaauuagaugcuaccuucuguuuaagacaugcugaauucgaggugccucuuagauauccaaaaaaguucauggaugucagugaaggggucugaagcuauggaaagagggcugagcuaaagacaagugcuggggaguaggaugagggcaggcggagggucuugacccaaauacacauauuagcaaccaucagaguaacuggauuugcuguaaaaaaguuuucagaguaggacuagaaaacuuaagcuaggaucuucaaaaacacagauauaaggggugaaaggaagaaguuaagcauaagcuaggcaaguggaaaaaaaaaguuaagacagugguaucaaagaaacuaaggaaagaguguuuuaauaaugaaggcacugucaggagucuuagacuacuaacaggucaagcuagaugagaaauggaaaguacaucucauuuagacaagcuuacugacagcccuaagaagagcaguuugagggaaggaaguggcagggccacagauagcaagggugaaaugguuacaucuuuaagugggacuuucccagcugcacuucugaucccagggccugacgauuuguacugucccccaacacaccuuccccaucuuccuuagcugagugaaguguuaaaaaggguuuagaaaauggaaauagauaguacagacaauuguuuuaaaaguuuccuuauuaaaaugaaaucaaagaaucaaacacaggcagaaggucaagccucauacagaaagacaggcaucucuuaaugcuaacuggaaagcaagcuaagcaggggcaggaacauaagaaguuaacagauuucuuauaugcaaauucagggguuucucaguugaaggcuucugauuuuucuguuaagcaagagagguaaucugcugacaauaaagauggaaacaggcgaaggagucaaaauugugaggagaagugaagauaguuuaaaauaauuaacuauuucaagacaacagcaggggagugagaagacaaaggagagagaugggauguggggcagugucgagaaacuaggugaagauuugcaaccaugaguuaaauaucaaugugucugguuacaugacuuccccaaaagaauaggggcaaagcagauaaaacuuggauguauucagguuugggguuuugguuaguagauacauagaaaaauaacaggcauggaagaguaacuaaauagaccacagaaucuaagcuggauuucaguacaguuugagcauuccuaacccagaaauuccaaaccucaaaggcuccaacccgaaguuuuugagcacuaacaagacacucaaagaaaaugcucauucgaacacuuuagauuccagacauuuggauuagggauacucaacagguaagcacaauguaaauauacugaaaucugaggaaauucaaaaucuaaaacauuucuggcugcaagcauuucagauaagggauaaucaaacuguacaagaaaugguuguggcuuccuaugaacaguuauuuuguauugcuuuauuuuaggcugacagccauaaaacucagaggcaaauuuguggcucguuucuagaaaauaagaggaaucucaugaauauacuuauucugcuagcuuuaaccuaagcucucuuuuuuuccuuuuguauauauuuuguaagcugcauuaaaugccuccugauacaaauuaagcuguaacuaauaucaauuaaaucaaacaagcguaaacaugucuucacuucuuuucauaaaucccuaggcuaagaaauaugugcuuuccccacugucuuguauucuaagcuuaaauuuuccagcuuagccaaagggugagaaaucacugaauaaaagaagauucuauaguuuaaaaagcaucaugaacuucauugacuauaguugaguaauuuacuaagaugcauaaaaauauaaaguuucaaauaguaaaaguucucucuaagcuacuaacaaugagggauucuaauuacucaaauguaaagucaaagggaaaaaaauguuacaaauagauuacuuauuuucaggaaacuacaaaaaaaaugcuuaacuucauacuaaaaaaaucugagaaugcaauacauauuagauaauuuuacaguucuuugggacaaucauaaauguuaauuuauauacugugcuauagauauaaugcauagaaaguuuaacuuuauaugauuagcaugcuguauuauauaaauaaaccaacuguaacaaaaacauuuaacuuagauucagauuaucugaagaaaauauagcucuggggaaaaaaaguaaagaaaaauaaaaacugacucuuugcaugucaaaaauauuacaaaauuuuucuuaaagcaaguacucuuauugauaagcuuuauuuaggcaauauuucaauguaaauauucaugguuuuacuuuauguacuaaacuuguaccucauaagcgcaaagaaaauuaacucuggcuuuauuuuaucauaguauuuuaaauaagauagggccucaaaaacuugagaauaaugccaccaaaauuaaauuuguaauacgguaccauauacucaauaacaguuaaguuaaaacuaacaaguuaaaagaccaguaagucuggaggaccauuucauuaguauuauuugcuuagaggaguauaguguuguccccuguaucugugggguauugguuccuggagccccccagauuucaaaaucuguguauacucaagucccuuacauaaaauggcaugauaguugcauauaacuuuugcauauccuuccaugcuuuaaaugauuucuauauuacuuauaauaccuaauaugauguaaaugcuauguaguuauuguaauacuuuuuugugcuauuuuuuauuguuguauuguuauuuuuaauuuuuuucccaaauauuuuugaucuguaguugguugaauccaugaauguggaaccaauggauagagagggcugacuauauucuacugguuuugagcauaaucucuagaaccaaccaccuugguucaaauccuggcucuaccacuuauuagucgggacuuuaaacaaguuacuaucuaauggugucuuugugaaccaguucuuguggaucagagacagggggcuugauuuacagcacuugccauuucccaugguguaaauauucccaucaugggcaauucaagcuaucaaugugaugucacugaaugcugaguugggaagagauguauaauacauaaccagcucaagauaauaaacaucugaaaaaaaaaaucuguacauccuaggguuuugguagggacuaaaugagcuuaaauauguggcauauaaagcauggaauaaaggugaacuaucaucaucaucuuacuaguucaugaaaaauuaugauuuucuauuuuguuaaaucucaggaauaaaaucaaucacaaauaaauuuuaacuauuucugcaugcaaauuuaaaggcucuaaagaaauuugccuauguggcaguguuuuucucuuucaucaacuucuuauguaaaauuuuaugugccccaaacuauauuacaaucugcaugguaauaauaauccauuauacaagucuuauuuggacuuguaauagaaaaccuuagacauuuuuacgagguaauacuuuuuaaaacaaaucuuuuguuucacaucaaauuguacuagaaagaaauuuacacucucaacauaacacuaaaaaauacaaauaggugaguuucaauaauuugaauauaaauaagauaagcacucaacucugcccaaucuuacugaaauuauuuucagauacacuucacacaaaaucaaaauacaguauuugauuugugaugacucugaaaauaaucacugcaaaaauaacccuauuuuugucauucuuuuuugccucuuuaagaggauuuuucuguaucaauucaguucuacacuugcauauauccacacaauuaaaaaauuuuaauguugucaaaauauguaguaguaaugaaagaaccaagaaaaaaaucuaaaauggaaaaacccucugauuauuuucaaugaaaucugucaaaucagcaaugccauacaaaaagaaacagagagaaaaaaagagacaacccuuggccuuaaacucaccuguaaacaaaaaacaaaauauccacuaacacucuguucugcaaugacaucuuccauuguccgcagggugguacccaaguaagaauucagaagcuggguaggaagcaguccaaccgaagaugccaucagauaguuggguaaugagagaucaguaaucuagaagaguagauuaaagggaaugauucauuaccaaguaaaauuucaauucaacauaaaaaaauguguguauuaagucuaacuagugguauuuccucgggaaggagcugacaucuuuacaacaguauucugaguuuacaaaaugauuauaaagagaauacaugcagaauguagaaaauuuagaaugaaauaaaaguaaauuuuaauauucuauuauacuaccauugaaagguaacauuugugacuauuuuuucuuucauguaaauaaaauccacacauugauaacuuuguaaaaacaguuuuguaagucuuccucauaucauuaaacauucuucauaagcauucuuaauuagcaguguggucgcugagcuuugaagccagauaacccuagaauggcauucuggugcugauaauucaauaugcuacucugucucuaaauaucuguuuugcuuugucuggaucagagucuugcucugucgcccagaguggaguggaguggugcgaucuggccucacugcaaccuccaccaccuggguucaagcaauuuuucugccucagccucccaaguagcuaggacuacaggcacaugccgccacaccgcuacuuuuuguuguuguuguuguuguuguuuuugagacagagucuugcucugucgcccagguuggagugcaguggccccaucucagcucacugcaagcuccgccuccccgguucaugccauucuccugccucagucucccaaguagcugggacuacaggcgcccgccaccaugcccggcuaauuuuuuguauuuuuaguagagaugggguuucaccauauuagccaggauggucucgauauccugaccuugugauccgccugccucagccucccaaaguacugggauuauaggcgugagccagcacgccaggcccuacuuuuuuguauuuuaguacagacagaguuucaccguguugcccagguugcucuugaauuccugagcucaggcaauccgcccaccucagucucccaaagugcuaucaguuuuucaucuguaaaaugaaaaucaucaccagcuuagauggcuguuguuaggaucaaaaauauuucuaaaguaucuaggaaauaccuggcauaugagugacacucaaaaaaggugaaaauuaucauuauuaugcaauuauacuaccauuguguggauguagcacaauuuaaccacuccugcuguagaauauuuacauugcuuuauuuuuugaauauauguaauuacacauuuauuuuuggcuauuaucaaaaaauucuaaaauuacaaugacaucuuuuggauauuaaccucugugguaggcaacaucuaaaauauuccuaaugacuugaucuccugguauucaugcccuugugugaucccuuccccuagagcgugggcuggaccucgugcuuacuucuagcaaacaggcaagagcagaagugaggagaugccacuuccaaaauuagguuacaaaaugaauaggacuuccacuucuuccucaagcaaguaagcugccaugcucuaaguagcucccauggagagacccaauguggcaaggaacugaugucuucagucaauagcuagcaaaaauagucuggaaaaauagccagucaauagccuggaagugaauccugcccgagucaagccuuaagaugaugcagcccuggccaaaaccuugauugcagcauugugagggagccugagucagagguacccagcuaguugcacaggaauuccugacccagagaaauugugagacaauaaaugauuguuuuaagcuacuaaguuuugaagugaucugguauacagcaauacaugacacacguaucuuaacucugguaggauagaucacuagaaguagaauuauugguucaaauaguaaaaaacuuauuuuccaaaauguucacaaugauuuaacacaccugucaguaugugauacaugaauguguccauugugucauacuguuaccaacuguagguauuaaauuuuaaucuuucuuauuuugauaggaguaaaaaugauguuucaucauuaaucuguacuauuuuauauugacacauuuucuacauauguuuuuuauucacauuuccuuauggcuucauuuguucacauuugcuuuuuuuauugggauguuaaguguuuuucuuguuuauuuguaagaacuauuuauauagugagggcuaucuguugucuauuauauguagcauauaguuuucgcuaaaguguccuuuaucucuuaauuuuauguuuugacauacaaauguuuuuaaauuuuuauauaaucaaauauuaucuauuuuuuccucuuauuuuuccacugcauuuagcuuuagaaaguguuuuaagaguauauuguugguuucuaccuauauauuucuucugauuauguuuuccuuuuuagcauucaccacuuauuccuucugaaauuuauucaaauuaaaggugaggauauagccugaucccuccccguuccaguagccaauuuucccagcauuagauaccaaauaaucaauaacuucuccauggacuuauuauguauacuucaguagaaauaaaaguuacuuuauauaaaaagggcuuauuuggagcucuaauacuguccauguauauuuuaaaucuucuacuagaacuaaaacauggguaucucaaaucucguacugaaaccaaauuguaauaaagacuaccaguuaauacguggcaaggaauuucccauucuauucaaacuccuucuuuacgcuucuuuuaaaaauggccauaacuguucuuggccauauuuauucuugcagaucauucugucacucaaaaaaaaucaguacauuucauauugggauuaaggcaaaucugcaaauuaaucuggauagaccugaaaucucuacaauauuagguauucuuauccagaaauuuuucuauaauuacucaaaaucuucuuuuauaccucuuacuaaaguuuggucacuuuauucacauaucucaugcauuucuuguuaguuuauuucuaagcacuucauguuauuauuguugccacuacuacugauuuugaaaguaacuuuuccacauccccaucugaguauuacugguauauaagaaagcuacuggccacuauauuaaacuuuuuuacaaauuuuaaaaucugauacuuuaaucagcuauaggugaaucuauaacuauuaauacaaccaaaucuaaaaaucauuucacauuuucaguaaaacuacauucaacuauauuaauagauaaugaacuggagaugcaucacugcugauuuggaaagaauauuacagugacugguuguuaacaauccaccuuaucgaucacugacucaacugcucaugcgagaugcuccaagaagugcuuggaagagauaaaaagacacaaugccuaccacugauggauuuacacacugacaaauacacauaaacuaccucagaaacaggcagaauggggagcauugagaaggccuacaugcugagcauuaaagaauaaaggaugaaaauuaguuguagaaguggaaaccaaagcguaacuuuuugggaagagagggauucaaggcagacacugaaagccuaguaugaguuuggcaagcaaagauagauaggaugaggaaggcagguguuucaagaagagaaugaacaaaagaugaacagcuuccaaaucauuuuauuuuauuuuauuuuauuuuauuuuauuuuauuuuuuuugagacggacucuucgcugugucacccaggcuagagugcaauggcagggaaaguacagaauauauucauaaaguuggcaguacagcuaggauuguuuauacgacacacacaaaucccguaaaauaaagacaggaaaacuacauggggugauacuuguuggggccuuggauaaaagaggaaggagccuauacucagaggaaagguaccagggagucuagucaaagaaugaugugaauggagcuaagcugagcaagguuccuucuucaauuuagagcacuuacaggagcagagaaauuucuuuagaauaaacaugucaaauaaagaaaaugagaacauaugacaaaaaugaauguuauaaaauuauauugcaguuaauaacaaaacauuacauauuauggaaguuaucuuuaaaauaaauaucucaguucaaaaauuucagaaugcaacacuucuggccacaaccuuuaccuuuaaauguaaugaagcuucucuaaauagaacacauaauugacauucauagaugacaucaauaauauucaaauugguaauuuaagaacagauuuccuaaaugugaaacaacuccaccacucaacucaacaagaccguugcccaugcauaaacugcauaaacugaaguuuaucaaaccuuucaugaccaaaccuuacccuugggaaacaguguuacuaugcauacauauaauuuuaguuaauaaucguaaauauuuuugcuggagggcucaaugcuuuaaccaauggagcaacacaguaacauacauauacacagguuuuaaacuauuaauaacuuuauuaaagaugaacagcuuccuccaaacuauuuuauuuuuguuuuauauauauuuuuuugagagagagucucacucuguugcccaggcuagagugcaauggcacgaucucggcucacugcaaccuccgccucccagguucaagcaauucuccugccucagccuccugaguagcugggauuacaggugcacaccaccacaccuggcuaauuuuuguauuuuuaguagaggccggguuucaccauguuggucaggcuggucucgaacuccugaccucaugaucugccugcgucggccucccaaacugcugggauuacacgcgugagccacugcaccuggucuauuuuaauauggcauuuucuauaagcaaaaauuuuacucagaaucuccaucuagcucagucuuugacaaacauauuuggaauacuuguucccacaaggagaugcauccagccuucucuccccaguaagucuucaagcaccaaaguuauaaaauucugucuccuuguucuacuuuguagaaagacauuaaacaugagccuagaucaauaccauuggaauuccugcuugcaguacccagcauuuuggcucaggaguuguauuccaaaucaaagaaccccuacacuucucaaccuaggauaucgaugcuaucuugcuaguuaguuucuaugaugagauaccacagcaagaguuuaagggauggcaaacaccaacugauugcugucaucucauguuuuaaaaacucuagaagcacuauaaaauuauauauccucuuauucccagagguacagugauauacuuggagaugugauucacuuaacugggucagcagggguuaacauguggaacaucacuucaccacuauaccaaauagauccugaaaacaaagaaguacuccaucugggagggaaaaaaaugagaggaaaaaaaacuaauucugaagagcaagagcugauucaccucugaacacagcauuucuggagcugacaacagagaaccucugucuucagaucauucacugaagcugggguuguggucgguccucuuaggcacagcaccaagcacagcucucaggaaaccugacccagcucuucugcuuucuaagauuauagcuuuuuacacaauggcuuuaccacuuugauuuaacccacccagaaacuuuguuuuuacauagaauaucuuggcauggauguaauaaaaaauauaaaggugaccaguauucagaagaccucaaauuuuaugugcagcucugugaaucuagcauuaauuuuggcaaauuauaccuuccuguauagacuuguugcuugguauuugggaugcugcuuauuaacaaaguuacuguuaaaauauuauaaauuccaauuaaaauacauuuaauuauauuauauaugaaaaaaucaugaaucccuauagaaaaaaaucaugaaucccuaugacuguuaagaaaggauuggucaagagaaauuaaaaugaccaguuuggucuuuucaucuaauuaauauuuacugauaauuuuacuguacauauccccaaaauacuuccuauuaauauuucagaaaaauuggggaacagagaaaaagaauucagaagcggcaacuauuuuucacucucagaaaaucaaaacuuuaaaaaucaguuucaagaaaaacauuaacuaccuauucucuuuccuuugcuccccaaaauaccucuucaucuuuucuguguucccaaucucagcggcccuagcuggagaccucaucagucaggcacauagcuaauuccuuauuucccacauucaauaucuacuacaucuugucaaccgcaccuucucuggggaaaucuauccaccgucugggccuauuucuaauucagucuccucuuugguccugacuacacagacuacccccacucacuaccuaugguaacccugcagaaaucuuuuuaaaaagugagccuaauccugcuuaaacucccuccuacugccaugagguucuucagagugcaaagugcuucaugaucuggccucugagcauuucaugcacccugucacacuaugucccagucacaucaaaauuuucucaguuccuagaacacuacuugcuccccuuucccucugggccuuucuacguuguuccuucuggggaguacaacaagcacauccuucuucccacuccauuuacuccgaaaacuccuacacugucuuucacuacucagucaucaauuacucuaggaaaccuucccagaugccccaagucuuuguuaagugcuuucaagugcucugacagaacacuauacuucccuguccccuuugcacuggagaacaacugaagguuucaccauuuguuugccccucaguccuuucccagacuauaaauucugugaggaaagggaucugucguucuugguccucauugugucccuagaucuuaacaaaugccuacuauauauuaguugcuaaauauauguuuauuggagguuggauguaucaacaccaauaaugcuuuauuuauaaauauggaaaccuagaauaguugccaguuuauaaacaaguuggaaugcaauguccauuuuuaaucggauuuucagaaauuaagaacacucugccaaacacacagaaaaaauguuauaaaugaaaauuagcuuauuaucagcaaaacuuacaccaugauuuaccuagaaugcuauuucuccacuggaaugcuaccaccucaagggagagacuuucuuuuauucacggcuacaccuccagcauuuaaaacagcagcaggcacauacuaggcaccuaccaauuauuuacugaaugaauacuaaaaauauuuccagaaaccgccauggugaaccuaaugucaaggcuaagacccucugguuagggucucucaagcaacccugagaguacugaaaaaagucuugcuacuggaggaaaaaaaaaaaaaagaacaagaaggccgcagcagugcugagacccuacccuaacagcuagagagggcuucaggguaaagagauuucuacugacagaaaugguuaggucaaugucugucuacaacacagaagcaucuucacauaugcaagcuuuuucaugacuucacugucccuaaauuaggaacugcuuuuaaugguucccaaauaucuuagggagaggucaccaauuuauuugagaaucugguguaaccccccuuccacccucccacccacauacacacagaggccuugaaucuucucucaaggggggaaaaauguauaucuuauuguacauaauuucuggaacacaaguugaaaagcuuuucuucauacagucugacauacuauagguuuauuauuuguacuaaaacauguaucauaugccuucuauauauaucuaagacccaguucuaagcagaauaaaaaagauacaaagauggaaaacuacagcugacugugcagucauuaaaagucauguuguaauacacguaauaacaagauguucauuacuucaaguaaaagaaggucacaaaaaucauuaacucaauauuauauuaaaauacauaucaauaaaaugcaaagagaaaaauaaacacgaaaauguuaaugauguuuuucuuuguacuugcuauacuuuucaaaguuuuuacaaugaauacauacagacagaaaaaacaaacauuguuaaaacauguuuuaauaaccucguugcuuuuaaacaaauuuuuuuuaaucuaggaaggguuaauaaaacauacucuauauacauuaauauaacaggcuagagauauagauuagugaauuguaagccuacauaugacacaaaaacugcagaagcugaugagauaacuaaagagacacaaagaggggaaaacaguuucaaggaaauaaaggucaacugcauucagugguauugugaggucucaggaugugcacugagaugacauuacacaacuuguucauccuaucugacccuuaagggccagacuccaacucuuucaaaacacagacugugucugccuuucuauuuugccugaacuguaccacuggcagcgaaucauuacacuuuaauaguaagaagaaaucaucauuagauacacugauacagugacaaguauuaugaccgaucauaucuuuuuuugaaucuauggcucuaucuacagcacagaauaagaauuaagaaaauaagaaaacauauuacagaauaagaacucaagaaaaugagaaaauguguauuuuuauaacacauacuaucacuaaacuguuaaaaaauaaaagguaauguuacacuguugcucagaacauuugucuuuuuaaaagcaaacucugaccucaucuguacccucucauuuuacaaauaaggaaaacugaaggccagaaucauuaaaucacuucgccagggcuacaaaggagcuaagacagaaccagaagaccccauagcauaagcuaagacuauacuguauuuguggucuuagagucauuugccaaaaacuuuuauuuaguuguaauaaauuucaguucaaauauaaacuaaauuaguaaaaguaauuuaucuucuugauagcucaaugcaaacucaaagaaaacuugagaacaguuauaucugcuuaaaguuaugaugacaucuuucacuauuauuauuucagucaguaccaguuucacagcuccccggcucccuccaaaacaaagaaucuauuuguugcuucaaaccuauggugggcucauauaaauaaccaaaguaacuggcaguuugguaacauucaauucuauaaagcaguucccuaagaagugagccagggugauggguaaggucuugcacuuuaaaauuuacucauuucuauuuuguuugcauuuuacacacaguacccauuuauugcuuuaaaaauuuuuuuucuguuaaauaaaaauacaagauauaugugagaaauuaagggccucuuccuacaguugcaggggcucagccuugguagcuguuuuguuggugugacucuaaggcagaaguuggcaaacuuuuuccaugaagcaccagguaguaaacaguucaggcucuguaggcaguagggucuguaguaacuacucaauuugcuguuuuggcuuaaaaggagacacacauagcacacacauaaaugagcacagcuguauuccaguaacacuauuuacggaugcugaaguuugaauuucauauaauucucauguauaugaaauauucuugugguauuuuuuccaaccauuuaaaaauggaagaaucaaucuuagcuuguaugccauacaaaauugggcugugguuuucugaccccugcucuaacaucugggaugauaccuaagucaacuguauagaaccuuacccaguccuccauaaugucugaucuuuaaggugcucuaagacaaguauucuauaacuggaaucaggaugugucugggaaauccagcucuucuuggaccaacacuagugccuggauaaguuaaugacucuaaacauuuacuaacuguguaaucuugagcaaguuauuucaccacugugccucaacugcuucagcuauaagaugaggaucagggcugaaaugaacaguaaauaaguuaugugugcaugauuaaacagugcccaggaauuaguuaaguacaauguagguauuuguuaaauuuuuuuaaaaaguagcucaacuucacuguccuuauuuuggaaggcagaggauggugagaaagaaauaguaaauaaugagcaaacuauauauuuuaucacagcuuugcagcagguauuauuaaacacaucccacaacagaaaguauagcucaaaagaguaacuauaacuacuucaagaugacacuguaaauguuggaaccaaucucauuucaaguuucuaccaugcaugggagaaggggaaaaaaugguucagaggagauaagcaagggaaagcaccuuuccuucuuccauauauuauccuuuacaaucagcuccugcuucuaaaaugugaauacaacuaccuccaccacuacaaacaauaaugacacuuaacaauuacugggaagugacuaugagccagacaaaauacuuaaugccuucacuguaucagcuuuuuuaagccucauaacuacuuuauuuuacagaugaggaaauggagaaggccagauggcacagacuaauucaggaucaucuauuuccaaagccugggccucacaugaccacuacaccuaacuucuuugagguacgcccagaugaauuucucuaauuaugggcacacaaaaaaaaugaguuuuaacuggaauuuuuuucuuuaaaaaaaaaaggaugauuucaaagauagggagggauguggaaaacacaagaaauaugccuagaaaagggggcagcuauggucagcaggagggguaugagguggagaggauacaugaggaggcagaauggaguucuagaaggcagaaagucaagucagacuaaaaccaacaucagccuuaacuaagcuuucuuuucuuucacauaucuuggcugaauucaguaaacuguuuuuguugaaaggacuacuucuguaagcaggcaguucagaacaauagguauaaacaggacauaacagaccauauccaggggcuucacaguccacccugcuauggcugagucaaaauuuuacaguaagaugcaccauaucagcugauccuggguucaaacccuagcucagccacuugguaggugggugacugaagaaguuccuggaugguugagccucuguuucuucucagugaaauggugacaauaauaccuauugcaagaggccauuuuucuuuuuuuucccuucuuuuuuauugaccacacaaugcuaaauugagauuugucccuugucaagcucaguuucaacuacaugauuaccuuaaauuauuaccaagcacaaaauacaaccucuuaguuauauacuuaauauguaagagacaaaaucaaaagaaaagccuaccuuauugucagucgauaaauacauaaugagcccuuacuauuuacccaugacuacaccaggcauuaaauauauauucaagaaauaaagaggugguugguugagacacugccaucagaccaugguucaaaguuugacucuaccauuaauuuaguaccuuggugaccuugggucauaacaacagaaacgacaaaagccaacacguguuuguuaagccaggcucugcugcauguauucaucucauguaaucuucucaauaauccuauggaaguagguaucauuacuuuccucauuuuacaaauaagaaacugaagcccagagagaauaaacaacuugcccaaggucacuagauucuaagcagacagcaggauuucacaacaccagcccugugcucccaacuaguagacacuagucuauaauaugugcauaauuaacuucugcagggcugguuuaaggaucagaaauauguggaaagagccgaggacaguaguuggcacacgguagauggacaagaaaaggcccaaggauacaugcuauauugaaacacaaacuaacagaaucaaucuauuuagguuccuuagcccaaccuucuuucaaaguccugggacaguuuauuuauuauuacccaagacugggucaaaguucaaguuuauauuucauacuauaggaggguaugaaaaagaaauuuaagacuaagacuauaccaaacuacugcuaacacuaaacuuuaucucuacagaaaaccccuuaucuguuuccacugccucuaccaaauaccauuccauagucauugcugcuguugcuuggaaucaagagguuugcaaaaggcauuuaaaagaaaagaaaaaagagaaagguuuuaauuucaucacaaagaggcagauugguuaguauuauuccuaauucaaaacaaaaugagaaaguuuccagaaacuaacaauaauuuacguuuugaaacaaaauaaugcaucagaaucacuuaaaauacaucaauuccuaugguuuugaaugcaauuaucucuuuauuucaguaaguuuucuuuaagucuagcugaaggguuaaguuccugggaaucuacauaaacucuugguaguuuagaaucacugaauuuggggaacaugguaaucuacuuuuuuaaguccuucacuuucgaaaagagaaaagugaagccagacagggucaguaacuugauccaaagucacaaaguuuguaaagaccagauuccuuucuuccaauaagaugaucucuucacuagcaguguuucuauccuaaaucaguugcauggagaugcacacuagcuauagaaaccugaguaagcaaaacauaugaauacaaggacagaaaagagucuauaauggugcagauacagaagaaaaauauaugcuaacugagcaaaagauuaucuguucuguuuuauucaccaccccgugauuucgaaaugaaguuccuccaaagaaagaaagauaaacaguaggauuuucuucuuuacaucacauuaaagcacaauuacuugaagaagaaaaagcccauuucaaauuuagcaaacuccaaaaucuggagucugcaacuagcuccuccacuguuuacugaaacacuuccuuugguccaugucgcuaaaaacuugaaucaaaacccuggauguauuuauguaagcaagagagaaagcuuuccucccuaaauguugccaaagcugcuacaaaagaugacaaguauuaaagaugggcauuuccauucaugucccugcaugccuauuguuaagagggcuuuucauuuuuaauuacauucccaucccuaaaagaaacauuaguuuuuuaucuaacaaacucucuuucgaggcuccgcguuagguauguuuuauguguaggacagacuucccaggcugcgauggaaaguaaucguaacuccugccgucaaugucacuucucugcugguauuuaucugauagagcgcccuccuagggccgccacaagaccgcucaaaaacagacuuggagagggauaggccagcgggaccccacuuaccgaaaacacugcauucugaagcccaaaagguaugggugucagucuggccagcgccaccacuuucaggccgcuuccucccuccacuacgcgaauaaccgcgcucagcuucucgcugcucuggauccuggcggccacccaggcggugaggagccgcuugcagaccacaugggcgaugaaggugccgaugaggacgcccaccaucaucagacccaugcccagcacgaagccguacagguagccagcggccacguugagcacgauguagccccagccgcaggggaaagagaccacgaugaagcccacgacgaagagcaggacccccagcagcgagucaaggcucuccacccacagcaggagguggugaagguagcggcggaccagggccagggaagcgaagcacagggcggccaacacgcagaccagcacgaggcuccggcaccaacaggugcugccgaggcagcagcagcgccaguuucucaccucagccacgccgaccaccacgccgccgccgccacucccggggccgcccgccaaggccccgcccggcuccggcagcuccgaagccucgggcggaccguggcgcuccagauaggcgccgagcagggcgcccgaggccgccgcugcugccgccgccgcgcucgccccgcccccgcggggaaggcgguccgccgggccguccccgcccgcaccccgcggcagggcccagcgggccggcagcucggcgaggcccgggagggcggcgugcugcagcagccggggcagcgccuggagcaggaucccgcccgggcuccgcaugccucggcccagcgcgggcccucagccggccagccccuccgccgcggcgcccguuaggcagcugcccuucauggcgcccgguucgcccggcaucgacucccugcguccgcucagagggugggagacggcccguagaagggcgcggagucagcggaggagcgacggccaggcggggagugaggaaacuccu

SEQ ID NO: 13899 - RNA, 25831 nt, Homo sapiens
agguuuguacuacagaaagugccaguuaauuuccaaggaagauguuacucaugauacgaggcuuuucuguuugaugcugccaccaagcacucaucuucaagugcccauugggcaacauguuuaccucaagcuaccuauuacagguaaggugaauagaggcuuugggacacaauuuauucuuuuauaagcaguucaaaaucaguacuauucucucuagaaaacaaccauuuaaguuauuaauaaauguuuccaggcagcuagauuuagugauagucagaauguagguuugugacugcaacguguccuacauguuggaacuauagcuguaccacauuaucauauggaacaaagauauugccaguaguuuagacagaugauuccaccagcauuguaauuuauuacuaacaaaacccuaaaggaaagagaugagagacugcacaaauaguccuccaugaagacaacuacuagaagcucauacuggugucucuuagcagcuacuuaggguuguaucauuuaugaaguugaaucuauaaaauuuaaaauaagugaaugauuggaaaugauuuuauuauaugugcuaccaguauaagaagcucuauaaauguauaaauaugaauucuuuuuucuuucauuuucauccuaaauuuaccucacuuguuuugaauacccuucuuauugacguccaacauuuucuuggccuuuugaagcugcaaacgguaaaauucuccugucagcuguaguguuucuggcagucgucuaaaauguuaccaccuaggucucagaagauaugauauauuaugaugaggcacuguuaagguuuucuguuuuucaucacuaauggcugguuuucucuuuuucaucacuaaugccugguuaccuaauucaagagcugguaucuucuccaguuauugccaaugcauuuuaauuuauauauguauuuuguauacauugaggagccaugcguaaaauuuuuggucuuucaaacaugcaaugauucuucucuuuggaauuuggcuaccuaaaauaaaaugaguucuuauuuauuuuacucuuuaagaaaauaauauauucuuagaaguagcuggauuaacauucuuuuuauucaguuaccaaaguaauauguaauauguuaaaauauuaaaacaauuuaaaguacauaaaguaaaaagugaaauuucuuccuuuuucuccgccaaaugaucccauuggucaucaguaacauuuuuaaaaauuugguguauaauuaaaauuauuagguaaauaguuuuuuuuuacaucuccaugguaacuuuugaugccguuuuuguuguagcccauuacaaaguuuauuugcugauggaauagaugguugucuaaaauuauuaccauauauuucuauuaaauuagacuauacaucauaaaaacagauuguuuauauuauggguacaguauugauuugugaaaauuguuucggcacacauaggcuugggguauauauacuauauacauauagaaaaauaauuagaauuauaugcccauuagguauauaguuuuaaauauauacugauagugucaaaauuuggauguuucauuuucauugagauuuuuggauuuuuagaauuuaauuauuuugcugugauuuuuuuuucuagguacagaaauaguaaagccauauacaccuguaucugguuccuuacucucagaguucaaggaaccaguucuucccaacaauaaauacaucuacuuuuugauaaaaaucuaucccacuggacucuucacaccagagcuugaucgucuucagauugguuaguauuuuuacauuuuuuaaaccucauuugugcucuagauuggaucacauuguccucuaguuaucuccauguaggagucuaucagauaucuuuaacucaacaugucuacaaccaaaguuaucuucuccuuguccuacacagcguggccaugcuccauauuccuuauuuuuauuauuugcagcaucacuguucauccuugauccaaucuggaaacucgagucggccuugauucuucccacuuucucuuucccaguccagucagccgcuaaguucuguugagucuacaucucagugacuuuuucagcuaccucuucugccacugucuuacaguaagccuucaucauaucuucauuggcuucuguuuccuuacaauugacccuacugcuucgcagcuuugaaaccucugauggguccccauuaucuguacugcaugaccuacaaagacuuugauaaucucuccagcuucauaucuugcuauacaaaaauacuugugcuacucagaguuccacagauuugucauccucauucacagguacaugcaguugccacacccaagaugcccaucaaccuuuucuuuaccugucaaguacuuuuuuaaaaagacccaaacaugggcugggugcgguggcucacgccuguaaucccagcacuuugggaggcugaggugggcagaucucuugaggucggaaguucgagaccagccuggccaacauggggaaacucuguuucuacuaaaaauacaaaaauuagccggguaugauggcgggcgccuguaaucccagcuacuugggaggcugaggcaggagaaucgcuuaaacccgggaggcggagguuucagugagccgagaucgugccacuguacucuagccugggcaacagagcgagacucugucucaaaaaaaaauaauaaaaaauaaaaauaaauaaaaagacccaaacagaauaucacuuuauggagcccuccucuuccccugaaacccucaauaacuaacauuuguucauagcucuuuuauaagaauaaauauauuucuucauuacaagacuuugaguuuaagagcagaaauugucuuacuuaucuuuguauuuccaccaccuggcauggcaguugguacauaauaggcugucaguaaaugugcuuuguuuuuuuguuuguuuguuuuauuuuugagauggucugcugcccaggcuggagugcaguggcucgaucucagcucacugcaaccucugccuccuggguucaagugauucuucugccucagccucccaaguagcugggauuacaggcacacaccaccaugcuggcuaauauuuguauuuuuaauagagaugagguuucacuauguuggccaagcuggucucgaacuccuaaccuuagaugauuggcccgccuuggccucccaaagugcugggaucacaggugugagccacugugcccagccaguaaagguacuuugaaggaaugaauaaagaacuauaaugagaucuauuaagauuuaaaaacuucucuugcuucugcucccuuuuggugucaccuccuuuuucuauauuuucuuuucacuuuuuaccuaauagcaaaaguguuccucuuuccaaggcagcauuagcaauacauugggauaccagugaaguggauuacuaaaauuuggaaauaaacaaaauuacauuacuuucugaaauguaguagauaugauucugcuaauuaugucuacuucacauaauagauaugauuagucauccuugguuacguaaaccaaaauauuguauaugaauuugaaccugaaguauuuuggaguaccuacaaaucuaaugaaggugauuaucaccuugugagagaaggacugacgcaugauuguaauaaaguaaguggaaacuuaaggaaugguauuauagccuauuuacggagauuuuugcgaacauagcaggguggagaguuguccuagagcauggaaagggaaagcucaaagaacaagaugaaguauuauuucaacuucauuuagggaggcuugacauggcacaaauauuugugucacuuagagaguuguacacuaaaugaaugaacccauacaauuauucaucucuuuguuucaaucccguguucacuaagcaacaugauuuuacaugauuaauuuggcuuuccauguguucugauacuggaaacaagauauccucaaugggacauguaauguucaggucacuagauacauguaaccccagcuguaagucaguugccauucuggcaugugugcuuuaaucucuucugaauuugauuagcaucaguuauccuaugugagucuaaucaauuuuguuaacauuggaaagacugggcuguggguaaaaguuaccaaguuaauacucuccucugaggcuucuuuaguaaacaacuaucuggcuuuccuaaagacacucuaaucuuauggucuuuuucaaacuauaaugaggagcuucuauuauuauuauuuuuuuuuuuuugagauggaguuuugcucuuguugcccaggcuggagugcaguggcaucgcaaucucggcucacugcaaccuccgccucucggguucaagcgauucuccugccucagccucccaaguagaugggauuacaggcaugugccaccaugccuggcuaauuuuuuguauuuuuaguagagacgggguuucuccauguucgucaggcuggucuugaacucccgaccucaggugauccaccugccuuggccucccgaagugcugggauuacaggugugagccaccacgcccagcccuauuuucaaauacuuauuucaucaacuacugcaagauucuuacuauccugcaauggaaaacaggaaaaauuaugagcauccaagcauuuuaaaauagaguauuuuaaaucauuuaaaaauuauagcagcuuuauuuuuccuuuuuaagauuacauuucaaguuucugaaucuaguccuaaagguaauuuucucauaugaaugguacauggugauuauaucaacugggcuguagaaaaugggcacugauuucucaacuguguugauucuagauugguaagugacaugcuccaaguauaguugacugcauuucugaucuugcuuuguuuuuaugggaauuaaacucagaauagcccuucuuaauaggucuuuucaaaaauuugguagaagagaaguugguguguuaaucaacauaagauuuuagaaugcauuucuauuucaauuuucucuccuacuaauccuguuacugugguuaauaaucaauguguaaauagugaauaucuguucuuuacucuguaccagguaagacaaauauauauggacucugcuuuugaaguacuuagaauuuaguuuagcaaucaauccuuuauugauaauuuguggauaaguacuuugcaguaguuuguaaauuucagacuucagaugguuuggcaaaauaguggugggaaauuauaucauaaaaccucauuauuaauuugacuguaaugauauaauucagacauacuuaggggccuaaugaguauccuuaagacuacuuacauaucuuaaagacugauaaauagucugcaaguuaaguauuuauacuguuacuccucaguguuuuaaauucagcuaguuuuggcuucuuaguuuccccgcuggguuuuuuguuuuguuuuuuguuuuuuuuuuuucugauuuagcuuauguuucauuguuuaggagauuuuguuucuguaagcaguccugagggcaauuuuaaaauauccaaguuccaagaauuagaagaucucuuuuuguuggcagcuggaacaggcuucacaccaaugguuaaaauacugaauuaugcuuugacugauauacccagucucagguauguaauuuugucucuaauuacgauccuuuuugaggcuguuauauuaguauaagguauucuaaauugauuacucacuggaccuuaauagacauguuaccauuuccucauucaucauuucuuacuuugccuccucuaauccuagcuauuuuauuaacuagguucuuuuaucucauuucaguuuuugaugauuuuuaguuaccuacugggcacuaaaacauucacacugguucacuuuagacuuuccauuugugcauauuuuaaauguaauuaauuaguuauuucugaguuuuuuuuuuucucuuaaggaaagugaagcugauguucuucaauaaaacagaagaugauauaauuuggagaagccaauuggagaaauuagcauuuaaagauaaaagguauuaaacugauauuagcucugcguuuaguuauuuauaccuggguaguaagucuaugccuuaucuucucugguugaagcuuugauuguccaggaagcuccuucaaagaaaaaaaauaaaccaauaauucucuaacuagaaaucauguuaaauguuccccuucccucaaagaaacacugucuggcaagaucuaggcaaccuuauauaugugucacuaagaugcauauugggcuuuaugaucauguuaugugauuuauacugaguuggguuucacugaaaauguuccaauguagccaguuugguaaugcaagauuuuuccuguuauacuggggcugauaaaauaagcauuuggugagaauggauuaagcaaaauuaaacaugauaugggauuucuaaagccuuuaauauguuaguauccuuugugacuuuccaagagaggaauuuuuuaugcauugcuuagcaaaauuccuuuuauguuuguuuguuugcauuaacacuucuucgcucuuucacuagugauccuugguacacacuuugggaagugcugguacagauaauagaaaaaaguucuagucaagcugaacucaguaguggaaugggacagaaaggauaacaaaagugaaaacuuauuuuauugauuaaagagcucagcccaguaaacuaaaauaagaagauaauuuaacugaauauaugcuccauuuccccuaaaaagauuugaaagcaguaggaaguucagaacaaucuuuucacaaaaagugaauucaauaaguuaucauacuuucuaaagcauuucuauaaucauuaaaagcuauuucuaagaauuuuagggcuuuauaaauuacacaaaagaucugaaguaaauauguauguauaugaaaggaugguauacauaaaauucuaggccuuuuaaaagaguaaagcccuuagaacuuuguuagcuguccaggggcucgagguucuucugaauauuuucugaauguccauaauaagaaaaugcuguggucuuuucccauuuuucccucccugcugucucccaucauccuccacuuugucuuuuaauaaaugacuuucaaaauuaaggaugacaccugaauuuauuuauccuugaaguauuuacuauucuuuacauacuaaaaacauagaccuaagaacauuuauuauaaguaguuguguggcauuuuagagaauuauuuaaagaaguucaaguucuuaguuuuucaaguauuuuuuaacacauuuucaaaguggaaaauuggaagcguuuaucaagaagccuaaagaccuaaauuccaguugccauucugcuccucaccagcaugaaacuuuauucacaaauuacuuaccucugggggccucuuuaucuucaaaagaaaauaaugcugucuuuucuacuucauaaaguauugugagcuuuggagaagauaacguaaaugcuuuggaaccugugaagcccucccucagacauuugaauugugguuauagaggaccccuauguacauguuuguuuucugucuucaccguuagagcuucuguuuuuguaaguaaauguuuaaaagaauuuaaacuggucgauuccugggcaagauagccaaauaggaacagcuccggucugcagcucccagcgagaccaacacggaaggccggugauuucugcauuuccaacugagauaccugguucaucucauugggacugauuauacagugggugcaguccauggagggcgagcagaagcauggugggguguugucucacccgggaagcucaagugguuggcacuagccaagggaagccaugagggacugugccaugagugacugugcuauccagcccagauacuacgcuuuuuccacagucuuugcaaccugcagaccaggagauucccuugggugccuacaccaccagggcccuggguuucaagcacaaacuuggguggccauuugggcagacaccaagcuagcugcaggaguuuuuuuuuguaccccaguggcgccuggaacaccagagagacagaaccauucacuccccuggaaagggggcugaagccagggagccagguggucuugcucagcggaucccaccccaacggagcccagcaagcuaaaauccacuggcuugaaauucucgcugcaagcacagcaguuugaaguugaugggggacacuugagccugguggggggaggggcguccaccauuacugaggcuugaguaggugguuuuccacucacaguguaaaaaaagccacugggaaguucggacuaagcagagcccaccacagcaccgaaaagccaugauagccagacugccucucuagauuccuccucucugcagggcaccucugaaagaaaggcagcagccccaaucagaggcuuauagauaaaauucccaucucccugggacagagugccugggggaaggggcagcuaugggcacagcuucagcagacuuaaauauuccugcuugcuggcucugaagagagcaguggaucucccagcacagugcucgagcucugcuaagugaccgacugccuccucaagugggucccugacaccugagccuccugacggggagacaccccccagcaggggucaacagacaccucauacaggagagcucuggcuggcauuuggugggugcccucugggaugaagcuuccagaggaaggaacaggcagcaaucuuugcuguucugcagccucugcuggugauacccaggaaaacagggucuagaguggacucccggcaaacuccagcagacuugcagcagaggggccugacuguuauaagguaaacuaacaaacagaaagcaauagcaucaacaucaaaaaaaaaaggaugaccaagcaaacacuccauccaaaggucaccaacagcaaagaccaaagguagauaaauccacgaaguugaggaaaaaccuaugcaaaaaggcugaaaaugccaacaaccagaaugccucuucuccuccaaaggaucacaacuccucacuagcaagggaacauaacuggauggauaaugaauuugacaaauugacagaaguaggcuucagaagguggguaauaacaaauuccugaaggagcauguucuaacccagugcaaggaagcuaagaaccuugacagaaggcuagaggaguaucuaacuagaauaaccaguuuggagaagaacauaaaagaccugauggaacugaaaaacagcacgagaacaucaugaagcauacacaaguauccauagccaaaucgaucaagcggaagaaaggauaucagagauugaagaccaacucaaugaaauaaagugagaagacaagauuagagaaaaaagaaugaaaaggaaugaacaaagccuccaagaaauaugggacuacauuugguguaccugaaagugacagagagaauggaaccaaguuggaaaauacacuuccggauacuauccaagagaacuuccccaaccuagcaacacaggccaacauucaacuucaggaaauacagagaacaccacaaagauacuucuugagaagagcaaccccaggacauaaucgucagauucaccaagguugaaaugaaggaaaaaaauguuaagggcagccagagaggaaggucagguuacccacaaagggaagcccaucagacuaacaggggaucucucugcagaaacccuacaaaccagaagagauugggggccaauauucuacauucuuaaagaaaagaguuuuuaauccagaauuucauauccagccaaauuaagcuucauaagcaaaggagaaauaaaauccuuuaaagacaagcaaaugcugagggauuucgucaccaccaggccugccuuacaagaguuccugaaggaaguacuaaauaugaaaaagaaaaacugguaccagccacugcagaaacauagcagaauguaaagaccauugaaacuaugaagaaaaugcaucaacuaauaggcaaaauaaccagcuagcaucauaaugacaggaucaaauucacacauaacuauauuaaccuuaaauguaaacgggcuaaaugccccagugaaaagguacagucuggcaaauuggauaaagagucaagacccaucagugugccguguucaggagacccaucucauguacaaagacacacauaggcucaaaauaaagagauggaggaagauuuaccaagccaauggaaagcaaaaaaaaaagcaggaguugcaauccuaguuuccgauaaaacagacuuuaaaccaacaaagaucaaaaaagacaagggcauuacauaaugcuaaagggauuaacaagaagagcuaacuguccuaaauauauaugcacccaauacaggagcacccagauucauaaagcaaguucuuagagaccuacgaagagacacuuucacacaauaauagugggagacuuuaacacccuacugucaauauuagacagaucaaugagacagaaaauuaauaaggauauucaggacuugaacucagcucugcaccaagcagaccuaauagacaucuauggaacucuucaccccaaaucaacaggauauacauucuucacagcaccacauagcacuuauucuaaaaucgaccacauaauuggaaguaaaacacuccucagcaaaugcaaaggaacagaaaucauaacggucucccagaccacagugcaaucaaauuagaacucaggauuaagaaacucacucaaaaccgcacaacuacguggaaacugaacaaccugcucuugaaugacuacugcagaaauaacgaaauuaaggcagaaauaaauaaguucuuugaaaccaaugagaacaaagacacaacguaccagaaucucugggacacagcuaaagcaguguauagagggaaauuuauaucacaaaaugccuacaggagaaagcgggaaagaucuaaaaucgacacccuaacaucacaaugagaagaacuagagaagcaacagcaaacaaauucaaaagcuagcagaagacaagaaauaacuaagaucagagaaaaauguaaggagauagagacaugaaaaacccuucaaaaaaucaaugacuccaggagcugguauuuugaaaagaauaacagaauggauagaccgcuagucagacuaauaaagaagaaaagagagaagaaucaaauagauacaauaaaaaaugauaaaggggagaucaccacugaucccacagaaauacagacuaccaucagauaauacuauaaacaacuccacacaaauaaaguagaagaucuagaagaaguggauaaauuccuggacacauacacccucccaagacuaaaccaggaagaagcugaauccuugaauagacccaguaacaaguucugaaacugagguaguaauuaauagccuaccaaacaaaaaaagcucaggaccagauggauuuacagcugaauucuaccagagauacaaagaggagcugguaccauuccuucugaaacuauuccaaacaguagaaaaagagggaauccucccuaacucauuuuaugaggccagcaucauucugauaccaaaaccuggcagagaugcaacaaaaaaagaaaauuucaggccaauaucccugaugaacaucgaugcaaaaauccucaauaaaauacuugcaaacugaauccagcagcacauuaaaaagcuuuuccaccacgaucaagugggcuuuaucccugggaugcaaggcugauucaacauacacaaaucaauaaacguauugcaucacauaaacagaacugaugacaaaaaccacgugaugaucucaauagaugcagaaaaggccuucaauaaaauucaacaccccuucaugcuaaaaacacucaaacuagguauugauggaacauaucuuaaaguaauaagagcaguuuaugacaaacccacaucugauaucaugcugaaugggcaaaagcuggaagcauucccuuugaaaacuggcacaagacaaggauauccccucucaccacuccuauucaacauaguauugcaaguucuggccagggcagucagguaagggaaagaaagaaaggguauucagauaggaaaagaggaagucaaauuaucucuguuuccagaugacaugauuguauauuuagaaagccccaucaucucagcccaaaaacucuuuaagcugauaagcaacuucagcaaagucucaggauacaaaaucaaugugcaaaagucacaagcauuccuauacaccaauaauagagagcgaaaucaugagugaacucccauucacaaaugcuacaaagagaauaaaauaccuaggaauccaacuuacaagagaugugaaggacgucuucaaggagaacugcaaaccacuacuccaggaaauaggacacaaacaaauggaaaaacauuccaugcugauggauaggaagaaucaauaugaaaauggccauacugcccaaaguaauuuauagauuuaaugccauccccaucaagcuaccauugacuuucuucacagaauuagaaaaaaacuauuuuaaauuucauauggaaccaaaaaagagcucguauagccaagacaauccuaagcaaaaagaacaaagcuggaggcaucacgcuaccugacuucaaacuauacugcaaggccacaguaaccaaaacggcaugguacugguaccaaaacagauauauagacuaguggaacagaauacaggucucagaaauaaugccacacauuuacaaccaucugaucuuccacaaaccugacaaaaacaagcaauagggaaaggauucccuauuuaauaaaugguguugggaaaagucacuagccauaugcacaaaacuaaaacuggacccuuccuuacaccuuaugcaaaaauuaagauggacuaaagauuuaaacauaaaaucuaaaaccauaaaaacccuagaagaaaacuuaggcaguaccauucaggacacaggcaugggcaaagacuucaugacuaaaacuccaaaagcaauugcaacaaaagcuaaaauugacaaaugggcucuaauuaagagcuucuguauagcaaaauaaauuaucgucagagugaacaggcaaccuacagaaugggagaaaauguuugcaaucuauccaucugacaaagggcuaauauccagaaucuacaaggagcuuaaacaaauuuacaaggaaaaaaaucccaucagaaagugugggcaaaggauaucaacagacacuuuccaauagaagacauuuaugcagccaacaaacauacuggucauuagagaaaugcaagucaaaaccacaaugagauaccaucucacaucauuaggauggcgaucauuuaaaaagucaggaaacaacaugcuggagaggguguggagaaauaggaacacuuuuacacuguuggcaggagugcaaauuaguucaacccuuguggaagacaguguggugauuucuuaaggauuuagaaccagaaauaccauuugacccagcaaucccauuacuggguauauacccaaagcaugauaaaucauucuacuguaaagauacaugcacauguauguuuauugcagcacuauucacaauagcaaagacuuggaaccaaccuaaauguccaucaaugauagacuggauaaagaaaauguggcacauuacaccauggaauacuaugcagccauaaaaaaggaugaguucauguccuuugcagggacacggaugaagcuggaaaccaucauucucagcaaacuaacacagaaacaaaaccaaauaccgcauguucuuacucauaagugggaguugaacaaugagaacauaugggcacaggaaggggaacaucacacaacagggccugucacagggugggggccaaagggagggauagaauuaggagaaauaccuaauguagaugacagguugaugggugcagcaaaccaccaugcacauguauaccuauguaaccugcacguucuacacauguaucccagaacuuaaaguauaauaauuuuuuuaaaaaguaaacagacauagguaggcuuaagauuguuuuuuagaaaaguauuucugaugguuuuuuggcuaagguauucuuuuagauaguuaccuuauaaaagcaauuuuguaaaauuuuauuuuuuuaggaauagacauuguacuuuugacuucaacuugauuuauaaauuaauuguuaaggaaaguguugacagucucugaacauaaaguaucuuuuaauagagucaacuguguuuuuucuuucguuuugaucuacauaauuuggguuggugagguugcauaggcuggaguuuugaggaugaggaaaggccccuuuuuuuuucaugucuggaugccuggcucuaacagcacucaucaggugagugguacucuccagcuugcugacggaagugauaguguuccaaccucuggccugccuuuauccucccucugcuguuccuucucuuucucuucuugcucucccuugcuggcuugggugugcucuuucucucuccucccuaaccucuuucuggagacuuuguuguccuugcuugaggcacugacuccuaguauuguguaauuuaugauccccauagacuccuggcguuuugggcuuuuuuuuuuuuuuuuuagugaggucaggucaagcccuagcuagaaaacaaaaugaccaugccuguguauauggcuuuggaagauuuagcaggaauuuuaccauauucugaggcuugauguaaaacauaggagaacccuggccuuaaaggcuuauugauugcauuugcuaguacuauucagccaaaacauaauuauugugucccauacaaaaaaggaaaguaaaaguuaagauuuaaguugagaugauuuuaauuagucacaguuguauuuuaguuagcauuuaaggaucuucauuuucuaauauaguaaaucaucacucuuuaccauaucuugacccucucuauaucacuuucaguuuuaguaguaaaguuccugaugccaaaauauguuacuggaacacauuucugugguuaaauuauuauugaauuguaaauauuaaaaaacaaauuuuguaguuaagagaaauacccuacugucuauauaauuaggucccagucuucuacuccauccuuuguggaacaaggagagggauaggaauuauggauucugaggcugacauaugaucgaauauuuucagcaagugugcuaugcuuguccgcagaguuuaucuagagaauaucauuagcaaauggaauucuucaaaauaaaauuguauaauggaaaguuauuaaucucuuggccuugggcaaauuacuuuaucuggcugagcuucaguuuuuccaucuauaaaacaaacauuaauaccuacaccacagaaucauuuggacaugggaaucaaugaguuagcauauguagguuccuagcccagaauuaguauguuuguagcagacauucauucauucauucguaaaauauguguaacaucuauuauguaccuguacacauggauccaacagugacacgauauuguguuuacuuauuuucucaugcagcccaaggaaugaaucucuucauuuucccuaauuacugcccucaggagaauugcaaaaauauagauacuucaugaauaauuuuuagaauacuacucuuucuauuucaaucugauuuucaugucauuaaguaugaaaucugaacagaaaaaaaaauguguacccaaauuuuauccaaauguguuauuaaacuugacuguucuagcaauugggauucaauucaccacauuccaagucuagcaaaaucuuauccuuuuuuucuuacgaaaaaugagacaaaacauaaggcaaauaugugcaguaguggauuuaacuaauuauguaaacugaaauccaaacuaaauuccacuuauccuucucccaaauaugugaucaguguaugaggcucaguucauucaguacacauuggcccaccugcucccaucagcagaaugcccuagcucugugaugucucugcuuuuguagaaugaguuuuguggggugggacaggugguacaguuugacaaugagguugacuucuagaaaacauuuugugguauauaaauauaacagguauuuuccuuuuguuucaaaugagucguucuuggagaccauuaaucuuauuuuaguaaagguagugguacauuuuuuuauaaacagcauuuguugauuuucccuucuuuuuauaaaauuaauacauguuuauauagaaaagguauaagaaaaaaaucacccauaauccuaccacccaaagaacaauuauuaacauuauggucuguaucuuucuauucauaugcauaccuaccuuuuuguuuuguauauuuaaaauaauguagucauacuaacuauaauuuuuauaacuacauuucuacucauuguauuguguguuuuuuacauaaagaauauuuucaacaggugguuuucaaccuuaagcaacucugccaccccagaaacauuuauuaucacaacuaggggaagacguguuacaccuagucaguagaggccaggauugcuacaaaauaucuuacaauucacaggagagccccccuacaacaaagaauuauccagcccaaaaugccaguugugccaguuaguaaauccugcaguauaccaugauuuuuaauaacugcauuguguucagucaugugagcauaccauaauuuaguuaaccaauucucuguuauuugacauagugacuagaaauuguucaauaccucucuaacuauucaggauaaagaagaauuauuaggucaaacuguuuuaaggcucuugauaccuauacuuuaaguucugggauacaugugcagaacauacagguuuguuacauagguauacguguaccauggugguuugcagcacccaucaacccauuaucuacauuagguauuucuccuaauucaucccuccccugccccuccaccgcccaacaggccucaguguggaacguuccccucccuguguccauguguucuuauuguucaacucccacuuaugagugagaacaugcaguguuugguuuucuguuucuguguuaguuugcugagaaugaugguuuccagcuucauccaugucccugcaaaggacaugaacucauccuuuuuuauggcugcauaguauucccugguguaaugugccacauuuucuuuauccagucuaacauugauggacauuuagguugguuccaagucuuugcuauugugaauagugcugcaauaaacauacaugugcaugugucuuuauaguagaaugacuuauaauccuuugaguauauacccaguaaugggauugcugggucaaauggucuuucugguucuagauccuugaggaaucgccacacuguuuucuacgaugguugaacuaauuugcacuccugccaacaguguaaaaguguuccuguuucuccacguccucuccagcaucuguuacauuuugacaaaugccucugacaaugaaaacacuuagcagagaauacuauacccagccuacauugucauuguugaugacauuaacacugacagugucauuaacagugauguuguuagugucauuauuuuuacacuagaguggauugggagguuaguuggggcaaaagagagaggggaaauaaagggauucuaagcagcauggaaaugggucacaaaggaaacgggacuauuuacccacuuauaugcaccaauagaagauagaagacaauuuacaucacuuuaaagauuugugugcucacucccugcaaaaugugcuugacauuacaaaaagauaagaaaucaguaagacuacccuagugguggugaaguucuaaaguacauaagugacuguaaagucugugccuugagagaaacaaaaaacauaccauagauaucuagugaaaagaauuuuauuccauuuuugugagggugggaauaucagagcuucauggaagaaggggcuuuugagcugggcuuugggaaaugauuagcauuucuuggagcgggaaaauaaaucuggguaguaggauugcauaagacaugagggccaggauauucuaguguuuuaaugacagaguagaguuguuuuguugaaauaaauauugugcaugaaggagaaugaugcagaauaacuaaaaauaaacccauuaaaccuuauaucaguuuuagaaggaaucuuaauaguuaucauuucugaucuuuuuguuuacaauugaggaaacaagauaggcuaaaaucaggugcugaaagaccuugaauguaauuaauaugugaaguaaauauuauauaucagauagacauaggaagaaggcacagugacacucuguggcucaucucccuguagugcugacaggcucuguggacuauauguuuuugucuucugaugucaguauugggacuggcaauguggcaguuccauuuaaguuagcaaaagcugaugaugccagaagcagaaguaaauugaacaguauaccugaaacuguuucuuuuuccccagccucuuaugcugacagauaugcagcccacuaaucuggagccuuauagcacuuucgguuucuuccaggagauguuccucagauguuguguugcucagaauguguucuuugaaauguuaauguguuccccggaauggacucugugauugaauaaauuugggaaacaguauaugccuuccugaagauuuacucugaacuuagcauauauaaggcuuucugaaauucuacggaaauauauuuaacuuuuuuuaacccaguaugucacagacuuauuugauaguuagccugcuuucauggaauaacuacuaacaucuggaggcauacuaguguuucauuagauucauuuuaagaaauguuuccauauaauuauggaaacauauauaauuauauauauuuuaucuaauuuugauuccuaguuuugugagauuuuuuuccuuugagcacauagcaauuuuuacuacaguugcaggcauuuucuuuagcuagaaaaaaaacaaaaaacaaaaaaaacaaaagcaggaaaagcuggggccccaaguacucugaaauaccaaucugugggcagugaggaaucacugaagcuuuuaagcaaaaaaguuguaaaguuguaucagaguuuuuaggggaacuaauauggcaaugguauaucaaauagauuaagggcuaaggcuguuaauguaauauuuuagaugagauauaagaaccugaucuggaguugugacaguaaaaaugggaagguaagggacuuugugugagaaaaugaaggaggcaaguugcugaagcugauuggcuagaggaggagggaauaagucguuggaugacugcuaaugauuuagacuaaaugaauacauuuguauuucaagacuugucaucucagaucacuaucagccuacuuuaaaauaaaauuuuugacaagcuuacuuagauugacguuugagaucacauaggcacucaucagaagcaggucuguucucuuccucuuucauauuacuuuguauuuuauggguuaucugaauuuauuuucagguaaccuuuucaagggucccaaccccuucuggcacuuuugaaauuauaaaagaauuucaggauguuuacugugugccccccacaugucuccagcaucucaaagcuguaauuuuuuagacaguaaguuaaccuucauucagaaaacccaggagagaguauuccacaggaauugucuauauuuugauauaaaaaaucuuucauuaaagaauuauugagucuuaacuugggaaugcuccuguuccaguuuaagcucuuuucucagcguaugaaaaggagauaagcaggauaacagccucuuuagaauauccuuaaauugcagccagagauuaaaaugcaugugucacugguaauugcuauuuacugugauuuauaccagcauauuauuauuguuuauuuuggguucaggggguacaugugcagguuugcuugaaggguauauugcgugaugcugaaauuuggauuucuauugaucuugucaccuagacaaugaacauaguacacacuaggaggguuuucagcccuugccccuuucccuacaccucccuccuuuuggagcccccagugucuauuguucucaucuuuauguucuuauguacacaggguuuagcuccacucauaagugagaacaugcaauauuuguucuuuuuuuucaauacuaguagauuauuaauagaaauguagcguucucugagaucccuugggaucuuuauuucauuuauauauuuauuuuuaauuaauuucuuuuuuaagagacagguucuugcucuguugccuaggcuggugcaaucauaucucacuggaucaaacgauccuccugccucagcuucccaaauagcuaggaccacaggcacaugccaccacaccuggcuaaguuuaaacaguuuuuuuuguuguuguuguuuuuggguuuuuuuuuuuguagaaacuaggucucacuguguugcccaggcuggucucaaacuccuguucucaaacaauccucccaccuuggccucccaagaugcuaggguuacaggugugagcuaccaugcuuggauaauuaguucaauuuaaaaaaaaaugccaaauuacauuccuuaucuauaggaaaagcuaauccuuaguaaauauagauuuaccuauacguuuuuguuaaaucuuacaauuuuuuucaguguuuuucuagcaaguaaguguaucuuuauauauuaaauuguuccuuuaggggagaaauauauucuugaacuugaaacauguuaauaauauguuuaaaauaauaaacuuuaaaaagcuguuuuucuuuucccuagacuggauguugaauuuguucucucagcaccuauuucugaauggaauggcaaacagggacauauuucaccagcucuucuuucugaauuuuugaaaagaaauuuggacaaauccaaaguucucgucugcauuuguggaccagugccauuuacagaacaaggaguaaggugaguaacaguguaguaggaaacagacugcccaacacugaagugaagaucuuucauaacaagcaucucucaguucuuccuguuuauaugaaacugcacuuuaauaaucuuacaguuuuagaaaauaacaaagucuuuaaaucuucguauaguuugaguuggaggccaggauuaugcauauuguuagauaaaacauaaaaguaaguuacagccagcagucaguguucucugcucgugauggcugccaauauuguuacacucacaagauuggugccacaauucuuauuugggacauuaggcccaaccucuucuuccaucaaagcuucauaauauauaguaauuaauaaggaauguucaucucauuguagcuuuugaucuucauucucuguaacugagugaaaguaaauaauauaugugaucaaaagccaagcagcaagacaaaaagggaagacuagaacacaaauaaggcaagacuaauaguugaagcauggaucaugaaaaaucagugguaguggcgauccuguuugaaauucaucuugaugugauuuagcuuuaaaauggcacuuuaaaauauuugguuaaauauagccccuauuggauuucuagauaauuuuaaaauauggcuguucuaagugcccuauucuuauuuaguaggugacuaaccuaacauuucuagauguugaugaaaaaagucaaacucuguaaaaucuuugaagagauuuauucugagccaaauauagugaccguggccugugacacagcccucaggagguccugagaacaugugcccaagguggucggggcauagcuugguuugauacauuuuagggaggcaugagacaucaaucaaauacauuuaagaaauacauuaguuugguccagaaaggcaggacaacucaaagcuggauuggggggggcacggguuuccaggcucuagguaaguuuaaacauuuaaacauuuucugguugacaauugguugaguuugucuaaagaccugagauccacagaaagggaauguucagguuaagauaaaagauuguggagaccaagguucuuuugaagucuuacaguggcugcccuuagagauaauagaugacaauguuuccuguucagaccuuuaaaagguacuagacucuuaguuaaccucuucaggauuggacuggccuggaagaagaagaucuagcuauguuaauaggauucuuuacagaugcaaauuuucccccacaaaggacagauuugcagggccauuucaagacauggcaaagaaacauguuuugggguaaaacauuuuuauuuucuuccuugucucguaauguuaugccagagucagguuggaaaguaagucacgauauaugggguuaaauaaaacccaucugaugagaauuuaugguuuguagggcaugacuucccagaccccuuagauaggaauuugggcaagauaaaaaaaaaaaaaaaaucagaguuuaguccucauagauaaucuuauaucuugcuuuuuuauuuaaaauuuuaauuguagaaaagauugaccccccaaucaauaaaaacauuaaaaacuuuuuucuugucauauuuaaaauguauuuuauuuuuaauuaaauauauuucuauuuuaaugcuuuaagaaaaauguuguuuuaguuaaacucucucaacuuaaaaagauuuuucaaguuucuguguaaacuuuugcucuuuuaaagcucaagcaaaacuauuaaaauuacaaugaagacuaacauaguuugaauauaaaaaauuuuuuaugaaaaaaggcuaagagcuguacugucuucugcuguauugcuucugcuauuuuagaaguaucucaaugaguacuuuacagauugcaauauaauaauacuuuuaaauaauuagaaucauuuuugcauuuuuaaaauugaccauaaacuuagggaggccaaggcagguggaucaccugaggucaggaguucgagaccagccuggccaacauggugaaaccccaucucuacuaaaaauacaaaaauuagccgagcaugguggugggcaccugugaucccagcuacuugggaggcugaggcaggaggaucgcucgaaucuaggaggcggagguuggcaaugagccaggaucgcgccauugcacuccagccugggcaacaagagcgaaacucugucucaaaaaaaaaaaaaaaaaaaaaaaauugaccagaaccuauauggcuuucuuuucucaguuuuaccucagagccaaucuuucaaugcugugcuaacuggcuuacccagaguugcucaggaguauuuauuaaucauuacauguggauuccugcuauuacucacuccugaacaugcugcauagaguugcauucugagauguaacuugauucaaauuaguacuuaaaauucauaguagcugcccuugugacucucaguuaggacucauuucuuugguuuccuuauccucaucaucuuaauggaugugguguauuuuucuugauuagcaauuauauggguuucuuauuauaguuuuugcuguucugaaaaaugagucuuucuugugauugugauguccacuccuagagugcugcaaaguuaaucucaugucugcuacauagauuauauuaaaaauauagccaucccagacauauucuccauauuuggugaacauuugucagucuguaugguaugauaacagagaaagacucagaaaccuauuuuuuaaaaaauacagauaagcagcuuaucauuacuuggccaauaaugguucuuuauccauuaaauauguacuuuauuacagagguuaguaaaacagucucugcuuuccaggaccacacuaucuagugguagaaacaaaugcacgugcugauaaccaaaguaugacucagaacaccacaaauaucuuacuagagauaaaaucaagauguuacaggaauuccgggagagauggguuacuuuuaccuagcgauguguguguuggagagacaggagcugcauggucaaaaaagucaugugcacagcauguggacuaaaaccuaccagucaagagagauggagaaggggauaguacaggcagggagaacuggcagaugcauuaggggugcagauuuauacaaaagacuagacugguuuggcuagagugaagcugcuugccugggagaacaggauggaaugguagcaugggcccagauacugagaggcuuuacugcugcacuguguuggcuucaacuccugugcccuacuggcccuuugugugaguauguguaugcccucugggagcugccagcugggguuuaaaucccaggucuaccacuuacaagcaucuuacaaucauuugcuggguguccuagggcaguucuuaacccuucuaagcuuuagugcacuuaucuauaaaaaugaauaaauaauaauaccuaugcaugugaagugcauagcaaagugacauuuauaauagaguaagugguaaaaaaguaguuauuauacuauuuuccuaguugaacaauacgcaguauuucugcuuuuccuguucaguagggggagaaugaagauagaaucguaggggaaucaacuccuuucuuugaaaacuggugaauaaaggggaaaaaaaucaaacauuuauucucccuuuguuauaugagccauacuacugaauaaucacauaauaaaugagcagacauuuuucuuuauaggauuccucagcugauuaaugaauaaagaaugauagaaguagaauaucaccaauugcagugcuuaaugaacuaauggaucuauacauagaucauaaugguagcuagcacucaaaaagagaggcaaccauuuauuacaugccuccagauagaggaacauuaccugugaaauagucuugucaaaaagauuugaaccugugucugaucaagccucuagauccauauauuaaguuauggaaaauaugaggacauaaagacauauuauuaaggaauaccacagggauguagaaaaaugaagguuuuaggagacucaacaaauaaaaaucugauuuuugucaacaaauaaauugcaggauggagugggggucugggggaucuuacagaucaaaggaugccuaaaagacuuaucagccaaucauaaugaguaaauuuuaauuggcuauugauugaaacuauuuuuuaaaauuaugacauuuaugagcuaguugaaaauuugagcacugcuuagauauuucaugauauuuaggaguuacuaaucacuaauuuuuuaagaggugauaguguuuuuuuauuuaaaaaaaacuacauagugaauggggaaaaugaaaaaguaucaugauuauggugguaaacugcucuuauuucuucauuuuaaagcauuuucccuaagaaacaugugcuuuuuauuuguuuuucagguugcugcaugaucucaacuuuuccaaaaaugagauccauaguuuuacagcauaaugaagagcugucauuguccuuuauucaacuaguuuaucuaaauuugugauugcuuaggguuuuuuaagagaacauuuuuguacauaacaaaagguuaacuagaauccagccuucaguuucuuaaaugaaaucaaauguuccuucaguacagguaacuucuuggcuuucuuuuguaccacaacuuauuuuacuacugauauuugaccuggaaaguuaaucauggcaacaaauacauacaggauucuuuguuaugaaucacaaauuuccuugccauuuaaauuauaucacuguucuacaauaagcacuuguguuuuaugacaugauaaaguaaaugaucacuucgaucauguuucuaugcuguaaaaugucuuauuagcaauacagauuaaauuuuaccuugcacuguuaacucaggaaaugaucauuuauguccuuguuauuaauguuaaaacauagaauguuauaacuuauuaagugauccaaacauuuuuuuguguguguauggcauugaugcagaauagaauaaaauuauacuuaaguucuuu

SEQ ID NO: 13900 - RNA, 1239 nt, Homo sapiens
uccccgguccgcgaccgcgaccgcgaccccgacccccacgggccgccuaagcggagacucuggaaacgccuggggcggguaccggguggucuccgcguccuucccuuucaacuguuacgucgauguggacuucagucacccguacaaagcugggcuggccaacccagguccucgagaggggagguuggguguccccggccgaguuugguaaccaggcagcggggaggcuggcaggggauucuagaaggcgccugagaacugcgcgccaaccgcaccgcccccuugaaggucggggcccuaucuccgggaauggugacaacguucgcuguacggacagccugugccccugaaugugaauguccacacuugcuauuuggggggucgcggcaucuguaggaagugaagacgggacggcgauaggaacacacgcacaggcgcaucacuagggucagaacugggccaacuccgggcgucuacuuugaagcgggcacgcccaggccacgccugcaaacggcgucagcuuccucugaucaaccgcggucagcgccauccaccgaccaccacuaagccuauccaccggggcagaaaagaugacugguuccuauucguuaaaacuguugauuguuccuaaauacauggauauauagcuuguacucagugaaaguuuccaucuauaagggccaacugaaauucagcauaaaacaagaauauuugaaaaccugcuacaucaaugcucaguauuaagggugaaaacguaaauuggacagucuuuuucacaagagguuuaaauucaguaaggaaaaaaggcagaaagcgugacucguagagacaacaggaacaauuuuagcauguugcaagaagaguaaaugcagugaauagucugguuuaacaagaaaauaacgcuucuguagaaggguguggugagagguaagcaacaaaggaugugaugaaagacaugaaagggccgagcugguuuugagcaugauuaaauagacaaguagccuuguaaauaugaacuuguggugccagaauaauugacuauccacauaggaaaaauuuuuuacccggcguuacacacaaaaauaaacucgaggugaagugcauauguaaauacgaaagcaaaauauuauacuuugauaagaaaauauauaaauauaucuuccuaacuuaggcuguuggaagaguuucauaaaacauuaaaaauaaaaauguuaauuaaaaauugacuauauaagaaaa

SEQ ID NO: 13901 - RNA, 24747 nt, Homo sapiens
cgcgccgggacugcauuucccauaggcccacgcugcggagcaccgcccacccgagucucacgcgagugcgcugccgcgaggugucccugccgcagcccccgcccgcccgcagagcuuuugaaaggcggcgggaggcggcgagcgccauggccaguccgggcugccugcugugcgugcugggccugcuacucugcggggcggcgagccucgagcugucuagaccccacggcgacaccgccaagaagcccaucaucgguaaggaggcugugcggggccgcagcagacggggaggagcuggguguuggcgcugggcgccucccgccgccgcgcuccagcuggcgcgucccgccgggaaaaacccccagaugugcuucgcuuuuggugcaaggaggaacccgggcugggcaccauuuaggucguacugaaauguaccugguugagguaccucguucauuccuuuagacucauaugacucuuaaaggugggagggaggagggugcaccaugaagaauccugcggauuuucuuuuuuuguacacagcuaggaauuucuacuaaaauaaaacauuuccuuuucgcacauaguugggaaguuuuacucauuuacaucuacaaauucuguacaugcauugcauucaucaaaauguauugauggcguauuuaaaauaccagugcauuguaauagaaaaucaagaaauuaagguauaacuuggauuuugucauguucaguagcagaggacaacaguggcugauauccuaaugugaguucuauuugguguuaaaaugcagcccacaauuuuucguuuccaacauauuuguguuuuaaagagguaguaaaaucagucuguguuaccaaaacacacauuugagacaggcccaaggaaagcuaccuaggagaaaucauccugggguuaaaauuugcccaaagaaauuuguguguggacauuaagauuaguuuuauuuuggcuguaggauuaugccuuucauacuauuuuuuucuaugaauauuaucacuguauucuguaacuaaacagaaaguagaugaauguuuuuucauauagguagugcccaguuuucaaauggguugcuuacuaauauuuggaacuuauuucauagcuguuuaacauggugauuugauucuccacgaauuaacucaagcuguaauuaauguaacagguugcauauuguguguccagagaagagaaaaaaaagcagaggggauucuuccccuuuccuagaaucagggguagcccugcgucaaauauuuaaaaaagggacuuugcuuuuggucacugagaucagcacaacaucguuaacugaguaccgacuauguacacaaucuugcucugggaagugcaaaggauugaaagaugacaagccacaaaaguugugagauggccuuaaauuauugguggaauuuuggucauauuuugagggacagggagaacagcuugagcucuuuucccagggaugggaaaagugaauaugcgugggcccaggggaaggggagauguugguggaacucacucugauguacuucucuuucugguacccuugugcucccaugaugccccaugucuccuuugugguaccucaccccauguacccuguaccacuccauuuccuaugacacuccuaguucuucguucccuagccaaacuuuguuauuccuuagugaagaugaucuuaccuaccaguaaggagaaaaaguuuuacugaacaaauuuuggcguuugacauguuaaucugaauaccugaugaaugccaauuguaagaagcugggaauacaaaagugaguaauacagacaacagcucuuccuaucagguggccuacagagacacugaaaguguuccaaaugcugaagugcugaauaggaguaggcacagguacucacccgacagacguguuuugauguauacugguugcuauacucugcuggggcuggguuucacugguaaaaggaggccagagagauggguggggcagagcauacgggucuuacagaguuuauuaaaguuuagggacccacugagguaguuaaacaaaguggugacaccugcuugcugaucuaucgcuaccugauguccuuuccuauugcuuucugcuuucacucaccuggcucuaauaauauggauuccuugcaacgugacaggcacaaaucugacuccuggccuuugcacuugcuauuccuuuguccuggauugcucuuuucccagauauaugaaugugguuuacucugucaccucucugaaguccuggcucaaaugucauguuuuaccuucucagggaggacuugccuggccaccguguugaagagacuguccuuuccuacauagaugggcucuccuuccccaccgucuuucucuccuuagugcuuacgaccagccaucacucuauauauuaugccuuuuugucuuguuuauuguuuguccucuuuccccucccugcuacacccucgaauuaaugcacacagggcaggggcuuuuguuugguucacucauagucauguguccccagcagcuaguuuguugccuggcaugagguaugauucaacaguauauauugaaugacuguaggaauaggaauggugauaugauccgauuugcuucuacauggggagcugcuuggagcuuggggggguuucuuaagaaaagauauaacaagaccuucuaagagucuauuaugauagugugguggggagaggguagauauugauagcuugggcuaagguaauguuggagagguguggauggaagauguuuucacuccuuugcuucguugucagggaaucagugugucugugaguaugugugggaaaggagugacagccuuguaaauuuaaggaucuauauucuuuagauggauucuaggucuacaguugugugaaggcugcaagugcuauuguaagccuucuuugggggcuuauuuggccucccuaaugaggugagagauagaucuacuugaaaguaagaucagccuccccugcugcuuucccauaggcuauggguggacuuggaggagagacuuccuauuuaauucuguggauugaaauaauaaaauaugauauuuuugcugugauauauuucaguuucugagcaagaagaaaaggaauuugcuugaaacuaaacuuuuuuuuguuauuaggaauauuaaugcaaaaaugccguaauaaagucaugaaaaacuauggaagauacuauauugcugcguccuauguaaaguacuuggagucugcaggugcgagaguuguaccaguaagguaugauucaguguuuuuuuuuuuuuuuuacucuguauaaaaaauugcugcguacgggugcggugccucaugccuguaauucuagcacuuugggaggccaaggcggguggacuacugaggucaggaguucgagaccagccaggccaaccuggugaagcccugucucuacuaaaaauacaaaaauuagcugggugcaguagugcacuccuguaaucccagcuacuggggaggcugaggcaggagaaucgcuugaaccagggagguggagguugcagugaguugagaucgcaccacugcacuccaguuugggcaacagaucgagacuccaucucaaaauaauaauuacugccuaauaucucuaaaauucgugcuuucucucuuaugauuacauuguuuaaaugcaguaacauugcaccugauuuuugacacaaacauguugcuuagagucucucauugaauuguuuaaugugggaagcuguguguuaccuguaacgucauuagagguaccauaugucauaugcauuaacaucaagaaugaaaugauaguuuccuuuaucccagaaaaggugguucucacagacacuaugaagguaauggaguaaaauaaucuaaagugguugggggggcggggugagggauaaaaaauuacauauuggguacaguguacauugcucggguggcugguucauugaaaucucagacuucaucacuauacaguucaugcauguaaccaaaaaccauuuuuaccccaaaggcuauugaaauaagaaaaaaauuuuaaugaaucuacaauuuaaccagcuuuguucuauaauauuaggauaagagaacaguuagggaaugaaggagguuuuuagaagaugacuuuuaaaauaccuucacacucuacuuuaaaaguuuguaaauuaccagugcauuaggguugcuucaguguggauuauagguauugcaguuuuaaaggcacugcauuauuuuugugauaaaauguuccuauaagaauaaaaugauucaucucauuuucauuuagaacugaauucuucccauauuuuucaucuggaaggagcuaacaaccagaaucuuauaaggauuuguaaugucuugucagcuaaaauuaauguauuuuagaaucuuugagcaccucaucuaauccauuuugagugauuucacacauaaaacacuauuuauucuguacagccuguuuuugcaaacaauuccucaucaaaaauuauaacaaaaauacuguucaaauauaauacuacuaauaaaaugcaaauauuacaauuuagagaauuguaccacaaaauggcuuuagguuuagauuuauaagaauugucuucuuguaugaucuuuuacauuuaaauuaacuguuucuacaccaagauugccauuugcuuuugauauuagucuuuaauauuuuaguagccuaucuaauuuuucaaacgaaauuuuauuugaagcccauauaacgccagaguuuuagagcugaggaagaggcuccagagagucuucagaacaguguuucaaaguuuucaucagggaaacuuuuuaaugcaagcuguucuucugggauguuagugcugaccguguggaugggagauauauauaaaaauauauauauauuuuuauauauauuauauauauauauaaggagagacauauauauauauauauaaggagagacaaaaggcagagcagccauaaaaaagaaugaaaucauauccuuugcugcaaugugaaugcagcuggaggcccaagugaauuaaugcagaaacagaaaaccaaauaccacauauucucacuuauaagugggagcuaaacauuggguacacauggacccaaagauggcagcaauagaugcuggcggcuacuagaggaggagggcaauaagggcugaaaaacuaccuauuggauacugugcucacuaccugggugacaggaucauuuguaccccaaaccucagcaucacacaauauacccauguagcaaaucugcacauguacccucugaaucuaaaauaaaaguuaaaauuauaaaaaauaaaugaaguaaaaucauaacugaaagaggagacauuacaacuaaugcuacagaaauaaaaagguucauaaaagacuacuuaaacuauaugccaacaacauguguaaccuagaagaaaugaauaaauuguuagaaacacacagucuaccaagacugaaucauaaagaaauagguaacaaaccugucacugguggagagauugaaaugguaaucaagagccucucaacacagaaaagcccaagaccagcuggcuucacuggugaauucuaccaaacaucuaaagcagaauugauaccaguccuucucaaacucauccaaaaaauugaagacaguacaauuccaagaaugaaccccaguguaaacuaggucuugggcaauuaugaugugucaguguauuuuuaucaacuguuacaguguaccacccaagauguuaauggaggaagcuauacauguuuuggggcagggguuauaaaggaaauacuuaaccuucucuuaauuuugcugugaaccugaaauuacucuaaaaaauaaagucuuuaaaaaaauaaaacaaaaugccuaaaggcagguagaccaguuuagagguaguugcaguagucuaggugugaaguguugagggcuuggcuuacacugguggugugggaaugauagguaaguguuguuuaaaaaaaucaccaguacaugaugacuaauaaaagggcacagggaggaagaaauauauaaggaugauggaaguuuugaaaucaugggaguuuugaaaguggaugacuuugcagaauauugguauuuaugagagaugcugagaacacgacugucagcauacagguuuauuuccaaauuggguucucagaguucacuuaagguauauuggaaucaugugaucuuguagaaacaguguaauacauauggggugaguucauagacuagccugugaaggauuaccugaugcaaaauaagacuggaucaugaugauguuagguucauuucugaauuuuggaugcugggagucaacuucugugguuuagaagugaaaaggaagagaugggagaccugggaagcauucugaaauagaugcagaaauuugucuuugguuuccuucugccuucuuucugccccuucugucucaggcgcuuggugcucucagguugucauaaaugcccaaugugggacuaguggaaaagagaauguccugcuuccucagagguagcauacaggagcccauggacugcugcuuuugguuuaaaaacguguuuuguucacacagcguuuuaaaacaugaaucaggcugggcgcgguggcucacgucuauuaucccagcacuuugggaggcugaggugggaagaucgcuuaaguucaugaguuugagaccagcuugggcaacauggaaaaaccccuaucuauaaaaaauuuuuaaaaaaugagcugggagugguggcgugcaccuaugggcccagcuacucaggaggcugaggugggaggaucacuugagcccaggagguggagguuacagugagcugagauggcgcuacugcacuccagccugggugacagagccagaccuuucucaaaaaaaccccaaagaccacaaaucaaacuuuauaagagucugaauuuuuguuucuuuugaagacaguuaucuagauugaguuuuaaauggggcaaacacuccccauuggcaacaaugccuuaccauccuuuucaugcugcuaaagcugugugucauuugccaucaucaccaggcuuaagccauuucguuacaguuaaggagagaguaaacuguuccucauaccuuguugaaagggacuuuuguuucaaaaaaugucugacaacaugcaacuaacagcuguauucucugccagggccccuaggcaccagaguugugacauggcacacuccuuccccugugacaauuaggucucuuaauagagauaaauggggaccaaaacuauagucauggacagugugggagccauuuauuuagaauuaaugaaaugacugaaacuagcuugcaccgcuagcuggcaggaauccuuggagugcagcugugugaucuaaauccauuuuggucccugauggcgaugguugcccauuuugguuuaaauauccauggggagaauucuggguccugacuggcugguuccuuuuuguugccacaaucuggggagauuagacuggcagaauacuggguacauguauauugauauuucaccucccuaucacuucccaaggcagggcuaccugucaguauuuucuccacuuaagaaugguaagcaccauucugguaucacccauugcuuuguggcucucgccaggaagagauuacuaugaacuugugagagaccuggacuugcaaagcuuguuuggacuuagaguagaucccagaguuguuugcuggcaaaacacagccuguguucuggauaucacaggugucuaguuaauaaugggugugagggacuuuaccucccccuaaaacuucuuugagggcagaaauggacuaguugacaucuaaucauaagucuacuucuuuuagggcagguugagaggacagguaccauuuauucugucacagaaacagaaggcugcuaaaugugggagaguucuugcaaggauuucacuaacuuggugcucucuucccuuauuguugcauuuuauugaacuuucgggagagcagauaucugugacuuaguaaauguugucaccauaugucacagauuaagcccaucuuuuuuuucuggagaaagggaauaaagucaccaauaacauggcgauuguuaggaggcccuuaagggguguuugaucaagggucuuucagaguaauuaccugggcaguuaggcuguucuacagucaucucucugugguccucaguucagacuagaugugaaccauccugacuuugaaaugcagaguagucccuagacuguugcaacuaguuuguuggggugggaucaggcagcgacuuggcauuuauuuaugcauuuuuuaaucugccagagcuuccuguaguuaaauaggcaugauaaauaaaguuauuuaaaggagucuuuacauaaaacuacugaauauucuuacauuucuuuuuguaguucuugguuaguagagaaauuacugguggccaaaucucacggucuuuacuguuuuugcauacuaacacauacuucacaauauuaaauugcauuagaucacagaaaaacauauuuacuugucugauuagcaaaacaaggauagaaugauguggcuuucaagugguuugcaaaaaugccucuagaaaaguagagagguaauauugucuaguaauuaaaaauuuguuuuuauuuggcuuuuuaaaaguaaauguggagacuucauuuagagguuuacuucuaaguuucacaaauguaacaauaacuuuuauuguuuucaggcuggaucuuacagagaaagacuaugaaauacuuuucaaaucuauuaauggguaaguuggcagcauugguuucauacgguauaugaguggucuacauaugucugcuuuuguaaaagaaaucauauaaauauuauacauguuucuauguaacugucuuagagugguauaguauuaguguucugaguucuuuuauaggauuuauuuucuugggagaugcaaaaguccuucaaaagaggaagaggcagguuaggaaauguauaauuguuacauaguagacacacauaauuuuuuuaaaugugugacuuaaucuuuguucuuuuaaugcuugucuuaaauguuuugaagcuaccuugaauggcguggcauacugcuugcauaugggguuuauaaguccaaagucugaggauguugauuuuuuuuuucagguaaauugggaaaaaauauucaccauuacucuuaauuuuaggaaagaaggcuaauuacagcaaucaaaaacauuuaauuaccauguuggcagagaucagaaaauuugcuuauacucuauggggccugugaggaaacaagugugcucauacuuuauuagagggaauguaaaucagguagucuuuuuugggguaauauugcaauaccuauugaaauuagaaacacguauacccuuugaccugggaacuugaggaggaauuuuauuuuauaaauauauucccaccuugcaugaagacuuagacucaaaucuaugcauuguauuaguaguauugucugacagucaccccguaauccaucaggugagaauugguuaaauaaaacagacuauguacauucaauagaauacuaugcaggaauuaaaaaaugcggcuaucuguagaugcugacuuagaucaccauuguccuaugaacaaugugauaguguuaugugaaaaaggcaaggcacgugaugguguguauagcauacaccccguuugcuuuuuguuaaaggugggggugaagagauaugcauauuucuaccaaaucaacacagcagauuuuaauggcaguuguuucugauugggaauaggguggaaguauuuuacuguaaaauguuuuuuuaaaagagcuuuauuauuuuuacuucuaaaaccauguuaauuuauuguuucuuuuaaaaagcuauguuuagaaaauuauuugccuucaguucaguuugguucaguaaauauuuaccauaaaaucaguucaauuuaguaaaacauuuacaaugcccaguaugugcugugugcaagguacuuuggcauggacaaagaucauuaagucuaggcuagaauauaauaguagaaccucaaaaauagaccuuuugaaacacuucauuuucuucccacccucuccccaguugcauuccuguuuggagaggaaucugaaucaaguagcaguguagacaggaauacauacuuuggggagcuagccuguccagaugcucaguaugucuucaugcaaaccagcaaaaggaguccauuuucuaucuuccucacucguuuucugcauugccacuaauuguugcuccuguaggccccuuuucucucucauguagucacugaaagcugcacuccaaaguggguuaaauuaggggccuuauuuauaucucugagugucaccagaaaaugagccguauucuaaugugacuucaaaagcaccuuuauugagucacuguuaugcaguggaccccauaguauuuugcaggggaaugcagagaugaaaagacagagccaugcuuuaaggaguuugucauauaggagggacagucagguuuugcugcaugaaaggaguuugggguuagacauaccguauuuggucauaggcagcuuuuuaaauacuaaguuaaugucuguaagcuggagaccugggaugcaaaacauaaaaauuaaaaaaaaauacugaguuaauggaaagagagaaugcuaaugagucuucacuaagccacuuuuaauuguuggauuuucugcuuggauuugugguagauauucucccacacagaugcuuauauguuuucuaccagacugugaucuuccuaacagcaaaagccacucauguuugucucuccaggcaagucgagucuagcucauggaagaaacagaauauauuucuugaauaacaacaaucacacaagugauauuucacauaucucaagcucguauuuaaauauuuucaaaauuuuaauaugauuaauaccauuuuucuuaccucuuuugaauauccuugguucuuucaagaccuugcuauaaauuuuaaauuuaaaguuuaauuuuaaaaguugauauaaaaacaugguaaaauauuuuucuauauuucaccuuuauaaguguguaaaauaauaucaaauauuuuugacugccuucuuuuccuaggcuuuuucuagaaucguaauuauguuucuugaaaaaaauguucuaauacugugcguguuucugaagagacucggggugauaagaauuaaauucuuguagaaauuuaauucuagcuuaaauauauuuuuaugaccagcuuguucuuuauaguuaaauuauuugugagcuaaaaccuacccauaauuauggaccugcaauugauuuggcaucacagaucaccuucauuuaaaccuggcuauaccuggaauuuugucugucuuugaugucuagcucuguguacucuugccccuccccuacuuauuuacuuuuaauuuucccacacucuauuucauuaaauaaauuuuuugaagaaguuuuuggaaaauaugcacuaaaguguuguuaacugcuguaguuucugaaugggauuguaaauauuuuauauuuucuuuuuucuuuacuuuucuaauuuucuucaaggaucuuauugcauauguaauaagaaaaauuguuuuaaaauaaaaagauuguuuucuguguguguaugggucggggguggcaaaauacacccuauuugauuuauguaacguuguuucagaauccuuuucccuggaggaaguguugaccucagacgcucagauuaugcuaaaguggccaaaauauuuuauaacuuguccauacagguaaauaucaguuauugcuuauuauuccagauggguuucuguaaguuuuugugcgagugguucauuuuuuaagcagaugguaaugcucccuucaaaauuacccuuagccucaucauaccuuuaauuuugaggugccuguucuuggcugcucccgccuauuuuccaugugcuucaucuaauccugggcuuccagagacccuucagagcacugcugacugccccucucuugaugcuuguuaaugugaaccguguccucauguaguguagacauucugaugucucucucuguccuauuuuuuuuuuaugggcauuguuucuauguuauuaauucucaccucuucuugaaaucuguucuucuucccaacucauucaauccuauuggaacuuucuucacaguuaccauagacuccaugucaagcagagcuucugagccucugacuucuccuuuguaauguucacagugggacugccuuuguaccauagcucaaaccuuugcuguuucucuccucaacuauuaacagugauuuuuaaauuaaucuugcuggcccuagaaucuuaccaaucccccuuacacauuucccuaaauaacuguuuuuagccuuugaaauacuuguuucaaacuuuuaauagcuaaggucaguaaucuauaggcuuuuauagucuuugggucaagauauacaguguguccacagcucauguuuuccagccugugugggagcuuggucugaagagagauuaagugauagccuacuuauggauccuggagaauucuucagaaauccauguguaacucaggugccuauuugguuaugacaaaagauauggcuaauuuuuauuuugaaaaguuugaauaaacuuaguuuucucuuuuuccacuugcaaagaguuuugaugauggagacuauuuuccuguguggggcacaugccuuggauuugaagagcuuucacugcugauuaguggagagugcuuauuaacugccacagauacuguugacguggcaaugccgcugaacuucacuggagguaagaguacucuuuucaacccuuugaaaaauauuugcugggcaggauuaguaaguagcaaauaugaaaguaaaagugcuuauuuuuauuuucuuuuuagccuuuucccugaaggaaaaaaugcuuaugacauuagcauuuaaauuauuuacacagguugaagaugugaaugaccauccuuguacucauuuaugaggaugacuuaaggaauugugaauuuuaauaacucauugcuucuagugauaucaggacugugugugaugaagaacucugaaaugggaucugguuuugacuccuagcuuugucacuuuuaccuugaggaaccauuuuaccucucugagguucaaugucugcauuugcaaaaaggucuaauaacgcuuagggguuuuuuuugugaauauuaaauaagauuuuuuuuuuucuuuuuaagacagagucucucucugucacucagucuggagcgcagugacgcaaucucggcucacugcaaccucuaccuccaggguucaagggauucuccugccucagcccccugaguagcugggacuacaggcacccuaccacaccuggcugaauuuuguauuuuuaguagggacaagguuucaccauauuggccaggcuggucucaaacuccugaccucaggugauccacccaccuuggccuuccaaagugcugggauuagaugaucuaccgggaagcgcuauauuuacucagcaaccaggaacuccagugaguuuuggugucuagaguuuuuacuggaacguuauuaugaaauaauugauugaaucuuugccugugugauugaacucaaucuccagccccucuuucauacuuggagauugauugggcuggcucgaaguuucaacuuucuaaucaugaaguuaguuuuucugaugauuagucuucauccugaaauaauugagggacccaccuugaauuaccacauuagcauaacaaaaauacuuauaucauuccgggaauuccaaggguuuuagaagcuuccugucaggaacccaggacaaagaccagauagauucuuagugauaucacucuguauaaauagauaaugauuauuguggguuacuugaucuccgaaugcuuagaauugaagccaccagcuauuucuguucucauagggauuuugcaaggaagguagcagucauacuuaaaacuuguagaaugcuuugugcuuuugaaagcucuuucuuccauugucucacuuaauaauugcaaaaaccuggugggaaguacauguauuaggucagaguacuuugguuguguguugccagaacucaguuuauacagaaaaggaauguuucaaggugcugugguuuucauggaagucucuaguaagaauaaggggccugguuugaaacagcuggcacuaucgccuugaaaacgucaguuucuuuuuuuucaaaaucuguuuguugguguuugagucugugcagaaccuucaggguugaccacuaagauauauugcuuuuugaucuguuuacugagucaaaauuucuuggcuugguucauguucuuuucuacauuguuuguauuuuuauuuguuugucccagauaccucugaaaauauguuauauuugaaaguuuuggauacuuuccugggcaaauacauacacccauggaaaguuuuaacuguuuuucagaauagucuguggaaaucuaguuaagauucccugccuguucuuuagcuugccaauacucauaucggaagaauuuuacuuauucauguuaaaauucuagaagaagauuacuuauagcuggagcauauuugaguuuauguuaaacacauuuugugacuugauuggaauacuucuauggaaaugauguguuuugcauaucauuuggucaucuugauuaugucuucauaauggcuucucuuugggugcaguaagugacuucaguggauuuuauuuuuuuguguuuaaauuauuucucuuguacuuaaauuauuucaggucaauugcacagcagaauguuccagaauuuuccuacugaguuguugcugucauuagcaguagaaccucugacugccaauuuccauaaguggagccucuccgugaagguaucacacuaauuacacaaugaaauuaauauguuuagaauaacugcagaaguaaucauuuuguuuuauuuucguauucuagaauuuuacaaugaaugaaaaguuaaagaaguuuuucaaugucuuaacuacaaauacagauggcaagauugaguuuauuucaacaauggaagguauaucacuauaacauguauacuuuauuucacuuauuuuauauuuuuaaauuuugauuuuauaugucucaucaauaaaaucauauuacuuuggggcuugaagagggguguuagggcauuuugggagacaggagacauguuuuguccauguuucaaauuaauugcaguuuuccuggguauuuuccugaaugggguggugaagaagaaaaguaaaagaauaaagggggcaaggaugaagaaagaaaugaagaaaaugacuucuguuucuagcaauauugcagauuaaauaccuugacagacuuuccuccagccaacaacaaaauaaaugugggugauagagaaaaacauaguaaauacguugaugaauuggcaaagaaauaaagauacucagguccaaaauuuuaagaguugaguggaauauuuaaaccaguguuauuauggaaucaggagaacuugagacaaagucaggacucucuauacgaauaguaucucauggagcgggaccuggauggcuauaccagcaauguaagggugaacucaaaauacaccuaaaauccccccuacagaauggcaaggagaauugcccauccugagcuuuggggcuaagggaguggggugggggacagugaauaaagccuugaguguuuauaaugaugggcuguucuccuaguguggccagcauuauacuaacugggaaguuggacaaaucuuaaguaaguaauuuuguucaagguugccuuagacugguaaugcucucaugugugaggcugaagcaaauguaaauaguuuuuuugagaggaccagacauucaucccaggcuucaaggaauuucaacauaugaaguuugaaggaaaaugagugcuucacagccaaaauacuacuaaugcacaagcaagcacugugaaugagaacuugcagagauaacagauguggaagcagaccugcacaaauguuagauauuaguauuaugagauaaaguauaauauauuuuaaguuuuaaagaaagaaaaaugcuugaaaauauaggcaugaaacaaucagauuugaaaauaaccaaauucagcuauuagaaauuauaauugaggccaggugugguggcucaugccuguaaucccagcacuuugggaggccggggcggaucaccugaggucagaaguucaagaccagccuggccaacauggugaaaccccaucucuacugaaaauacaaaaaaagaaaaaaaaaaaaagcugggcaugguggcaugugccuguagucccagcuacuuggaguugcaaugagucgagauugugccacugcacuccagccuggacgacagaguaagacuuacucuguuucaaaaaaaaaagaagaaauuauaauugaaauaaaacccucaguagacauguuaaucagguuagacacaguugaggagaaauuaaugaacuagaauagaagauagaugugaaggaaacauucagaauccaacauacccagacauguaaauguaaaugccaaaugugucagaagaaagguuggaaucuggaggguaaagugauuucuaacuuaccuaaccagaacucuagaaggaaugggaaaaaguaggacagagacagacucuuuuuuccauauuaaaaaaaaaauuuucagguggauaaaagaccuaaggagaaaggcacacuacaauaagguuuuagaaaaaauaaaggagaaugucuuuaugaucuuguuugagggaaggaguuuugaagacaaaauauaaacaaaccauaaaggaaaagauugaugaauucaaucaaaugaagaaguuguguucguaaaaaaaaaauuacacagagaagaaaaaagggagguauuuguaaugcauauaacugacaaaggauaugugucuagcuuauauaaaguaaagcugugauuuaagaagaaaagauagcuuauuaaaaauggauaugaggucugggcaugguggcucacgccuguaaucccagcacuuucagagaccaaggcaggcagauuucuugaggucaggaguuugagaccagccuggccaacauggcgaaaccccgucucuacuaaaaauauaaaaauuagccaggcgugguggcgcacgccuguaaucccagcuacuugggaggcugaggcaggagaauugcuugaaccuagugggcggagguuucagugagcugagauugcacacugcacuccagccugggugacagagcgagacucugccucaaaaaaaaaaaaaaaaaaaaaaaggauaugagauuugaauggauaccauccaaaaaaacuugauuguccuguccacuuauggcuuggugagauaaguugcucaguguaauuucugaucagggaaugcaaauggaaaccaaaguaaaaaaccauuuauacccaucagauuggcgaaauuaagaagccugcugauaacuaguguuacccaggaugucgcacagcaggugcugucaugcacuuacgauuggaaaacauuuuggcauuucuuaguaaaaucaaacauuuuccaguuuuguuaccuggcaguuuuauucauugguuaaaaaauaucuuaaugaaauaauuucauguagauagaaauguacgugacauuuuguucauaccagcaaaaaaauggaaaacaacucaaaaguccaguagugcaaaggauaaguaauacuauacagcuauuaaaaucagugaacacaccugcauguaccacugaaugaaucaugaagacaauuuugaguuaaagaagcaagucacaagggaauacaugcuguauguuuucauuuauaugaugauuaaaauuuggcaaaaaagaaacaauguucggugguaaaucuaaggaaagguuggggugaugaauaauuaugagaguccuucucacugggcugaaggggugggagggacaguagaagggcuuuggaaguauuaaucauguuucguccucccaauccgauguaccuugcuacaucagcauuaaccaccugccaccuggauugcugcagcagcagccucuuaaggcuuccacaaacccaucuuccagccacccacucguggucugcugaagugccagucugauaguauugccugaacaaaacuccucaguggcuccucugcauuggaggaugaagucuagauuuaugagcuuauuuccucaugcccucucccugccuucaccucuagcuuguacccugcacgaccuguuugcuacacacagucccuccacagagccaugcuucuugccucugcacugcuucucaugugcuuuccucuucucugaaaagcucccccuuuccccuauuccuuucuccugaugaacucuuagccaucucgaaaaacccaggccacuugucaucccuagaggccuuuucuaccauuauuccucuucuccacaaccuuggugcuuugugcugugugggaacguuucuuaaugcauguauuugcucuuguucugucaucccucuagaugaaaagcuuguugagaucaggaacuguaucuuacucuccuuuguguuucuagggcucauagauguugaaugaaugccuaauuauuuaaaugauagaauauuggauuggaaguuaggaaaucagguuccauguugguucugcuuuugacuaugccauaccaggcucauuugaaaauuuucucccaccuccaaaauaggaacacuugagaugcuuuauuauuugcauauuuucuuuccacucuugauacuucugucuaaaucagugaggcagggcaugauuccuaguuuucaggaaacugcacuggucuuuuaguaaugcaguuuacuaaagaagaguaaaucucacucguuacugaaugucagugacuucaaaaaguuugugggaaaaauggaauuaaaauauaaaaauaaaaacuguaaacuuuauuucucaaaauaagcucuaucaaguuuaagacacuuuugcccaugaugauaccaaccuuuuaguucaucccuaaagaacugaggguccugugaauugaaccacgucaaaugcggucuuuuacauuauuaacagaaaugagugcccuuuaaagauuuuuuuaagauuaggaaacaagaauaagucagaaggagccaaaucaggaccauaagguccuaauggcuucccaucaaaaugcucacuaaauagcccucggaugaaaggaaugaggaggaacauugucaugcuggagaaggacucuggugaagcuuucuugggcgauuuucugcuaaagcuuuggcugacuuucugaaaacacauaaaaagcaaacguuacuguucuuugguucuccagaaaaucaacaagcaaaaugccuuggagcauccaaaaaaacauuaugaccugugcccuugaccaguucacuuuggcuuugacuggaccacuuccaucucuugguagccauugcuuugauuguguuuucagguucauacugguaaaaccguguuuuaucugcaguggcaguucuucaaaguaaugcucuaggaucuugaucccaccuguuaaaaauguccauugaaagcucuucucuugucugcagcugaucugugugcaaugguuuugucaccgaucgaauggaaaguuugcucaacuuuaauuuuucagucaggauuguguaagcugacccaacugagaugucugugguauuggcuguugguucugcuguuuauuugcgaucuucuucaguuaagacacgaacaagauacauauuuuccuggcaaauugaugugaauagucugcccugagggcuucaacauuguuucauuccuucuugaaacaaguuauccauuuguaaacugcugauuucuuugggacauuauccccauaaauuuuuuguaaagcaucagcgguuuuaccauucuuccauccaagcuucaccguaaauuugcuauuuuuucugccuucaauuuuagcaaaauucauauugcuguuacagggguucuuuuaaaacugaugucuuguccuucuuagugccucauacuggauccuguucauacaaguuacuacaaguuuauuuuggugcaaaaaaauggugaaauccuugcauaauuuuuuucauaauacacguuuuccaugagcuuuuugaagauuucuuauauauauguaucuuuuccaacgcaugaagcauuauugaggacaaaaauagucuuaaaucauaaaaaagauuuauauccaauauacuagaaggucugccuuucaauuaacucuauguaacaauuuccuagucccccagccugugggucucuugcugguagcuucacagguagucccagaauagaggggaaaaacggcagugucacacggaagugggggaggcagggagcugagugccuggagcugcaugaggcagguguuuccucucgugaauacccacaaaacugggauaaaauguuucccuucuguggccugcucucuagucagaaagcuuacugggaugagaacagacagugcucuuaccccuagauaucucuucuuucauuaauucacuucauuucuccaaguacuuucugaugguggucaugguuacaauuccaaagcagaaaauaauagaggggagauuuguuuuuuuuaaaucaaaaugaggaaaggcacaucugaagaagagacaaauauguacauuuuucugaagguaacuauuacacauauucacuuuuuuuuugaauuguggaauuguucaugaguauguaaacauagagagaguaauaugaacccugggugucuaucuaucagcuuugacaauugucaacagcucuguuucccuucuuguuuuaugucugcuuuuaaacuucuaaaaaauauuuuaaaaauuuauaccacaaagucaucagucauuccauagacugagagagagacacaguuuaggcaguuuaggcaggguguaaaaggauaccagaagugcugccauacuucauucucauaugaauaagucauuaugggaggacaggaaagcaugcuacaagacgggagaaagagacccacugcggaagaaacuuguaucaccaauaaaaugugcaucugacuuuuggacagggauagauuccucagcucagcuucuacuuugcuaugaguaucucgaaaagcaaaucguccuacagauuguaaaagguugcuaaucagugaaauacguuacagggaauuuucacauugauuaugaauggaaauuauuuugugucugagagaauauguacaauuuuaccuugucugauaaggugaauuauaaaauguuuuacauaagaaauaaaccaauuucauuauaaguaacauuuuaaaccauucuuaguacuuacuaauuuguguucuucuuacaggauauaaguauccaguauaugguguccaguggcauccagagaaagcaccuuaugaguggaagaauuuggauggcauuucccaugcaccuaaugcugugaaaaccgcauuuuauuuagcagaguuuuuuguuaaugaagguaauaugaggguacauaauuuuguuauucugggguaguuuugaagaaaauugcccuuaucugaacuuuugccuacccuuuugcucuauaaauguuuuguaaguucuauagguuuaacuuuaaagaauaauacaaauguuaaauaaugugaaagcccuaaaaucaagauguaagguauucuaauaaaaccaggacaguuacuucaauuaucauacaugcuucagugggcagaauucuugaacaacagugugaagaauguugagaguuuuuuuuuugguuucuuuuucuuuguuauuuguuuuuugacaggaucuugcucugucgcccaggcugaaaugcagugaugugaucauagcuuauugcagccucaaacuccugggcucaggggauccuccugccucggcauccugaguagcugggacuacaggugcagacuaccacaccaagcucuuucuucuuggauacuuuuaauuuagauucuuccccauuacucuccauuucuuagaauaaugcuuuaauucuaacagugucugagaauuagguguuacuuuuccaagacagugauacaaauugaauauauacccaccaguuugugauuuuaaggcuaccucucuguaggcauuggcauacuggagaaagcaaauaaacucugccugcuguuuggugaugaaaacacagacauauucaugcuguguuauguuugugggaaaaaucgagaauuugguuguagaugccuauuucuuaguugagcauuauagguacaguaaguccuacgauuuaagcagaacuguguguagcagguccuugaacaacacuguuuacuuugaagucguuucauuauaacauuguuagaaaaaaauugguuuuguuauacaucguugugcuuaaaaguacuacaagaaccuaucgaugacguuaagugaagacuagcuguguaagacagagguacaaaaacaacuuguaaacgguagagaucacuuuggugagguauagccauuuaaagacuuaagugaacuuugcuuucauuccaucuccaagcuugcccuaaguuuuuaucaacucuccugccauugcugggaagucaaguacuuccuacugaguucacucugcuuuagaaucaugcagagcugaguggaugguuuuaugacaaaaacuccaaauuaaaaaaaaaaaguaucccauauacaguauuaguccaaaggaacauuuucaugagugcguggagugaaugagggcagcaguggcagugccgcauuugcugcaguaguagucauguggcauuuggucuauguggucuuuuaucuuccaacauucuuucugaaaaugccguaagagccuguauuuacuuugacuuugggagcuuuaggagcucucaccuccucacauuccagcuuucaucaugccaaacuucucacugugccuccugguuuuucauaaugcugccuuaccagugaaaaugucucacuucucugucugccucagcuucaccaguuucuccaucuuuuuuacucuuguagcauccagugaugauacaccauauaccauaaaaacauuuuuaucauaugauucugugugguuacgaggcugagcuuuuugaguguuaggaccuguucuguuuauauuuccauccccaggcuguguuaucaagucuuguguauuugauagguagguauuugaaugaguugcggagugagcauagcaugggauaugcugcagggggaguacagcacagcugcuguggccaugcgcgacugugccauaaaucgggcacugcuuuauuuggggaaauuuugucaagcauuugccucccucccuuccuugguuccuucuucuucuucuuuuuuuuuuuuuggaaaguaaguuuguuagagaaguaaagaaaaaaaaagauggcuguucuauaggaagagcagucgcauuucucuucuuguugauauuuucccacuuaauaaugcugauugcaggaagaaauauuauaaaauagucucuugaagauuuugucaucugaucuuuuuaaaaauuaacuuuuuuucuugcagcucggaaaaacaaccaucauuuuaaaucugaaucugaagaggagaaagcauugauuuaucaguucaguccaauuuauacuggaaauauuucuucauuucagcaauguuacauauuugauugaaagucuucaauuuguuaacagagcaaauuugaauaauuccaugauuaaacuguuagaauaacuugcuacucauggcaagauuaggaagucacagauucuuuucuauaaugugccuggcucugauucuucauucuguaugugacuauuuauauaacauuagauaauuaaauagugagacauaaauagaguguuuuucauggaaaagccuucuuauaucugaagauugaaaaaaauaaauuuacugaaauacaaauauuuuuucuaauugauuugcuugggaaauaaauaccauccccuaccugcccacuccauccuccuugcugaaaaagaaaauagucuuuuaaaauccuaccaauuguucaucuuguucauugugaugucuccguccuuugggucugaggaguauuuguguguguguguguguguguguguguguguagguauguguguauagguaugugugugcauguguguaucuacuuuucugcccuguguuaacuucauauuuaaagcguacacauccugaaaacagagucugugucuugaacuuuuuaucuuucacaauguccauaaugucuagcccagcaggcccucaguaaguaauugucacuaauuauaaguuuuuuucccauggaaaauaauuuaaaagcugucauauauuuauuuugguacacuuuaauguauuuuucuuuuuuuuuuuaagauggagcaucucucuuguugcccaggcuggagugcaaugcugcaaucucagcucacugcaaccuccgcuuccuggguucaagcgauucuccugccucagccuccugaguagcugggauuacaagcaugugccaucacacccagcuaaauuuuguauuuuuaguagagaugggguuucgccauguuggccaggcuggucucaaacuccugaccucaggugaucuaccagccucggccucccaaagcgcugggauuacaggugugagccacugugcccagccaacauuaauguauuuuucaauccgugcuacucuccuccaccccucaccaucccauauaacccucagaaguaugaaauuuaggaacuccuugaggacaaccaagcugcuggaaggaagagagagaggguuugcugagcugugucugguaaaugguguuuaugcaucuguucucugugggcuu

SEQ ID NO: 13902 - RNA, 9118 nt, Homo sapiens
agccauucagcggccucgauuaugcagggggcugagggaaccacuccaugugacccucucgggugggacucugcagcugcuucgcagcgcaacucucucaccaaacuccgcgcccuugcgcuagcggugccaaaaggcucccgccccgauugaaaaggcgcagugcaugcccgcccgcgucacuccgcgggcggaggacgcacgucggggcgcggcucucuggcuagcgcgcagcuccagcucugucacucgcgcccuuccaaggaccuggagcacccgagcgccugccugguggcggcggcaacaaugcacggagccgccagagcgccagccaccagcgugagugccgacugcugcaucccggccggcuugcgccucggaccggugccugguaccuucaagcugggcaaguaccugucagaccgcagggagcccgggccuaagaaaaagguauugaccauucagaccucugcccacugccauucgccucucagugcccugacccgggaaagggguacgagagaaaguggaggaagggagugauugagucguuaccugcuaauucugccggguggaaggggacuccuauuauucugagcaaguagccucuuuaacugugagagcuggacggggucgggcugagaggagaggauguggccgagaggcgacagcccuggguggggugcacugagcgcuguaggugccgggaccauucgcagcuuguguuuuccccugcgcucucgggucuccucagucagaagccagaagcccacccccgcacgcuguccgcagcucucucugcaaaagcacccucuuucugggggcucagggcaucgagacccuuucuucccuucugcccuucaauauguuaauuugaggccuaauuucgccuuaaaguaauuuuuuuuccugaaaaaaaaaaucuuugggaggcucucaguuccuagaaccuccucagauauuuuuuuuucccuugccgaugucggcuuguggguaugcggcauauggagagaggaugagcaagguacuggcucugacgcgggcuccaagggcgaggcgcgcccauucgcgcggggcacagggucagagcgucugcagcggggcucugagaguccagaggcccaaccgggaggcgccagggccaaaccacuagcuuugacucccacacuccacacaccgucgcgaccccugaccagagagacuuauagcacucgcccgcuuugggggcgucccaggagccaaaggucggcaaacagcgaccgggaaaugaaggcagaagucugggguagaagaaaggacuuuggcuuccuuggcuuuagcuugccuugcuuggagcuuucuaguaaaaagcuccgguguccagccagcgggacuugcaccucgcuccuccugcaaucacgccccccacuacagucuaaagcgggguuuggugcccaccgcgcauuccucuuuaaacgcguuuuaauugcuuuuaaauggccugccagcugcgggcaagcuuuuccccgcuugggcuuuguuccgagacuuuagcugcagggcucacaggcaacuaggugcgaugcacacagaauacaggaggcaugagauaauuuuuuuguuuguuugucggggguacgcucugggcccugggacugaccuagaaaugucucuaccgugguguuacggcugcucucagaacugcaaaugggagagcugggguaggggacaacuugguacaagaugugccuaagcacucagggaggaugcucucaacaccccucuccccuccccgugucgucaagguggggcgcagggaagugggaguacuguuagcauagguagacuuuccucuuucucccuccccgaagcaagguccuaaggaauucuccuccucccaguagcccauaguggucuggccaaaccaaaaacaaccacuuuccuguguuggguugggguggaggauaaacuuucuguuuggguugugggccuggccaaggugcgggggagaacgaccacugcuuguguugcaggugcgcauggugagaggggagcugguggacgagucggggggcuccccucuggaguggauaggguuaauccgggcagccagaaacucccaggaacagacucuggaagcuauugcagacuuacccggaggacagguacugcgggcuucucuccacacccccccacuccccaccgccaauucagucuaccuaaccgucccugcgguggccaaaaauauuaagagcaaaguacuuuagcuagacgucucauuuaaacgucucgacaacccuuuaagguaguuacuauuguuuuuccguuugaaggaugacggaagugagguucagagagcuccaguagcuucuccagggucacacagcaucagaauccggauuugaaccuuucuucucaguugcuuuuugaccgauuacccaggaaaugacauugaacuguucuauuccuugcgucccagaucuucuaccgagcauugcgagacguccagccaggggaggagcugacagugugguauucuaacuccuuggcucagugguucgacauccccaccacagcgacuccgacucacgacgagaaagguacccauuccaaaagcguggaugggcaaaaguccagcccuccuccuccugucuugaagcgagucccuagacauagcucgaucuauguaaaauggaauucacauucccuguauuucaaggcaaagaggagagaggucgccacuaccuccuuaaaaucaaccauaaacgauaacagugauaguagcaaucuggcucacaauggcaggggaaaaaguaggcucuaugaacuuaauggggccauccuuuuucuguugcauauucaaacagaccauuauuuacucaauuaaaauaaaaaaaauuaggcgcgguagcucacaccuguaaucccagcacuuugggaggccgagguaggaggaucacuugaggcuaggaguucgagaccagccugggcaacauagugagaccucugucucuacaacaaaaaaauaauuagccaggugcggcgguacaugccuguagucuuagcuacucaggaugcugaggcaagaggaucacuugagcccaggaggucaagguuccagugagccguaauguuaccacugcaugccagccugggugacaagugagacccugucucaaaauaaauaaauaaaaauaaaaaauaaaaaaggagccuuaaguuguuguuacaguaauuacaucaugaguuccacagaguauaacucaaaccuggaaugcuuuuacaaaguccauggacauuucuucuccacuggcuuuccaggagagcagugcauuucuacagcauuuuagaaguauuacgguacuuacagcuggucaguuggcagguacugagacccuuccauuuaaguggcauuuauucauuuccccuugccuacuuaaguugaaucugggauguaucccaguuucuucucagauuuauuugaucccuucaaagccaagagcggauuuaugcaaauuaaggugcaguaacuaaacagaaaaacauuuuuaaaccuacccuugaacacugaagaacacuuccuguggaaagaagucuaggaggugcuagaauaguugagguuuuggagacuuccuuuucacacacaaagcuuccauggcuuuuuuucuuugacaauugucuguaauuucuccuaaagacacauuuaacaucaaaauaaugaaugcugugaaauauucuaacaugcugucuuccugaauugccugcucaaucucaucccuuuagaaauagguuuagagaaaucaauacaaguaugugaauuaggaaacacuucaugaauaacacagaaugaaguuuauucaaaacaaugaaucacuuuaaaguaucaucguccucuguaaguuaauucuguuuauuuuguagguauaguauucaaauuauccuaaaauaguuuguuccuugcaucacauuauauuacauucucuugucaacuucuuccaguaaaaagagaaguauaauaaaagccacauaguggagaacucucaaaucugccacuauagaauuuggcgggccacuaaccuuuagaagccagccauuucuacagagaacacccuuucuuagguagucccaaauaguacaaaagcaacuggaauagcgguccuuguguuuuccuuucagccaauugagcuuauaaacaucauaugguaacagaugucaaaauaaacauuuuuuuuuucuggaggugagaaggcaugggugauuuugaacccugacuuccccagcuuggagaaguuugaacucuugaccaccuuagaguuacaugaagaggaggcagucacuuguuaaauguauuugauacucuuggcaugauuuggaucucagagucuggagaauaugucaguuaggauaacugaaaaaaaguauauauuaaacguaugcugcuuaaagcuuggaaagaggaagaaauaaauagggauggcugcuauccuccuaauacuagcuaacuucaguggguuucaauuucauaguaagauggaggaaaauacugcccccucauuuuaagaaaaaagcuuauguggcuuugcauugagcugagucauucugcggcagacucugaaaacucccucuuucaaaaggggugaugagagagagaaaggcucugaaguuagaaggaaguuauuuaagacaacauacccaccaagagaacccaggaggucuauucucucuuuuuuucacgauucauuuuacaugaauguucaguacaagguaacagaauauugaaaugguuuuaucuaagacuucuauaaacgauuaggguagggugucauaggcaaauacucuucucccauuuuucuuucugcucuccuuggacucaguuggaaugcagugcuuaucacuugaguuuucacaggucuuaugggguaggggugggagcuacuuguguuaugcaaacccagaaguuaauauacauaaagggaagaagaucuggaauucuucccuauuguuauuucuguaguaauauuucagaaguuugagcugcucauauaugcagagggagaauuuaacuuuccuguuaaauuuuaugagacugauguauauuuuggauauuuccuugcgguucaacuaacuucuuucucagacaucuuucccuucaguauuaucaaucaaccacauuuuaaaagaaacccaacugcaagaucauuucucucuacagcaguaauaugacccuuuuaaguggaaauuaacuucuaguaugugaucagaaugucucauauaugugucucuugauuguguucacaaacucgggcaaaaugaauaaacuaaugcuaauaauacuaaacacauaaaaagauuucacaccaaacacguauauagugcccgguagagaauucugcacuuauuaaaagcugaguaucuauauuuauuuaucgaucuauaucauuuauauauauucauauaauaaaaaacuaauauauuuucuccaaagacuuuacuaagcuuggauuugugcagcuaucuaggaguuaauuaauuaccaaguggcagacaagacaagacaaugcaacaucauccuucuuagauuaucaucacccuuuuuagaguaucagggcauaagaauuuuuucuuuucucccagcaaauuaaaugguguuaaagaggaaauaaagauacaaauaauuuugaagaauggcaaaucauagucccuaugugguccuucaguuggucacgcuccaggaaaaccucaggcaaaguguuuaaggcuggaaggggguggaauggguggguaggggacacaaaagacauuguccugugaaaaggaaugauuacauauggccuauacauacaggauauugucucgccugguaaugaggcgcucacgaccauuagauuggucuuuguucagcuuauccaaacuccuugacauacgccaccuauucugcaaacgccaacagaugggcccaggcacugcacagccucaacacuugauuuaaagcaacagcugcucuuugcucuuacacggccagccugccugagugcugcccuuccaacgaagauuuugcucggauggccuggaggaagucuucguuggaaaggccccgucaccuuuuuuggccuccgaguagucccagaggauggagacacugauaaggauuggccauuuggggcuuuucgggguccucgauacaguagggcuaccgaacuuauauuucacccucuccccacaccgcuagucgaaacuugggcuuugccuugggugcacuggcgcuuucuuuaugucucgcuuguucgccucucaccgggucgcuuuuccauucuuucuugcccaggggaggagcgcuacaucugcugguacugcuggaggacguuuagauaccccaacagccuuaaggcacaccugcguuuccacugcguguucagcggcgguggaggcggcgccuuccugcaccacgaacacgcggcucgccaaggcgccgucccagcggcugauggccucggucucuccccaaaacccccggcgcccgauuucgccgcgccuucccaggcaggaacuuugcgaccccacccccugggcccgccaccaguucaggccugcggugcgcgggagggcaucaagcgcgaggccucuuccgcgcccucggccaccucgccgaccccaggcaagugggggcagcccaagaagggcaaggagcagcuggaccgugcccuggacaugagcggagccgcccgaggacaagggcacuuccucggcaucgugggcggcuccucggcgggggucggcagccuggcuuucuaccccggcgugcgcucagcuuucaagcccgccggccuagcgagggcggcggcggccgcucacggcgaccccuaccgggaggagagcagcagcaagcaaggagccggccucgcuuugggcaggcugcugggcgggggccgggcgugcgggcgccccgggagcggggagaacucggcggcgggcggcgcgggucaccaccaucaccaccacgcgcaccaccaccaccaucccaagugccugcucgcuggggacccgccgccgccgccgccgccuggccugcccugcucuggggcccugcgcggcuucccucugcucuccguccccccggaagaggcguccgccuucaagcacguggagcgcgccccgcccgcagccgccgcgcugccaggagcgcguuaugcgcagcugcccccugcgccgggguugccccucgagcgcugcgcgcugccgccccucgacccgggcggucucaaagccuauccggguggugagugcagccaccugcccgccgucaugccggccuuuacagucuacaacggggagcugcucuacggcucaccggccaccaccgcuuauuacccgcucaaauugcacuucggcgggcugcugaaguauccggaguccaucuccuacuucagcgggccugcagcggccgcccuaagccccgccgagcuggggucgcuggccagcaucgaccgagagaucgccaugcacaaucagcagcuguccgagauggcugccgggaagggucgcggacgccuggacucggggacguugccaccggccgucgcggcggcgggaggcaccgggggcggcggcagcggaggcagcggcgcagguaagcccaagaccggccaccugugccucuacuguggcaagcuguacucgcgcaaguaugggcucaagauccacaugcggacgcacacgggcuacaagccacucaagugcaaagucugucugcggcccuucggcgaccccagcaaucucaacaagcacauccggcugcacgccgagggcaauacgcccuaccgcugcgaguucugcggcaagguacuugugcgccgccgggaccuggagcgacaugucaagucccgccacccuggccagagucugcucgccaaagcgggcgacggcccgggugccgagcccggcuaucccccggagccuggggaucccaagagcgacgacagugacguggacgucugcuucacagacgaccagagcgaccccgagguugggggcggcggggagcgcgacuuguaacgagucuucccgggaaggggcggggugaggacagagaggagucgaggguuuauucucgcaguagaggaacuccugguggugggaagagggacccaauggacaaaaccguuuuuguuuuugagagggcgccagauuugaaacagugagaggucccacaucuggugcugaaacucagagcaacaguucagagguggcguaaaucuggccaccuggagagcucgagugccaccaguaccuccgcaccccgggccucuggacuucuuggaugagcucacccugaaccgcccaggcggucugcucuugguguucagaaucacaucaaugcgaacgucacagcgccuucgagggcgcagauuuuaacugccacguauuuuuaaguuguacuuuucuguggaggaaauugugccuuuugaaacgacguuuuguguguguauuucacguuagcauuucauugcauaggcaaaacacuagucacaauuggguagaugugacauccauauacuuguuuacauuuuaucuguucucaugucaaagacuacuccuugccccauugaauauauagugguagcagguguacaaauuggucaaguugcaauuauuuaugagaaaauaaugauaaauguaaaauaucuaaagcaugaaucuaagagcacgcaauauauaauuuuaaagaaaauauucuauuugguagaauacaaaugugguguguguuguuuuauaaugacugcuguacaguggguauaguauuuugguuuugguuccagauugugcaaucuuuaagaaaaauaaagauacaaacgagaguuuuguucacuuagugauuucagcagauauuuuaaagaaguaguuuaauuugaaaacaauuugcgaggagacugcauaauaaaauaaaucauuggagacuugaauacuuugaguauucauaaaauaauguuaagcaguguuguauuauaacagggaaauauaccauuuucaauaugugcauuucacaggcucccaaacaucaggcaaaacaauuguuuccuaaaacuauuguuaaucaugcuaaauguuuucauguuuacugaaagaaguucaugaccuucaa

SEQ ID NO: 13903 - RNA, 2008 nt, Homo sapiens
gagcacuuuacccuuggaugaaaaaaaaaauguuuauaaaguugaauuacaaaacagacauuaagaguuuuagagcaaaauaaauacgcagacuuacgggugagaccauaacaauaauagucuggggaaauaucuccaacaauggccauauacugcauuacagccauuacaacuuuccaauaccacuuaggcuuaagggucauugggaaagcccuuuguugauguuuguagcgagaaauacuaugagcuaguuuugcuuauuugggccagaccuguucuggguguucaaaagacauacuugucagcauaaagcaaaucauugauuccccuucuuguuaaaauguaguggaaaggcucugaagcccagugaagugugguaccuucaaagaaaguacauauaaagcuccuagaacuuuauuuaauugugcuugcacuuugcuuuuuccuuggaugugucacuccaauaaauacaagacgugcuacauuuucuuuugugcagagcuuucugccuucauguggagagaggaucauguaucuaaggguagaggagcucugaagaggacauagcaacugaaaagugcgaccacccuuaggaggaggucaauauuuuagcuaagaaccaugaaugaaagacuauugcugucugggugagguggcucccaccuguaaucccagcacuuugggaggcugaggcaggcagaucaccugaggucaggagcuugagaccagccuggccaacauggugaaacccugacugaaaauacaaaaauuaagccgggaauggcagcauacaccuguaaucccagcuacuuacgaggcugaggcacgaagaaucacccgagccugggggacggagguugcaaugagcugagauccuaccacugcacuccagccugagcaaccgagugaggcugucucaaaaaaaaaagaaaaaaaaagauuccugagcgguaaauuucgcuaacugaaagaacccuuuaccaauuugacccuaccuguugaaaauacagaauaauuuuuugucuucaauguuggagauucgucauuguucuuacccaaagaaagacuuugugcauuuagacguaaaauguuacugaucacuguuccuagcucuaaaugaaguuugccuagacugagccacagaagccuccuacuacaugauguauauacccuguacaagauaauagucauuugcagaaaauaaguuuuacauuuggccuucuggccaucugauauuugagugccuugaaaggggaaacaauucuucccuugaggaagaagugcucccauacucuugcauucuuagcaguagggucaaugucuuacaggaauauaaaaguccuugaagagacaucuguuaagugugaaauagagcuacauggcaauaaaagaagacacagcacgaaguaauggccugauugaggucaacuucgaacaugagguuugagguguccuauagcaauaaaguaucuucaaaguuguuuaugauaguaaaaacaucuugcaguuuaauuccaugugcaauuugcuaaaugagcgugaaaguauagccauacauacauaacacucaacaauacaaucaugaaagucggcugcaggccgggcgcgguggcucacgccuguaaucccagcccuuugggaggccaaggcgggcggauaaccugaggucaggaguucgagaccagccaacauggagaaucgcuugaacccgggcggcggagauugcagugaucccagaauccgagauggggacuguacuccagccugggcaacagaacagacucugcuaaaaaaaaaaaaaaaaaaaaaagucggcugcagacggcgaaagugaucucggaaccuuuauguuggggaucuuuuuucgggagggaccggaaaagaggugggaucguuugucgcgauguggaguggccguaagcugggcuccuccggggguugguuuuuaagagugcuggggccuggaggcuguaauacaaaagcugcgcgucccuuaauuuccucggcg

SEQ ID NO: 13904 - RNA, 137025 nt, Homo sapiens
ggccccagagcgggaagaggggacggcgcgacugugggugugaacgaggcacucacuucgcacucacuggaguaaauaucuucucuuugguccggccagaggauaaacccauaguccuuaaguccucuccuccgccucagcagcaguucuguuuuuuuuuuuuuaccaggccccgccuuucagccgaacgcaccaauuaaagguacaaaaaaaaaaguuucucaguaccucgucccggacugacggacucucgcgagaauucguggggcuccgacuguuuccgcgcagauaucgcgaggcgauugguagccgggggagggcugcgccguggccccgccuuuccggagcgcgggcgcgcgguggcgggaauuucgccuguuugcgguuuagaccccaaagauuccuguugguggucugggucacaggaggcagguuucgggagcuggaaaugugagcggguacgacaggcaccgcggguaaccgacgccccggguccuugcugcagccggguacgcgggauaccggcaccccgccuucuccgcccgagugcugccaggcgugggccuggugggucucgccuccuccuuggagggucgggguuggcccuagggguugcuuuccuaauuuccaccccgagccggggagggagcguucuccacccugcugcugggaaacgggcggagagugguuuagaaacguugcggagggcgcaguucuaggcaagcccgggacgcuauguccugcagacauuucuuugcuuuucaccuuguccugggcugcagagcccgacuuaguggccggauuucgaggucccugccacagccaguugguugugcauuuugucuuaaguucugacagccuugauggacggagggcgagggggaauugggaauuuggccucuggguuuguucguuuguuuuuccuuccugcuggcggacgucuugagaacuuucugaaguaauccccacucucucggccccacccccccccccccaacaggaaucucuucacaccuucucuuuggagcccuuaaugauacgacgaaccccaaguguuucagaacaugaaguaaacaauggagaacuguucugcugcaucgacguuccugacugacagcuuagagcuggagcuggggacggaauggugcaaaccuccuuacuuuucuugugcuguugacaacagaggaggaggaaaacauuuuucuggagaauccuaccucugcagcggagcccuuaagcgguagguaaaacucagagacauuuucccucaucugauuauucaccaguuuuuuaggaauguuaguuauuucagcccauuaaacuuugguguucaccaagucguguuuuauaaaucagcuuaguauaucauaaggguacaaaugauuaucaguucugcuggcuucuugguaagggcauaucuaaaguauuugggguauuagggaaaacuuccuugguaacugauguucccuuacuguagggagcugggcacuaauuuuucuucuacuuaaaaugaauuccuaacuaucugagccuuuugcaguaguauuuccuucuaaagagugugauaauauucuagagcuuuccaguaauauuuaagagagacaaacauuuuuuauugccccuguuccuucuaauccuaccugcacauauagaaguguauagacuuauuuugccuugggcagguacauauauauuacaguaaaacuguucuugaaauauuuugguaauaccugcugaggcaguuucagugaggaaacuauuuuuguugaccuuauaguuguaccuuguuagaaaucuuaaauagaauacucaacuucauuaguuggauacuauucuccagacauggcucagaauaacuguuagcaguuuuaaaauuaaauguccccucaaaggaugaaauucuacaacugaagacuacuggugaagacaggcagaaauauguuuuuuagaauucuuguugauuuuuccucuuaaguuacauuacacuuuagucguacauuuuaucaauauagaagauugacguuuuaauacagucuagcuauuguaaucuugaauguguaaaguaccaaggcauuuucugacuuuuuauacaugucauguauaauauggauucaaauaauguaaagaaaagagccgucguauuaugguacuuaguauacuuuuuaugagauugaaacaauuuucauuucagauugauuuugaaucuugacccuuuaccaacuaauuuugaagaagauaccuuggaaauauuuggcauucaguggguuacugaaacagcauuagugaauucaucuagagaacucuuucauuuauucagguauuucuucguuauaacuuucugugaguguagguguuguucacuuuuguaaauuacguuguuggguggcuucuaauacugauauuacaaaagaccagaggaauugugcugguugcucacuugauuaucuuaccaguaacaauaaucaagcagcaaugccugaugaguaaugguuuuaaugaguugcguuuucagaaucuuuauucuuugcauuugacacauguauugacaaauauuuaaggcuuugaacuauaauuuuuagaagaaaauuaaaauauuuuuguugugcaauagccauagucuuucagugaucuuuagaguauggucuuaacaaauaaauuguuuagacuguguaauagaaauauuaauuauuuggacaacauuuaaaauuuuuuuaaugaaaaauuuuaagcauacacaaaauaauaauauaaugaacauccauauacccuccuucaguugcaguaaacaacaacuuuuuauuacauuuccuucaucugucuugucuccucuucuuuuggccuaaguauuuguaaggaaauccuaggcaucaugucguuucacccauaaauacuucaguaugaauuucuuaaaaauaugugcuuuuuaaaaacgaugaggacggccaggcgcgguggcucaugcuuguaaucccagcacuuugggaggccgaggcgggaguucgagaccagccugaccaacauggugaagccccuucuguacuaaaaauacaaaaauuagccaggcgugauggcaugcgucuguaaucccagcuacucaggaggcugaggcaggagaacugcuugaacccaggaggcggagguugcagugauuugagauugcccacuguacuccagccugggugacagagcgagacucugucucaaaaaaaaaacucaucucaauuaauaaaaauuaaaguucuucauuaucauuuaagacacaguucauauucagauuuuagguaauuuuaaacaggagucaguuauugaaagcuaauuauuccaaaacacaguaaaaaucuauaugugauacauuuaaaggaaaauggagagguggaaggaauucucucaccaucaucccaugaaaccuuuugaagagacuuaaacuguaucuacgccaugucauacguuuuauugauagaacaggcucagugagugauccucuguaauccugaagauuacagaaugagcgagucuuuaucuaggacauagguuauaaauauggguuaauuuuuaaagacuuugaaaucaacuaggaagaauagcaagaaauugcuaucaggaauuaagauggaacaugauaaauaacagcuuucccugauacuuuagucuacauuauuccuuuuuugaacuucuauuguauaacuguaugauacaguuuaaaauuuuauuauguaacuguuaaccuagaauguuuuauguaucuuaaacuucuuuuuuuuuuuuuuugagagggugucucacacugucacccuggcuggagugcaguggggugaucuuggcucacugcaacuuccgccucccgaguuuaagcgcuucuuugccucagcuucccgaguagcucggauuacaggguccccccaccacgcccggcuaauuuuuguguauuuuuaguagagauggggucucaccaugcuggccaggcuggucuugaauuccugaccucagguguuccaccugccuuggccucccaaagugcuaggauuacaggcgggagccacugcaccccaucuuaaacuucuuuuuuuuuugagacgaagucuugcucuguugcccaggcuggagugcaguggugcgaucucugcuuacugcaagcuccagcuccuggguucacaccauucuccugccucagccucccgaguagcugggacuacaggcguccgccaccaugccgggcuaauuuuuucguauuuuuaguagagacgggguuucaccauguuugccaggauggucacgaucuccugaccucguaauccgcccgccucggccucccaaagugcugggauuacaggcaagagccaccacacccggccguaaacuuaaagauauaaacaguaucuugcugauggugaaggcuaugguauuugaaauaauuuuugagauauaugcagucuuuaauagauaauuuuggaaggucaggcaaagauguauuuuaucuuuucuuaaaguuuucauuaccugaagcugauccuuuaauuaacauucacaagguauuaaucaucauccccaaauuaaagagguauugaagcuguguaauuuggaaacauuguccacguaauuguuacaugcuuuaaaguguucuaaaauuaacucucaccuuacauuuuuaaaauuaggcaacaacuguacaacuuggaaaccuuguuacaguccaguugugauuuugguaaguuuaagguguguuuaaugcaaaagggaauggugcuucauuauagugaguugcacauggguccaugaugguauaauuggcauaucaugauaauacagaggaagcauuaggccagaaguuuacgaauuuaguguucagaaaaguaugacuuuuuaaauuuuguuguagcugagauauauaguauuuucccaaaucuguagauuuuaaagguaaaaccgacuuaagcuaaaauucucugaagagaauuaguacuuguuuuggagguagggagugggauagagaacuuaaaugagaacuaaacagugccagaccucaugcugucuucuugauuuucuuuucugcuuucugcuuuuguguuugcuuuuggugugugauggauuacugauuuuuuuuucuuuuguuuagauugguauaguugguuuuuuuuugcuuuuuuuuuuuuugauagggaguucugcucuuuuguccaggcuggagugcaaaggugccaucucagcucacuguaaccucugccccccggguucaagugauucuccugccucagccucccgaguagcugggauuauaggcaccugccaccacccccagcuaauuuuuauauuuuuaguagagaugggauuuugccauuuuggccaggcugaucgcaaacuccugaccucaagugauccccugccuuggccuccugaagugcuaggauuacaggcaugagccaccgcauguauagcuaagguaauaaagggaauugaagggcaguguguuuuagugcagucuggcugcuucuccuuucuaguaauuuuggugcagugcaguguuuagaaucauggccuugucacccuggcuuccaacccuagcuaauugugggucuuacgucaaguaauaguucuaacuuuguugagcguguuaagugcuuaacacagugucuaccauuauugaugccuagcaaccaaagacuaccuggaacacuuuuggucaaacagagguuuauuagauuaugaaaaaaggaaaaauacacauuacaaggaaaagcuggggcuugucaguaagagggaguaggaagggacuugugauauguuuggggcucauucuggugauuuuccguagggcuuaagggggauaaggcuauauucuggauuggaugcuguuaauuagcaggggcaauuugaagaguggguauuuuaauuuuuaucuaggaggugagacaaacaaagggagcauccuaauuaguaaaaaaguauuguccuggucacuggaagagggaggauguguuuuuuuguucauuuuguguguguguguguguuuuguuuggagugugugugauugcauagugccauguuuuguauucagacaugguuacagagguuuuguuuuugucuuguuucacuguaauggaguggcccuguaucauuauuauuuauuauuauuauuauuuuuugagauggagucucgcucugucacccaggcuggagugcaguggcaugauuuuggcccacugcaaccuccagcccccuggguucaagcaauucuccugccucagccuccugaguagcugggauuacaggcgcacaccaccacaccuggauaauuuuuguauuuuugguggagaugggguuucaccauguuggucaggcuggugucgaacuccugaccuugugauccacccaccucggccucccaaagcgcugggauuacaggcgugagccaccgugccuggacuauuuuuuauguuuuaugaaaauuguuuauuuucaguaggggauaccauggccuagcuguuagcuaucagcuuuuaggcuguuuuauauuuuuuguuuucuuaauauguuacgugauuuguaaauguuaaguauuauuguuucauuaucaucugaugggucccugguucaugccagguacuuugcaagguacugacgaaucaaagaggaaaaauaugcugcugaugaguuugcaguuguguagacagcuagacaugcaagcauacaucagcuugguaaaugaaaagguacggugauaaaggaauguacaagcugcuguggaagccaagggcuuugucuaucugugagcuccucacuaaaugaugccagaucugggucuucacagaugggaagaaauuagcuaggcaaaagauuugggaaaaguuuuucggacaggaagaauuccaggcagaaaaaaauaaaacuguauaaacaaagacgugauguguguaaaaacauaaaaguuuagagagcauggauuaaauauuaauuacauaugguuggaucagaaugugugugagugaugaauuuggaagggauaaaagcagaguuggcuuuguaaaccaugacagagaguaugauuuuuauuuuggaacuccuguggagccacuaaaagauuauaguggaaagaaccaaaauaccuuuaccuuuacguagaauaacuuaaguaaauuggguucauggaaggcauuuauuaugauagauuauuauuauuacacuuauuaaccugaaaccacugcaguggacuauuuguuaagaugguuguuuguuacacugacauuuuggcuguuuuuguugcuuaaaaaagcuuuuaaugacagauuuuggacaaguuagugguguuaaauauuauccauacaugaacaugucccugccauguagcuguguucauuaacuuguguagcuacccuuggaccucagcugugccaagaagucccuauguaguuacuuacugccagaugaguauaguucuuguucuagccauuaugcuuccaggguuaauuuccaguugaggcagaauaacauacuuaaugacauguuuugcugacagcuguuuuuuuucucucuuuccgucucuuugucucugucucaagacagggucucacuccaucgcccaggcuggagugcaguggugcgaucaugacucacuucagccuugaccuccugggcucaagcagauccucccaucucagcuucccaaguagcugagacuacaggcucacgccaucaugccugacuaaaauuaauuuuuuguagagauaaggucucacuauguugccaagacuggucucaaacuucugggcucaagugauccucccgccuuggccuccuaaagugcuagcauuauagguaucacccaccacacucagccaagagcuauucuuaaauauaauuguugguguuacccugucucagcuauuguguguguguuuuuuuucucuagacauuccuuauggauuuuuuaaaaugucuucuguuucugacuucaugcuuguuuucauccaucuugaauauauggaguauacauuauaaccacuguuguugcugcuauuaauaauucuucuuuuugagagggcaucuugcucugucaccaggcuggagugcaguggcgccaucucggcuuacugcaaccucugacucccugguucaagcaauuuuccugccucagccucccgaguagcugggauuacaggcacacgccaccaugccuagcuaauuuuuguauuuuuaguagagacaggguuucaucauguuggccaggaugaucuugaucuccugaccucgugauucgccugccucagccucccaaagugcugggauuacaggcgugagccaccaugcccggccaauaauucuuuuaucacugucauuucugaaacuauuuguauugauuaguuuuucuccugauucugugauauauuuuucugcuucuuugaauauauaguaauguuuuauuguuagaugaacauuguggguuucacauuguugcuuucuggauuuuuauuccuuaaacuagauguugaauuuuguuaugggucgcuauuguguaguuguaauccacugguucuucuugaggcuuguuuuaaauuuugguaggacuuuuaaaaagcagccuuuaauguuaacuuagccuaguaaauuagucuaguaaggcuuugagaauucuuucucgugcguagucuauuaugagauuuuuuuucaugcuugcuggugagaacuugaacuauucccuggcuuguguacucuuuauagggaauuguuuucugguguuuuucccuggcguuggguaauauuuuucaugcuugaacagaucgauacuuaaaucucagagggacacuucuguacccuuccagaacucuauuuuguauagcuucuuucuucuuggguacuuuugcccugcaaauuuggacuucccuaaacuuggaucccauaucuccucaucucaaagagugaguugggcuguauuuggguucucuuccucauauugaagccuggaaacugucucuagguggggagcugguacaguuguagggcucaguuucucucugggagagcaaucuuauauugucuuguguccagagccugaaaacuugcuugacguaauuuuuaugguuuucagcuuuacagugggagauggagcaaucugauuauuuuacuccgucuugccuggaugcagauguucacugcaguuauuuuuaagagaguacugccuuaaugggccgagaauugugaaaauugggaugauaugacuuuuuaugggugaaauaaagccauaaaaaugcaguuuaauauggagguauuuacacaacugcuucacacuuaugcuucuauucugccacaguaguggcaugauuguucauuugaauuaaacuuuaguuucauguuuaguauggcuguaaauuuguagccuauaauucucaucauguuuucuuugcuuuuguuuacuagauugucucuuacucauucucuauauaaugauuauuaguguuuugcccauaguaacuaccuagauaauuauugcugauauaaaugcugaaguaagugagggaaagcugacauggagugagguugggagaaaggcagcaacuauuaaaaggucguucagagcuuuauaaauuauuauuaggaguuuugauuuuauucuaaauauaauagguauucuuucaagaguuuugacuugggaacaagauaaauugauauacauuuuaagcagauuuuuuacuuaguguauagggggacaaaagagagcauggaaagaccugugaagagugcuauuguggugguuuaaguguuuauagggaaaauggauaguuucaauguauauuugguuauuaacuuaauaggacucugaaggauuagauacgagguuaaaggaaaugcaagaaucaagaaccauauaggccacugguggcaccauuuuaugaaaggcugaaaacaaggacagcaucaacagguuuugaaagaaaucaaaggagguauuauuugcacugucugagcaauccaaguauagguguuaggcaguuuaacacggaaggucuggagugcaaaggagagaugggguuguagauaacccuuuuagagucauuaucauuuauuaauaaaggaacugaugagaucauacauaugggaagagauauacagagaguagaggauucaggacugagucuugaagagaccauauuaauaauagaauugaggaggaggagccaauaaaagagguaggacaaaggauacaugaggaagaaagaagacucauuaucuggcaccaugaagccagguguagcuagugcuacugugggagcaaguuacuugaggguaggcacugucuauuagauugggcaaugugggugugauuggugacuuuaauaagagcauuuuuugaggaguagcggggagcaagaaccauaagagaauguuuaauauaaaauguuacaagauagagaauugcugccgguauggcuuacaacauuuuuugucacugcccaugauaauuauuugaacuaugauuaacauugucuauuuugguuucagggaagguaucaacucuacacugcaaagcagacaauauuaggcagcaguguguacuauuucuccauuauguuaaaguuuucaucuucagguaggauaucagaugaguauuuugaucacugcaugaauuucuguguguauucacacagacucuaguuguuuauuuuaucuaauuauuuuuuagguaucugaaaguacagaaugcugagagucauguuccuguccauccuuaugaggcuuuggaggcucagcuucccucaguguugauugaugagcuucauggauuacucuuguauauuggacaccuaucugaacuucccaguguuaauauaggagcauuuguaaaucaaaaccagauuaagguuugacuuguuucauuugauuuuuaaauuaucagcuuuuucuccccacaaggaguauucauucaagaaggagagaaauuagucagaauuacagcucuggaaccugacugccugaguugaaauucuugccccccauccuccuuuuauuaauugugugcuuuugggcaaaugacaccucagccuccacaucuguguaauucuuacaacuuaccagaaucauuggaugaauuaaauaaauucauauacaugaaguuauuaaaacauaguagucauugaaucaguagcuauucucuugauuuaugacaguauaagugucugaaaauuuuaaagcaaaugaaauaaucuuuauuuucugaaauuuuuaucauauauuacaguaagauucaagaucagcuuauaaaaaaaacuuucaagaccacaucauuauguguauucugacuuuugaggccuuuuuggaaugugauuaagauuguuuugacugugcccuuuuuuuccuaccugugauaaucauucccucugaaguuugguuuuuaaaacuuuauauuguuaccgugccuagcuuauagauaaguaauagauucugccuaugaaaaugggagcuuauaugaauaacaaauuaugguaauucacagugagauucccugaagucucaaccccuuucauuauauuugacuuuaccguuuugaauaauauuuacucuuuaugaauauaucuuuguuaaaauauaaaaacggcuaagcaugguagcucaugccuguaaucccaacacuuuggguggcugaggcaggaggauuguuugaauccaggauuugagaccagcuugggcaacauagcgagaccccauuucuacaaaaaauuaaaaaguuaguccagugugguggcacauaccuuguagucccagcuacucagguggucgagguggggggaucccuugaacucaggagguugaggcuguggugagacaugauugcaccacugcauuccagccuggaugacagagcaagacccuaucucaagaaauaaaauaaguagaauuaaauguuuacauauuucugugaaaugaagcagaaacaaguuuuucaucagagaucaauauauguaauaauaaaagcaaaguucuaacugaauuuacaaguuaauauaucuaaucgauagaaaacaaauagguaauugcuuuuaauuacgucauuuaauaaaaagauucaugaguagauuguugagggagggauauuuuccuuacuaguuucuguaaauuggacugguuuuuauuuucugguuauccaucaaauauguaagaaauaaaaaugaauaauuuauauagcagcagaaauaaaaauuugugcacugggguccucaaacuagguuuugccuuucauaggcuuuuuaauuaggcagacuugaaaagauagguuauuugaagcucagaagacuaaauuuuuaaagcaggggaacuuuacagucuucaaaaaauaaaaaaucacacacuaaaauacuguucuuuucugaaacaaaaaagcauaauaaaauaaaaagcaucuuucaagacuuuauauauuuguuauaacagucuuguauaugaaaugucuuguuuuaauugguacuuccaguugagcuucuuuuauuuuuuaagaacucucuagguauauauuaguuguucagaauuauguauugcaaauauuuucuuuuauuuacuuuuucaucaaguaagcugacuuucuaggucgauuugaauuuuuuagauaguuauauuuuuccguuuuuuguuuuaucuaugcuguuaaaauauuuugauuguugcuuuuauuucuuuaauucauguuauuuuuaaacaugcagugaggugagaagucuaacuuuaguuucuugcaaaguuaaaaaucuuauuuuuuauugaaugacccauacuuuucccaucgauuucagaugccacauaaauuuauuucugucuugucuguucuugcuguuuguuaucuauuucugucccaauauuguuuugucaguguagcauuuuauuuuguuuguauaccuaauaaggcaggucuacucuucaucauucuuucuauuuguuuuaauggaacauguuaugucauuguauuuauuuuuauagugaugcuaaaugcugacaggaggaagguuauugauaacccaguauaacacaauacuugaaagugcuggguuuugacucagguagaauugaguuugaauacuaauacaugaauugagagguaaauuuuuucaccucuuuuaacuucuguuucuuaaugagaugacaauaaugucuacaugacagucuaaaguucuuuuguuaaaauauuuuauaggaguuccuggguacucauacauuaaaaaaaauuuccuagcuaaauucuaaaacaaaauuaugaaaauacguguuaaaaaauucuuuuacugccuugcagcuguaguagaaucagagguugguuggaagguaccuuuacuauacaagucuauucagcagccccaagguggguuugucuuaaaccaacagaugaaaauauuuccugcuuucaaagaucuucagugaaagaauccucuaaugaacaagacagagguuuucccugagcuuuugaauagugguagguuaauugguucuuuauccuuguguuuauggaggaguauugugacaugcuaugaaauaccuaguaaaauauuaaugaauucucaaucacaguugauaaugucauccacagcuuuuuccaccgucauggcauuuauuacaucuccacuuggauauacauuggcuggugcuagaaauucuuuacaugcugggugaaaaauugaguaaguuuauggauuuaugauuuauauucuuuuuaaaaucagcuuuuauugcuuuuuaaaauuacauaaguaauaagugcuuucugauauuuaaaaaaaaaucaaauaguaaacaaaguaugaaguaaaaguuuuacuccuuucuuuccagagauaacuauugggaacagcuugguuuaucuuuccauauuuaccuucuaucuguuaguauacauauauagaaacucauagguaaaauuuuguuuuuguuuuuaaccacagauaugaucaucauacuguucagugugaucuuucauuuaucaguguuuuagcgaucuguuuauguuaguaccuauaguucuacuuuauccauuuaaaggcugcauguuaugguucuacuauauuuagccaugccuauuuuuaaacauugaaguuacuuucauuuuuugauuuuacaaaucauuuuucacugaacacccuuguguauagaaauauaucuuuaaucugcguacaaguuauucuguaaaauauucuuagaaguagaguggcacaucguaguuuuaauauguauaugcugcuguuuugcugaauaguaaguccugcugauauauaggcauuaacuguagugugccuuuacuucauacucuugccaguaguugauauuaucaauuauauuuuauuuuuugccagcuaacaugugaaaaaugaaauggcuuuuuuuuaucugcaauuucuugguuacuagugaaguugaacaucuuuacguuuuauugucuauauuugcuuuauuaauuacucauuguauuuugcaaauuuuccucuuuuuuuaguaggaguuuauacauauuauggauaaauaucuuuuauccuuguggauauguugcccauuuauuucuugauguugcucuuuggcauuuuuaaguuccauuggcaaccugucacuuagguuguaaagaugucuguuacuccuacaccugcuuuucuguuaauaaauacauacauauauaugucuauauauguauauacuuacauauauaugucuauauagguauauacuuacauauauucauacacagaaacauaugaagauguacaccaguauauaauuuccucucauguggacucuguauuucacauuaauauauucuuagaguaauacucaaguggacuuauucugauaaguaaaaauuuugguuaucuauuaccuugguuugcccuauuuuaugccauaaaacaauugcaugggaucaguuuaucaguauuuguuaaaaaaauaauguuuuaaaggcuuuguugguuagaaauguggaugaagauuuuauguuguucucucucuuuuuuuuuuaaguuguguugcauuaaugcuucuuaaagauagacuuauuaggaaaagagaaguuuauuagauguuacuuggaagaauuagaaacuuuugggcuggacgugguggcucacgccuguaaucccagcacuuugggaggccaaggugggcagaucacaaggucaggagauugagaccauccuggcuaacacggugaaaccccgucucuacuaaaaauacaaaaacagaauuagccaggugagguggcgggugccuauagucccagcuacuugggaggcugaggugggaggauggccugaaccugggagguggagcuugcaguuaucugagaucgcgucacugcacuccagccugggugacagagaccucgccucaaaaaaaaaaaaaaaagaaacuuuugaagauaauguuuaucagugcucauaugagaagguuguccucaaauucauauuuuauuugcaaaaaaaaauuaaaaacuguauguuuuaguuuuguuauaauuuaaagauguacagucacuuuuuccuuucugacuuaguaaaaucuguauuuuaaaacuauuuuuauuacauuuucagaacaaguuguauauggucaucaguuuaugaaucuggcaagugacaauuuaaccaacaucagccuauuugaagaacauugugaaacucuccuuugugauuuaauaagccugucacucaacagguacgacaagguaaugcuuuaagaguuuguauuuuugagacuuaaagacaguauucaguccuuaaugcaugucguuuaaucuguaagaauuuaaacuaaaaugcuuuauauguucuaauuuuauauuuaguugcuauuaucugggagcugaaagggaaaacaauuuuuauuuaaacaucuaaaagaggcuggaauugguauuuuagagcuuuucuuuuuuucuuuuuuuuuuuuuuuuuaagaaaaauagccuuuucuauuuugacaaaaauaaauaaauaaaaaugauguuuaccgaaaucacuggaagccuaauuucuauccaaauaguagaggccagcucuuuaauaauguauuguauuacuguuguguaauaauaaaauaaaugcuuacuuaaaguuacuuuacacauuuuaagagaggauuuucuugcuuguuuucauaaaaggucucgaaucuggguaaaauuauguguuuuuauuaaauuauguuuaucauagaguguuuaauggagacagugauuuaaaggugcuacagaacauguuuauuuuuaaguaguauaaauguuuguagaguauuaucuguuauuuuagauuacaagcguaaagacuguuuuugggaaaucaagauugagggaaaaggaguuuuauaauuuuucaaaauuuagauuuuuuuaugcauuaucaauauuuuuacaauuuaguguguauguguauuaguggauuaaccagauaugauagaauaacuuuuaaauauuuauuuauuuuuguuaauugacaaaauuauacauauuuaucauauacaucauguuuugauauguguauacaguguagaauggcuaaauauagcuaauuagcauauguauuaucucacauucuuauuuuuugugugagaacacuuaaaaucuaugcuucuagugauuuucaagaauacaauauaguacauuguuuuuaacuguagucaucauguugagcuuauucccuuaucuaacugaaauuuuauaugcuuugaucaacaucuaccccgccucccuccuaauccuccucacagcccuugguaaggaucaucuuacucugcuucuaugaguucagcuuuuuuagauucuacauauaagugagauuauguguuacuugucuuucugugccuggcuuauuucacuuaauuuaauguccuccagguucauccauauuguugcaaaugacagcauuuccaucuucucaaggcugaauaguagggucauacacuguguaacaaaguuuuagucagugacagaccacauauacaagguagcuauaccacauagccuaggugugcaguaguaggcugaaaaaguuuaaguacaauaaaucauguuagccuaaagacgugcuucucagaacauguccugcuguuaagugacacaugacuguauuccauuguguauauaaaccacauuuucuuuaugcauucaucuguugauggacaauuugguugauuccaugucuuggcucuuauaaauaaugcugcagugaacaugggaaugcagauaucucuuaaacauacuaauuucauuuucuuugcaaauauaccuaguaggauugcuggaucaugugguaguucuauauuuaauuuugugaggaauuugcauacuguauuacaugauggcuguaccaauuuacauucucaccaaacugugcaaggguuuucuugucaccacuuccucucuggcgcuuauuaucuuuugucuuuuugguaauagccauuauaacagguuugaggugauaucuuaucaaguuuuaauuugcauuuccauaaugaguagugacguugagcauuuuucauguacugcuugcccauuuguaugucuucuuuuaagaaaugucagcuaggcgcgguggcucacgccuguaaucccagcacuuugggaggccgaggcaggcagaucacaaggucaggagaucgagaccauccugguuaacauggugaaacccgucucuacuaaaaauacaaaaaauuagccgggcaugguggugcgugccuguagucccagcuacuugggaggcugaggcgggagaauugcuugaaccugggaggcgcagguugcagugugccaauauugcgauauugugccacugcacuccagccuggcaacagagagagacucugccucaaaaaaaaaaaaagaaaaaagaaaacgucuguuuauauuuuuugccaauuuuguaauuggguuguuuucuugcuauugaguuguuugcguuccuuauauauuuaaaauacuaaccccuuaucagauguaugguuugcaaauauuuucuuccauucucgagauuuucccuucauuccguugauuuuuuuuccuuugcuuugcagauauuuccuuuuuauuuugauauaaucccauuugucaguuuucauuuucauggcuugugcuuuuuggggucauauccaagaaaucauuuaccagaccauugucauauagcuuuuccccuauguuuucuucuaguuuuauaguuucaggucuuacauuuaagucuuuaauuuauuuugaguugauuuuucuguauggugugaaacaagggccuaaauucauucuguauguggauauccaguugucccaaccuguuuauugaagaagcuguccuuuccccgugucaugcucuuuucaucauugucaaaaaucaauuguucuguuuuguucugugucuguuugugugcuagcagcacacuguuuugauuacuguagcuuuguaguauauuuugaagucagguagugucaugccucgagcuuuguucuuuuuugcuaaagauugcugggucuauucaggaccuuuugugauuuccuaccaauuuuaggauuguuuuuucuauuucuguaaaaaagugucauuaaauauuuugguagggauuucauugaaucuguaggucacuuuggguaguauggacauuuuaacaauauuucuuccaauccaugaccacaagauauuuuuucuacuuacuuguguuguauucaguuucuuucaucaguguuuuuuauuuuucaguguauaggccuuuuacucuuugguuaaauuuaucccuaaguauuuuuauuuuuguagguauauacuauauaugggauuguuuuauugauuucuuuuuuggauaguuuguuguuauuguauagaaaugcuaugguauuuuguauguugauuuuuguauccugcaacuuuacugcauuuauuuauucaaauaauuuuuggugaugucuuuagagguuucuauauauaaaagaucauguuaucuacaaacagcaacaauuuuaacauuucuuucuguuuagaugccuuuucuuucuuuugcauaauugcuguggcuaggauuucuaguaacauccuaauacuuuuuuuuuaacuuuguauuagguuagaaaaguguacauaacuuacguaaaauauugcauacauuauuaauuuaagaagccuagcuauauuugcaaauauaguguacauucugugcauuaucuagggcugcugaggauuuuuuuauuaaaaaaagguagauaauuuagaaauuacugaaucuuuauaaaucccuaauaacuguauucauucugucuugcaaaauuuuuacucuguuuacagugaaucaaaauuuauuuucuaaucuuuucauuagaagucuuuuguuguagaugacucagggcaaaauaagcaaacuagcccugagguguaaucuagcccauuaccuauuuuuguaaauauaguuuuacugggauauaaccagguccauuucucuuaccagguaucugcggcuguuguacugaaauggcagaguucaguaguugugacagagacuguauugacaacagacucuuaaauauguccuaucuggcccuuuauagaaaaaguuugcuggcugggcgagguggcucaugccuguaauccuagcacuuugggaggccgaggcggguguaucacgaggucaggagaucgagaccauccuggcuaacacggugaaaccccgucucuacuaaaaguacaaaaaauuagccgggcgugguggugggcgccuguagucccagcuacuugggaggcugaggcgggagaauggcgugaaccugggaggcggagcuugcagugagccaagaucgcuccacugcacuccagccugggugacagagcgagacuccaucucacaaaaagaaaaaaaaaagagaaaguuugcugaccacggcacuagaugauuaaaauuuuuuuuuaaguugaaaucaaauuaaucugugcuuuuuguuuuaaaauggaaauuugucuuaaaaguuaaaugaaauugcacauuuucaauaaauaauuuugucuaauugagaauaaauucuuagucaucuaaaucauucuuuuaaaaguauuugaaagauauauggcauuuaaaauucugcugcugucuuauaaauaacacauuuugguuauuuucuauagguuaggucuucugaaucauuaaugagugaccaguguccauguuuaugcauuaaagaauuauggguucuacuuauucaucuucuagaccacagaaguaaaugguuugucucggaaguaaguuggaaaauugauguguugguuauuguuacuaaccuuuauauugauuuaauccaaugguuuuaacugagaaaaaucuuaacuuccuuuuuuauaauaaggcaauaauaaccaccaauagagcaauaacugaguacugaauaucuacuuuauuuuuaacccuaauuauuuuuagccccaaguuaguaauaugaaaaaucuaagagcaguacaagguucaacccuuacuuuuuuucaaguuuuguuguuguuguucuaucagaaaucuuucagacuaagguauuuacuacccauuaguaaccuagaaaacauuuuagucaggaaauacggcagauuuagaagauuuguggagaaauaaaacagguuucuauuacucaauuuuauagcaauuucaaggagggaggaagagaagcagaaaagggaagaugagaaacuuucacuucauuuucagucaugucuucagaacagggcuuuauuuuauuucaagugcuguagguuauugaaaaagagaaguauccuaggcagaaguaaguaaaacagucuguuguaaaacgguauuaaaaaugguuuauguuauaugaaaggguacuuuugauuuuucauggauuuuaaaauuuuccaguuuucuguaauuugggguuugggugcugcuaucuuuuuuuuuuuuuuuuuuugaggcagucuugcucuguugcucaggcuagagugcucacugcagccuccaccuuggcaugaucucggcucacugcaaucuccgccucccaguucaagcaauucucgugccuuagcauccugaguagcuaggguuacaggcaugcaccaccguggccagcuaauuuuuguauuuuugguagagaugggguuuuaccauguugcccaggcuggucuugaacuccugaccucaagugaucugccugccuuggccucccaaagugcuaggauuacaggcaugagccaccaugccuggccugcuaucuuuuuuuaauaacaacucuauuuuuguagguuugcaaguacuguauuuauuuugaauuauuauuuuagcaucaaauaaauguaaacuuaauauauuuuuguuuauugaguaaaaaaauuuauuuucauaaccuagaggcaguugcugaauuguguaaauuugaacuuuggcuuucaggcauuaagggguacaagaauagaagauaaaguucagaguuuaucaaguugguagccuacaacuacaccaguuauccauaaaacugggcacucagaaagaugaaguagaaacucaacuagauuuguaaggaaaacugacugucuuuaacuguggugcuuuucagaaguuuaaaauugcgucuguguguuuuuuguuguauucuagcccuuauguggguuuacagacugaguucauguuaccuagauuuuauuaaaaauuucaaaccauugagcccaggauaucgaggauacagugagccaagauugugccacugcacuccagccuggaugacaaagcaagacccucucuugaaaaaagaaaaaaaaauuucaaggcauugaauucuggguagccaagaaaaauggauggaugccuaaacccacaucucccuacauaaccuuccaacaaaauauagaacagcaaaaucaaauauaucuacuguugacucuugaacaaugugggaguuagggaugcugaccguccccccaacaugcagucagaaaacugcauguaacuuuugacuuccccaaaaaaccauugguggccuacuauugacugcaauccuuacccauaacauaaagaaacaauuaacauguauuuuguauguuguauguauuauauacaugauaaacuagagaaaauaaauguuaagaaaaccauaagagaauauauauuuacuucucauuaaguggaaguaggucaccaugaaggucuucauccucaucuucauguugaguaggcuaaggaggaggaggaagaagaggagggguuggucuugcugucuucggggugguagagauggaagaaaauccauguauaagcgcacccaugcauuucaaacccguguuguucaaacgucagcuguauacaaaaacauacguauuauauaacugcaaaugggagugcuuaguacugucaguuuuaaaaacagaaaaccucuaaagcucuuaccacgagccuuucuagcaaggcagggcagucugagaaaaacuacucugagaagagaacuaacagugguuauaaaacugcuuuaaaaucauugccagaaugugaagauacugaaaaaguuuucuuguagaucggagaacugauaagaaagaaacauaaaaguguccacaugacauggaguuucuguagaaggcaaaaaugaaucaugguacccauuggugauuggguggugaagggcaccagaagagaaagcagaaaauuuagggucuuaaaacaccaccaccaaaaaaagaauaaaucaaaggacucauacccucucccaccaccaaaaaaaaagaagaaagaaaaggaaaggaaauucaguaaagaaaugggacuuuggugcauugucaaaagaagguaacccugaauuaagaaucuuuuaagcuaauccuaaucuacaaaaugaauggaaugaaacuagaccauuauaaacuuacuagaagaaaacagauuugauaacacuuuaguugaugguacccucucccccagaaacaaccauaaaacagaagaaacugacaacacuguagauugaauuaguuugucuguucagacuacaucugggaguauagaaaaacaccuugaauaagauacucaaauguuaaaaacaaauggacagaaaaccggggauggauggaaagaauacauucaaugcaggaaagaaauaggaagaggaaaauuauauccguauugacuaaauuacaacaugacugagggagaauagacuuaaaugaaaauuuaauaaggggcauagaagaaagguugaaaacaacuaagggaauaaaaaugagauaaauaugaagagagugagaaaaugguugagauggaagguaggcaaggaggaaauaacuguacauauaaaugcaaucccuagagaagaaaacagugugauauagcuaauauuaaaaacuauaaucaaaggaaacuucccagaaauaaaagaucuaaaucuacguauugaaagggucugcuggauaauuugaaagauuaaccccaagcaauccacccgaagacaagucuuacuaaaacuguuucacuuuaaacauaaaggaaaaaaucuccaaguccucuaggcacaaagaccaaacaacuuauaagagcaaaauaauuuuauuggcacuagacuugcaaagucaacuuaaaacaaggccucaaugcagcauuuaaaaugacucaaugaaaaagugugagccaaggauuuuguaacuuugacccuagcaaucccacuuccaggaauuuacucuaaauguguacccuccaaaauuaaaaugcauaugcauacguuuauuuauugcaguauuguuuuuauaauaguauaguagaaacuaaauucuuauauauaaaagaguaguugaacaaaccaugguauaucuguacucugaaguauuauucuguauuaguguguguucuccagagaaacagccaauaggauauauagauauauauauauauauaagauuuauuauaaugaauuggcucgcagaguuauggaggccaagaagucccgaaucugagguuggcaagcugaagacccagaggagcugaugguauaguuuccagucucaguccaaaggucugcaaaccaggaaagccaaugguguaauuuccagucugaguccaagucugaaggcaggaaaagaacaguguuucaguaugaagcacagggagucuucucuacccucggaggacuuuuuguuguauucaggccacuaauugauuggauggcacccacccauauuagagagggccaucucuuuacucagccuaccaauuaaaauguaacucucaacgagaaaaccuuuauagacacacucagaauaauauuuaaccaaauaucuuggcauccuguggccuguucaaguugacacauaaaauuaaccauucuauuuguaguuguacaauagaaugaggaagauaucugaacugauacggagugaguugcagaauguauuguuaaaugauagaaauaaaguucaaaacuauaggaugauguuaccuuuuguauaagaaauuaggaaaaaggcaauguguguguguguauauauauguguucaauugugcacaaauaaauacuggaaagacaaacuauugagauugguggguaaaaauaaagaugggugggugaaaauggaguggaaggguuugauguaauuauuuggguaguucugacuuuagaaucguguuaauguuccacaugcccuaaaauuaaaucaaucuguaugaaaggugcacucaauggaauauaacagaaacaacugaacuuaaauguauuuuaaaugaauaacacucuuugaggggauuggcaauguuaacccagguaacuuaagaauguacuauuuugacacuauacuauaaggcuaaagacaaucauaaagaauuguaaauacuuaggagauuuguuuuuuacauuguuaugugaggauuagcaauuuuaaaucuauuauauuuguauucuuggacuggacaaauuaauaaauacauuguggguaauuggagucagguuugucuguguuggggaauugaguuacacauauggaaagaaggaaagccagcaugaagcacauuauguuggauuagaauuuguuauaguaugcaauacuucuuuuuaauauauaggacuauauauaaauguauaugugugugugugcauaccuccauuuccuaccuuuuucacugggugggcuuacaagcaaugauacugaguaacaauauacacauugcagcuauaucuuaguuucaaaauaaccauucuguagugaaaggaaacgagucuuugaacaaauggcugauuacaggaugaagcauggaaaguaaacaugagccugaaacaucuuguaccagaaacuaaggaagugcucaaaaaaugaugaguacaugucagaaggacaugagagucagccuuaaggucuauaggcuaaaauagcuuuauuuuaccucacuuuuuaaagauauuaauagguaaagaauuuuagguugacaaauacuguuuugauacaauaaggauaucaucccacuggccuccauugcuguugagcuacaaaauaguaagggauuguaaucuguucacuaggaaucugugagucccuacugauauaaacaaauugggaaaagggaagcucuuccuaauagauguagagucaugauggaauuagaaaaucaccauuugacaaccuccaugguaauuguuucaggcaagaauccucaauggaugcuuaaaguaguggacaaaacugaugaaaaacagcacauuuacauaguuuguuaagaucuuuacauaauauuuaucaauuauaaaagggaaaauaauaacuuuauaguacagaaaauguggcagguacuaccuuaaccaagcaaucaaaguuaacuaguaauaggacagauugauaucauguaccaucaauaugaugccuugaaagaacaaaaauagaccaggugugguggcucaugccuguaaccccagcacuuugggaguccuaggugagaggauugcuugagcccaggaguucaagacugggcaacauagagacguaaucuuuacaaaaaauaaacaagauuaccuauguguggugguggcaugccuguggucccagcuacuugggaggcugaggugggaugaucacuugagcccagaauuuugcaccagugcccuguagccugggcaacagagugagacccucuccccccacaaaaaaagaauaaaauguguaaugucagacaaaccugaaaaacugguauacucuaaaaauaucaagguuaugagugguauagucugaggaacgcuuacagauuaaaguaagcugaagaaacauuaaaugaugggauagcuaaaugcaccuuaugauugcugcauaaugguauaguaggcuaauuuugaauaagaucuguuaugcauaauauaacaaaagauggaaaacaugaaagagugguuaagagacauuaagaauagagaggaugucugauauacuucuaacuauaguuaaaaaggaaguggaacaacaaaaauauuugaagaaaaaaugacuugaaaauuuucaaauguuagugaaagcuaaucagauaaauucagugcacccacauaggguaaauaaaaagaaaaaacacacccagauaacaucacaguggaaucacagaagaccaaagacaaagagaagaaauuuaaagcaucuuacagaaaaauguguuacuuuauuuuauuuauuuuuuuaagagagaaggucucacugugucacccagucuggagugcaguaguguggucacagcucacugcagccucaaccuguugaacucaagugauccuccugucucagacuccuuaguagcugggaguacaagcacaugccaccacaccuggcuaauuuauuuuuuguagagacagggucucacuggucugcccagguuggucucgaacaccugaccucaagcaguccuucugccuugcccucccaaaguguuaugauuacaggugugagcugccacagcuggccaauauaguaccacuaaaagagugacaauugggcagcugacuuuucaacaacaauggaggccagugggaaugauauccuuauuguaucaaaacaauauuugucaaccuaaaauucuuuaccuauuaauaucuuuaaaaagugagguaaaauaaagcuauuuucauugaagcaaaauugaagagaauccugaaggauauuuaggcagaagaauggugaugccaaaaugggaauucugacauguagaaggaauaaagagcaaagaaagugguacauguuuuguauaaaucaguaauauaauuuauuggaauuaaaaaacggcuaaagcacauaguaauaguaccaucuaaagugaguaggacauaaaugagcuacucuuuuaagguucuuguuugcucuaagagaaaggucuauguuaauuuaccaagacauuuggauguguaauguuuauuucuaagaucaucacugaaagaagaaaaguagacuuuuuaacuuccaagcagguagagggggaaaaaauuaauauucaaccccagagaaggagguguugauggauacaguagguauacaaauagaaauauggaauaagauuguagauuuaaaacuaaauauauuagucauuauauuaccugcaaugguacuacuaaaagcuccauuuaaaagacauauugucaggauauauucuaaaacagaauauaucaagguucaaaauugauagaaaagauacaagaaagugacguauuaaacaaauauuggaaaaauuuugacuuuaaaacaaaaaagcauuaaguuguuuuauagugaugaaagguuuacuuuaucagggauaaauuuaaauuugcauguggcuaauaacaugguguuaaccguagcaauuuaaaauggacagauuuucaaggagaaauacacaugcauagaaauaaugaaauauauuucuaaauaacucauaaguuaaagaagagaugauggaaauuagaaaauauuccaaaguaaauaacauucuguaaacuaaaguuuugggacuacagcuaaaaguuauaauuagagggaaauuuguaacuguauaugcaaauacaggaaaaaagaaagauugcaaaugaacuaauaauuuaucucaagauguuagcaauaagcccuucauaguaaauccaaagaagguaaaaggaaugaaauuauaaaaauaacaaaaaauuaugaauuuaaaacaaugaaaaggauaaaaugagcaaaaguugguuccucaaauugauaccuaaaauuggccaauguuacuuaagaugguuacaaaaauacucaauacuagaaauauaaaaaggaacaugacuucaguuucuguauacauuagaaagguaagagauacugucgacaacuuuaugucuaauaacuugaacauuuacaugaaauaccuagaaaaaccuaaaacucacuaaauguucugcaauaguagauugaauaaauguuuuaucauauagucauauacuggaauauugcaauaagcuauggcaguuuucauuaauauagaugaguucaucagaaacgcagcauugaccaaagaagcaaguuacaaaagaauuagaaacaagccgcuugagaauacagacaugcauuuaaaaaaaacaaaauacagaugaagccacacaauauauaauauaggcugguauaccuguguggcgaaacaaaaaagcaaggaaaugauuuaucaugaaagucagcaaaauuguuaacuacuggauggaggaggaagauguggugaccuguaagguacuucuaaaguacuauuuauguucugauucuuaaccugggcauuuuuauuauuucaguuuuauauauguguuuugucuuuuguauauaugcuucauuauaaaaauagagaaaaaccacgaaaucaaagguuauugaaacugucuuaauggaaucaaauuacuucuguuucuauagucauuuuggaacugguugaauaaacuacuuaaaacacugcuugaaaaaucaagugaccgaagaagauccucuaugccuguaauccaguccagggauccauuagguuuuaguugguggauuauuacucauguagcaucauuuuacaaguuugaucgccauggaguaccagaugaaaugguaagacuucauuuuuuaaaaacuuucuuauauugucaauuaauauguaauuauuuggacaaauuagaaaauaagugagcagaaacaagaaaagucagacuacaaucacagagauaaauuauuuauguauaauguuucuguaaacaucuugaaaaauuauaaaguuuauguuuuaauuguuuaauuaaaaaaaauuacuuguagaagauuugguauguaguccuggcccugcuacugaacaauugugugacccugagcaaauuacuuaaaccuuucuagcuuugucuuccguuaacaaaaaaucaugggauuggauugucacaaagauuccuucuaguuuuaaaaucuauuaugauuggcaaagaaauuucucgaggaaugaauuacuuauuuuugugaauaauuuaauaaaaguacuucagaauagcacuucuuuagugaagcuuuuugcuaagauaacuuauuaaacaaccaugaaguuugcuucaaauacaaagagauuuuaacuaguauauuaauuucucauuagaaacauuuuuuacaguguuacuuaaaaacccuaugaauaaaaucagcuaacagauguuuacuuugaagcccuauuuuuauacaauuucuaccauauucagaaauuaauaguauuguauuauuguaucagccuaucagcuccauaaaauaagcaucuagaaucaugaagccaacuugucuauauuuucaaaauugccauuuuuuauggcagugguuaccaaaccuggcugaucauuagacuugugaguuuuaaaaaauccagguaucuaguccagcugcaguggcucaugccuauaaucccagcacuuuggaaggccaaggcggguggaucacuugagaucaggaguuugacaucagccuggccaauguggugaaacccugucuuuacuaaaaauacagaaauuagcagggcauggugacgcacaccuguagucccagguacuugggagacggagacaggagaauugcuugaacccggagacggaguuugcggugagccgagaucacaccacugcacuccagacugggcaacagagugagacaccauccaaaaaaaaaaaaaaaaaaaauccagauaccuagaucuuaacucuggagguccugauuuggaguuuggaaauccugauuuuuaaaaaguuccuugguucucauccucuacgagguaugggagccauugcuuuaugaaacauauucuuuaauaggcuugauagauuuuccucuuuggaauauuggauagacccagcuuugagaagucauccauggaaucugaggguuaguuaguauuaauauagcaucauagaaauggaaagggucucaaaaaguccucuaaauaauccccguaauaauaaaagguccuguaggagaucccagaauauagugaaauagucagaaauugcucugagaaguucacacacggcccaguaucaguguauuugaguauucuaccaauuuauugagaaaagucaaugaacuucucacagaaaagaauuguauguuuuuuguuuguauccaugauuauuuaccaugcuaauacagaguaaauaauaaauuuuagcaauugccauuauuacuauaguagugcuuuuauuaaguguuuuuguggaguuaaugugauuucacaucuuuuaauuauuagaauauuagaacuauauuaaaggaacuaagaaaauuuaccuguaauucuaaggucguaauauaagcauuugcauuuuucuuccucuccaacuuuaguuccuccaaguauauauuucucauuuuaaucaauguaaguaaguauggcaauuaguuaaguguuucugaguuucuguuguguauuugcauaauauuaggugccuaucagagaauacacaugaaauagauuguacuacuuuuuuuuuuuuuuuuugagauggagucucacucugucacccaggcuggaguauaauggcgugaucucggcuuacugcaaacucugccucacggguucaggugauucuccugccucagccucccgaguagcugggauuacagguacacaccaccacgcccagcuaauuuuuguauuuuuaguagagaugggguuucaccauguuggccaggcugguuucgaacuccugaccucgguuaaucugccuaccucaguuaaucugccugccucggccucccaaaagugcugggauuacaggugugagccaccgcacccugccagauuguacuacuucuugcuucaaggaacaugcuuuuagguuauuaaaaacuuguuggaacuguauuaacacuuuuuugagugcguaguauauuuuaauauuaguugauauugaccccgccagauauucucagugugguaggcaaucuagucacauuaggauauauuguugccauugcuauuguaauauggaauugcagugauauaaccaccuaugguugcagugcugaagucacucuucuauuucuuuuuuuuuuuuuuugagauggagucucgcucugucgcccaggcuggagugcaguggcgcagucuuggcuuacugcaagcuccgccucccggguucaugccauucuccugccucugccuccugaguaguugggacuacaggugccggccaccacgccuggcuaauuuuuuguauuuuucguagaaacgggguuucacuguguuagacaggauagucuugaucuucugaccucgugauccgcccgcuucggccucucaaagugcugggauuacaggcgugagccaccguaccuagcccuacccuuccauuucauacagagaacuccagaggagauuauugcuuuuauuagcucugaaucaagauaguaaaugaauugucuguguuuaaaauagcuuaacuugcgucuuuuaauauuugucagcaguuccugauuuucuuuugccacgauuuuaaaaaaucacauauuuuauguagaagguuuuaaaagaaaaggcugugauaauuaauagaaaaaggauaugauaaaaaugaugaggauguguaauauauauguguauaugcacauguaaaauaaacuuugccuuuauauaugaguccucaaagaguuuauuucuggauuuccuaaagguuuuuaaagaaaagcucucuaguuaauaauaguuuucauuagggguaaaauaugugcugcauuugcaacauauuuaguauuucacagugacuguguauuaucucagugaaauauuuuaaaguaggugagaggguaauauauucauuuuacagguaaagaaauugagauacacagugguuaaauaucacccuauuuuaucucuuagauaaacuugauauuagauuucuccuaaggauugccucuuacgaauaggucuuugguaggguaaccauguguuccauuuugccagguacagacagucccacuuuauaccuuauuaucuauucauccuaacugguuaauuuuugcuuuuauccucaaaguguuucagcuuaauugacaaaucagauagucauucuaauccaugaacauaaaggcauauugacguauuguuucugagagauuauauaagauguuaguuugggucuggaaucuguuuagaauuuugaaaauuuuuuuuucuccuuaugauauauuaacauaagcaacuacaauagagaaaaugguugugcaguaagcaugcuuuauucuacuaacaaguaaucuggagugagagaugauaugaaguaauaauggcuagucauguguucuucaccagagaaauaucuauaaucuuguggcaguguggcgauguuucaguuuuuaaacgugaacugcuuugcccugaagguuaaugugaaaucuuuacauuuuaaauagguuuaaaauguaaaccuguaguggauuuaaaucacaaagcuauaauggauuuaacucacaaagcuagccaauuucuuaguguaggccuguaagaaaaaucugguaucucacuuuuuauauuagagucauuagauuuucuuacguuucuguuuaaugcuuuucucucagacaagaugagaguggguuacucucucacgauucuagucaucuauuuuaaaaccaaauacaguuuaaagaggaaaauuacuucugggcauugcaaggggucaguuuuaacaguguuuucuguacccagaacauaaugcaauuagucaggcuagcugaugcucgucuuugaaucgucugaaauaguaaccagauaaaagugugaaauguaaccuuaaaaugagaguugcaccagacuaccuagucugcuggaaguggaggguggagaaucuguucuacauaucugguagagauccuaccuauacuaacguuuaaauggguaucuuaguuuuaaugcugaaauaagaaauauaaaauguagccucaaauugaugacauccuaccugcuuucuaucagcagauuuaacuugguauguagaaaaaaaaaugcuguagcugcccaaagugaaauuuuauuguggaagaaaaaucuauaucucuuugauacauauucucuuacccuugauuuggguaugacauaguugucauucuuuucuuugaauuacaguuuauuuuuguuuuagauuauagccacaaaacugauuuauauaguugaaauucuuugggugagaauuacaguuuuucuguaauucuugugauucaaaugcuuugauaacacagaaugauugaaauauacucaacacuauccaguuauaaagcuaaaacuuaaauuauaucaacccugucauggcccuucucacuuggcacuggaggugacauuuucuuaauaaagaaugauacaaaaaugaauugcugaaaucugagggaaggcauguuagguaaaaaaaaaaaaaaaaaaaaauugguuauugguacguguuauaauagaagaaauacaggcuuuggugccagauaaccuuggauuugaauucauucuuugauuuguacauacaugaccuuucugagacuuaauuauguuuucugugaaauggggaaauuuuuuugaggaagcacuaugucaagaacguaacacaguagacauacaguauugauagaagaaaaugagcuuuuuuugagagacuuuuagggccaacuaccaaguuucaggggacagucccuaaaacugucuuuacuucugacaccaguugcaagcucaggguucccaaaacgaccuuagguuugauaauuuguuaggacucacagaacucacugaaagcuauuauuuuguuuucuuaaaggggaaggauauaaauuaacaucagccaagggaagaagggcauaggccagaguccagaaguaccaaauguggaacuucuauuguuuucucuuaauggagucaggccacguucuucuccuggcaucagugugugacaguaugcagggaguguugcaaaacgggugcccacucaagccucaauguucauaauuuuuaugggaguuccauuauguagggguggacuacugaauugcucacguggcugauuucaguuuccaagucaacugacucaaagcccccagccugagacuauuguugcucuuugggugugaccaggcccuaagcuaagacuauguggguguguccagccuucacucucuaucacauaguuagauuauccaguaugaccauaggacccuagucaaagaugcuacuaucaggcauaacauucccagggcccagagaugaccuccaggaagcuaugggcaaaggucagaucuuuuuuuuuuuuuugagacaaagucucccucuguugcccagacuggagugcaauggcacgaucucugcucacugcaaccucugccuccuggguucaagcgauucuccugccucaaccucccuaguagcugagauuacaggcacgcaccaccacacccuccuaauuuuuguauuuuaguagagacgggguuucaccauguuggccaggcuggucuugaacuccugaccucaagugaucugccugcuucggccucccaaagugcugggauuacaggagugagcccagcaggccagaucuuuucuuugggcaaggccaaauucuuuacuccacauuuucucccaauaaaugcuuuuuugcauucauuuuauuuguguaugucaaaaagucaacaauuuugcuaaaaauaacuaaaucauuguauuaguaaucuauugcugugucacaaaaguaucagcuuaaaacaaacauuuauuaucucacacucucaauuucugagaaucaggcauucaggagaagcuuagcugggugguucuagcucagggucucucaugagguugcagugaagcuaucagccagggcuucaguaucugaagauuuaacuggaacugcagaauuugcuuucagcuuuacuuuaguuggcacagugcuucaguuucucaucauaugugcuguucacaauauagcuguuuccagaucaaguuaacagaucagagugucauaaagauggaagcuucagugucuuguaaccuauucuuggaggugacauacuaucacuuauauugguauugguagucuguuagugaccaacccucguacagugugagagggaauuguagaaagcauaaauuccaggagacaaaggucacugggggacaucuuagaggcugacuaccauacucacugugcucuuuauuaagaaaauauugauuuacugauuuacuguauuuagcauuuuacaugaauauugccuagccauuuaaaaucaugagaauucauuaugcuuuaacacuuuauugaucauuugaguucaugccucugaacagcauauucuuuauaacagggauaagaaggguaugaugaaggucuuucuuuuacuuuuuaaggccucagguuuugcuuuuugaggucuuaugauuacuuuucuuuuuuuuuucugagacgaagucuuguucugucacccaggcuagagcgcaguggcaugaucuuggcucacuacaaccuacaccuccuggguucacaccauucuccugccucagccucccggguagcugggauacaggcacccgccaccaugcccggcuaauuuuuguauuuuuaguagagacgggguuucaccauguuagccaggcugguuuccaacucgugauccaccugccuuggccucccaaagugcugggauuauaggugugagccaucgcuccuggccaugauuacuuuuuauaccguuuuuuucccuuccacauuagaagcugguuauuacuugcuuauucuuuaaaaugcuuucuuugcuuuugguuuuguccaguauccacauauccagaacuuuaagaacugaauauuaagugaacugaguauccugugagaaugucuuccaggcuuuccuuuuggaaauguggaauuguuuuaagugccuaccuagccuuugugaaaguccuuuuuagcuuucuuccuuauggaaaucauucuagauagucgagguugucaauuuauuuucuguauaaaauuuuuaguuacuuuguuuacuaaaguagauggucucagguuuguuauucacaaaaugaaggaaaaagcucuagugauuaaaguggaaaauagggaugauuacucagcauaaaaaaaaaaacaaacaccaaaaauacauguggcuauauaauuuuuuuuuuuuccuguuggauuuuguaucugaaagcagaaauuaaauauuugguagaauauuuauaaucuuacugaagcaccacuguuacaacuccugauaugguuuguauuggauuggaauaguuguacauuuuuuucugccaaguuuguuaacucuuuaccaaaggaauauuagaaauucaagaaaucacauugaugcugaaugauagaggaaaauguacugcacacuuaauuugcuauacccuaauuuuaaauauaggcauaaucaagagcaauaauuuugaugcacuauuuucucccuuucuagagaaaaguggaaucaaauuggaacuuuguagaagaacugcugaaaaaguccaucaguguucagguaugcaauuaaaguaagacaguuuguggauuuugcuuaauuuuuauguuacaaauuuuauuuuuaaaaccaagcaagcuguuaaaaugauucagaaaacaaauaacuuucaugcuuugaaggguuaacucacaguaguuucuuuuagugauuauucuuuaaagauuuuuaacacuaaguugucaguuaaaggacaauaauauccuaguugaugacuuugacaaaauguauucaaaauaagugguagaugcuucagaacuguaugccauuccuugacuguaugauaucaaacuaggugacacaaugagggagauagucauuggcauugaaaauucagcuauauccucaucacagcaggaaggugacuugccuugcugagcaauuugucuuacaggcuugaaucauauucuaacugauaagguccuaguuucugaccauucguuucauaccuuaucauuuuucuuucugcagagcuguuaauguagugcuucauggccuagaggucagacuugaccuccuuuuaaaauaguuuuaaacaugcuguucaucacauuuuuaaacauauuguauggaagcccuguaaaguuuuguaauauguuaucauuuuuguaagaguuuauggagaauuauaauaaauaauauuuuggaauuugggaaauauuuuucuuuuaagaaauaaagauuauuuaaaacuugaagaggaauaaaaaauauuguaguauaauauugcuuuauaugugugugugugugugugugugugugugugugugugugugucuguaguagcuaugucuuuggaaaaauuuuaauugcuugaaauuuucuuuuacccauuaucugcauuaacucuuacuuuuuuaggaaacauaaaggcauuuaguuauaauaugaaucacauaauuaugaacuaaaaauuuuagcuuagaaugccaaagaauucugcauacauaaauuggaucagaaacaaaucuauuaucuuuuuauaaucuuucccauaaucccuguaaaaguuuuguuuauuguauuuuguccuauaucauguucauugguuguccucauuuuuuuugagaacauauugauuuaguaacuuaaaaaguuuuuuauguauauuuuuuauuucagaaugaagggaauuacuaaaaagugguugugaaauaagaugcauauuacaguggccauugucauuuguaucaguuacuaauucagucuuaaugcuuuaaccaaauccagagaauuucaguaaagucuggauaacauuauuauucuauugggaguuacugaaucugagucaguaacuagggguuuaauuuucaguuagguuguaacugcuuguguucuuuaaauugcuuucucauugacccauguuucuguuguauuuaauaauuuuuaaacucccuuucagcucuaacaguguaugaauuuaugguuuugcacucagcugguuuuaaguuacagaauauuucuuaagaagcuuuaaagguuuauauggauaaauauauauauuauauauauuuacauagaucucagcccugcacaccagaggccuggauauaaauucagcucuguuggcuguugagggagcauagcgggagugagacugaccuugcuggcugcaugggagcugggugaggccugccacugccagcuuucccccacuucucuggagaccuuuaugaagcagcagaggcagccauaauuccccuucgaacauaauuucguagcccugagaacugcccccgcccauacccacuccacaguggucgcaucaagcccugcccaaggagagucugagcucagccaugccuaaccauucccccaucuuaugguuuguauuaggguucucuagagggacagaacuaauauauaugggaguuuauuaaggaguauuaacucacaugaucacaagguccuacaauuggccaccugcaagcugaggagcaaggaauccaguccaggucucaaagcugaagaacuugguguccaauguuugagagcaggaagcauccagcacgggagaaaaauguaggaugugagacuaagccagucuagucuuuucauguucuucugccugcucuuuauucuggcugagcugacagcugauuagauugugcccacuuagauuaagggugggucugcuuuucccagcccacugacucaaauguuaaucugcuuuggcagcacccucacagacacacccaggaucaauacugcauucuucaauccaaccaaguugacacucaguauuaacuaucaacagucuuucucuacccaccugguagccgaagauagaaaacauaaacucaugggagcuccauggccccauccaucaccugagaaaccugaauacuuaugcaggugauuucagggcaaguuuauguccccccuguaguaccacagcugaugcccucuugaaagugccaccuccuggcuggaggccaaccaacucaagccauuacggcaacucauaacagaacaacccugcaccaaggaaggagaaaacaacaucuaauuucauuaccuguaacauccuguuuaaccagagguccugagucuguccacaugacaacuucacugcuagcauaaccagcauucaagaaaaccaauguacuaaacaaaacugcaaccaaggauccucacagaguccauuucacuccccugcuaccuccaccagagcagguggugguauccacggcugagagaccugaagauagaucacaucacaggacucuuugcagacaccccccaccccaguaccagcccagaccccaguagcucugcugggugacuagacccagaagagcaauaacaaucacugcagucuggcucucaggaagggggagaacaccacaucaagggaucacccugcaguacaaaagaacauuaguccuuggaucucagaucuuuccucuggauauggucuauccaaaugagaaggacccagaaaaacaauucugguaauaggacaaaacaagguucuuuaucacccccacaagaucacacuagcucaccagccauuaauccaaaccaagaagaaaucucugaauuacuagaaaaagaguucuaaaggucgauucuuaacguuacuuaaggaggcaacagagaaaugugaaaaccagauuaaagaaauuuaaaaaauaauaacagauaugcaugaaaagaucuccagagaaauauauaucauaaauaaaaaacaaucacaacuucuggaaaugaaagacacauuuagagaaaugcaaaaugcacugagaaguuucaacaguagaaucaaacaaguagaagaaagagcaucagagcuugaagacaagguuuucaaauuaauccaauccgauaaagacaaagaaaaaagaauuuuuuaaaaaaaugaacaaaaccuccaagaauauugggauuauguuaagugaccaaaccuaagaauaauugguguuccugaagaagaagagaaaucuaaaaguuuggaaaacuuaugugagggaaucaucuaggaaaagugcacuggcauugcuagagaucuagacauccaaauacaagaagcucaaagaacaccugggaaacaucacaaaaaagauaaucaccuuaggcacauagucaucagguuaccuaaagugaagacaaagcaaagaaucuuaagagcugugaggcagaaagcaucagguaaccuacaaaggaaaaccuaucaaauuaacagcagcuauuuuagcagaauacaagcuagaagggauuuggguccuaucuuuggcauccuuaaacaaaauuaucauccaagaauguuguguccagugaaacuaagcuucauaaaugaaggaaagauauaaaguauuuuucagacaaacaaaugcuaagagaauuugccacuaccaagccagcacuauaagaacugcugaaaggagaccuaaaucuugaaccucaaaauauaccaaacaaaccucuuuaaagcauaaaucucacagggccuaucaaacaauaacacaaugaaaaaaggcacucaggcaacaacuaccacagugaauagaauaguaccuuacaucucaauacuaacguuguauguaaaugaccuaaaugugucacuugaaagauauagaagggcagaauggauaaaaauucaccaaccaaguaucugcugucuccaagagacuuaacacauaaggacucauaacuuaagguaaugggguggaaaaagauaguccauucaaauggaccccaaaagugagcagaaguagcuauucuuguaucagacaaaacagauuuuaaaacaacaacaguuugaaaagacagagggacauuauguaaugauaaaaguauccaacagaagaauaucacaauccuaaauagggaacauacacaacuaacacuggagcucccaaauuuauaaaauaauuacuagaccuaagaaaugagauagauggcaacacaauaauagugggggacuucaguacucuacugacaacacuagucaggucaucaagccagaaagccaacaaagaaacaauggauuuaaacuauacccuagaacaaauggacuuaacagauauuuacagaacauucuacucaaacugcagaauauacauucucuucaccagcacauggaacauucuccaagauagaccauaugauaggccacaagucucaauaauuuuuaaaaaauugaaauuauaucaaguacucucccagaccacaguggaauaaaauuggaaaugaauuccaaaaugaaccuugaaaacuauacaaauacguggaaauuaaauaaucugcuucugaaugaucuuuaggucaauaaugaaaucaaaauagaaauuuaaaaauccuuugaacugaauaguaauagugacacaaccuaucaaaaccucugagguacagcaaaagcagugcuaagaggaaaguucauagcauuaaaugccuacaucaaaaagucugaaagagcacaaauagacaaucuaaggucacacuucaaggaacuagagaaacaagaauaaaccaaacccaaaucccauccauaagugggcuaaggacaugaauaggcaguacucaaaagaagauauguaaauggccaagaaacagaugaaaaaaugcucaacaucacuaaugaucagggaaaugcaaaucaaaaccacaaugcaacaccaccuuacuccugcaagaauggccauaauuuaaaaauaaaaaaaaaauagauguugguguggauuuggugaaaaggaaacacuuacguugcuggugggaauguaaacuaguacaaacacuguggaaaacauuauggauauuccuuagagaacuaaaagaagaucuaacauuugaucuaucagugccauggcuaggugucucuccagaugaaaagaagcauuaugaaacacuugcacaugcauguuuauagcagcacaauuugcaauugcaaaaauauggaaccagcccaauacccaucaaucaaugagugaauagagaaaacuucuuauauauagaacauggaauacuacucagccuuaaaaaggaaugaaauaaugguauuugcaggaaccuggauugaguggagaccauuauucuuagugacaacacucaggaauggaaaacuaaccaacauauguucucguuuuuaacuuggagguaagcuaugaggacacaaagguguaagcaugauauaauggacuuugagggccugaggggaauggugggaguagggugagggauaaaagacuauacuuaggguacaggccgggugugguggcucacgccuguaaucccagcacuuugggaggccaaggcagguggaucaccugaggucaggaguucaagaccagccuggccaacauggugaaacucugucucuacuaaaaauacaaaaguuagccgggugugguggcaugugccuguaaucucaucuucucaggaggcuguggcaggagaaucacuugaaccugggaggcagagguuucagugagccaagaucacgccauugcacuauagccuaggugacaagagcaaaacucugucucaaaaaaaaaaaaaugaccauacuuuggguacaguguauauugcucaggugaugggugcaccgaaaccuuagaaaucaccacuaaagaacuuauucauguaaccaaacaccaccuguuccccaaagacuauugguuguggggaaaaaaguaggucaggugaccagccauccuauccugguuugcauggcccagaguuucagugugaaaccaggaaacaucugagcaaaccaggaugaguuagucacccuagaaguaggaauaauaugacuaaucuaagaaacaugcucuaugaauuuaggucuagcauaaagucaaaauaucuuuccuaugggaaaagaggcgauuauaauauuuaugaagaaguaguucugugguucucugcuauuccuucaguuuuaguguuccuugauuguaucaaauuauauucuauaaguaguauaggacuauguguuggauuucuggaaaccaauuuugugggagcaguaguagguaguuguaaagaauaauauauuuggauagaacugucaguuugauuauaucuauuuuccucccauugagguaaauugaaaucugaccauggucauguacuuugacuugaucuccaacagugacaguggugaaagaguccauuugcuguauuuaaacaaaauaaaaaucuuccaaauauacagcagccuucaaauaaaauuaguguacacuucauuauacuuuuuguuuuuauuuuuuguuuaaagagacagagucuuucacugucacccaggcuggauuggaguacaguggugugguuauagcucacuauaaccuugaacuccugagcucaagcacuucuucugccuccuucucccgagucauuaggacaggugcaugccaccaugucuggcuaauaucuucauuuuauagacagaucuugcuguguuucccaggcugaucuugaauuauuggccucaaggaauccuccugccucagcuuccaauagugcuugggauuacagaugggagccaccgcacccagccugaccacuacagcuuuaaucaagcaaauaauguuuugaauucuuuuuucuagcuagagaggaucugccagaaacagagguggaguuuuaguuuaguaaagagaacguauauugcucaauuuuacuuacuuaaguacaguuuuuuagagguaauccuauuuaauauuugugaaugcuaauuguaaacguguguucuaccuuugggaacagcauuauuguuuucauaugagaaagauuuuucaucuuuugcugccugcuuuuuaaaagccucauuguuuucugagaucacagaaguaauuuuuaguuuuauaaagguuauggaaggguauuuaaaaaguaagccugauuuuaaaaaauuauuuugauuuuuuaaacacauuaauuuggagaguccaggaguagaaccaacucagaaugugauuagaucuaaauaaugugggacaauagucuuuaaauaacuaacuaaaaaucaguguuucuugaguagaaggaucguaacugggauauugaagcccaacucuauucucuccuaaaaauaaauccaauuaggcaaacuucugguaacaguuacuguuuagacugugaauaaauuuucuucuugugaugguuucugauagguaggcuaguuaugcauaaauaaaugagucuuuguuaaauuauauauaauaaccaguuguuaaauugccauuucuuuuuucuuuuuuuuuuuuuugagauggagucucgcuguuucgccuagcggagucaguggcgcgaucucggcucacugcacuccgcuaggcgacagagcacuccgucucaaaaaaagagcuaaaagagugaaugugcaccuuauuaguccaauuaaagauuugaccuauguaguaugcccaaauguaauaugcguacauuugauuguucaaaauaaagauaagacauucuuuagaaaaggacuaaagcagagauuagaagcaggcauauucauuuaacggacuuauuggaauauucauuaaauagcucauauucucuccccgucugauacacucaaacacacacacacacacacacacacacacacacgagaugagacacgcugagagcccauaagggcuucugaaaaugugggagaugcguaguacuccuugagccagucagguuuaaggcuuuguggaaaagaggcccacaggccuuauggcuuacuaaaaacaaucuuuaaucagagggcauggaauuacaugucuuuaaucaaaucucugguaggguuugcuuaaaacugacaaaauugauauguaucaucuuaaggaacaauacuaugacccuguugcauuuauuauuugaucaucagaagaguaacauuggucuaaaguacauuucucuccugcagauaacaaaacgauagcuaucccugugcaagcacucugcuuaacacuuacugcacauaccuucacuuaauacuuacgacagucguguguagugauauuucuguuuccguuuuauacuuuuacagacugaggcccagaauguuugaagaacuuguccagguucacacagcuagcuuaggaaauggcagaacugagauuugaauuuucauauguuuaacuccacuguuugguaccuagcauucauacuuuugcuuuucccaaacuuugcauauuuuuuauaguuuaaauauguuuuucuggauuuuacaugguaaaaugaauuucagauguuaaauaaaacccuucagugugaacuuugauaacauaaccuacuuuuuuaccuuauaaacaugauaaaauuaguaugcuuuauuucaauucaguaaugugccauaggaaucaauaugaaccuggaucuaguuuaauauuuucauaauaaaauuagaggauauuagugauggacagaaccuugccuucuuugguuaaauaagcuuaauuguuuauuagagaagcuaaaugucuuucccuaagccauaacucuacuuguugggaagaagcaucagaacccagaucucaguuuuguucaugaaucauuuauggaggcucuuuggugaaacaggcaccguggcguauauaccauguggguauuauucuaucuuucagagagcucuuagacacuugaaagcagauaaacauuaaacuuaacaagguaaguaugaugauguagguaugccuagugugccauaaaagcguaaagaaaggccacuuaucuaguaagggaguuaggaaguuuucuggagaacuuguaguuugaaguguauuuuaaauaaugaauaaagaguuaaggccuuguccaaaaaaaauugugcauugcugcuuuuuacccauauuugggucacucuucauucauugaaaagguuuuguaccaagaucacuguguucuucuuuaccuguacacuauuucugcuagugacccugacguuauuggguauaaucgaacuguccuuucaauuucuuaauagccucacuucuuauuagauuuucuuuuacuugccuuaucuaccuccucccaugguuauacucuacagcuuuucacuuuucauuuuucuuuucauuuugcccguuaccauugaccuuuucauuuuucuguccucuuccauuuccucacuuuguuucuuaaacaauauacacaaccaauuauuuuuaaugaauauuccaauaaguccauuaaaugaauaugccugcuucuaaucucugcuuuaguccuuuuuuuuuuuuucugaggcggagucucgcucugucacccaggcuggagugcaguagcgcuauuucggcucacugcaagcuucgccucccagguucuugccauucuccuaccucagccuucugaguagcugggacuacaggcacccgccaccaugaccagcuaaauuuuuguauuuuuaguagagacgggguuucaccguguuagccaggauggucucgaucuccugaccuggugaucugcccuccuuggccucccaaagugcugggauuacaggugugagccaccgugcccggccuuaaucucugcuuuaguccuuuuuaaaagaaugucuuaucuuaauuuugaacaaucaaauuuaggcauauuacauuugggcauuacuccauaagaaacaucuuuaauuccauagcccuuaacuuguuuuaaccaugaaaaagccauucuuucucuccuaucucccacaccacccacaacugaauauugugagagaaaaucauacauucauuuuuacuaagaugauugacuuuaaauuguugaucauaaucucaaauggccaucagcucuagaauguuugcuuuucugcucuccaaaaugacuuaaugacuuacuucagaacuucucuuuuuuuuuuuuuuuuuuuuggagaaagagugucacucugucucccagugcaauggcagucucggcucacugcaacgucuggcuccucccggguucaagcgauuuuccugcuuuggccucccgaguagcugggauuauaggugccugccaucucguccagcuaauuuuuguauuuuuuaguagagaugggguuucgccauguuggccaggcuggucuuaaacuccugaccucaggugauccacccagcucggucucccaaagugcugggauuacaggugugaaccaccgugccuggcccggaacuucucuuugacauaaaauuuaauacguacucuucuccaauccauucggguuaacaucuugccucauaaaucauugaaaaauagaauuggucagguaagaauuccuaucuuuacagcuuuaaaucucccaacacaucugcuucauauucaaccucucagacuauucuucuuuuauguuagaagugucacuuucuaucaagagcuaauuccuucccucgugcacuggaucuuaacucuucucaccuguucaaggacuuuauuguuuguguauuuucacuuaaauauuuacuuccucaccuccuagauguccucagccauccauaguugagcuucuucaucauagucuucaucaagccccaaacugcucugggaaggccgucaaugacuuccauauuguuucuuccaaggguucuuauuucuucuuuuuguaaccucugagcagaggucaauccuguucaccauugucguuuuucugaaguacuucucuuggcauccgcaaugccugguuuccuuuuuacuucauugaccacuuguuuuugcauauauucuccacuugcuucauaugaaaauguuauaauaucaaauggcucucaguuauggauccuuuuaucauugacccaaauuuaugucaacaacucugacuuuaaucccuuaacucuagacccauaggucagauuaucugcuuaauagcucuacuuguauacccuggacacucaccucauaaguucuuccuuuagucuuugccauuucaggaaauagcaccauugaccuauuuccuuaugcaaaaaccugaaacuucuuucuuucauacuuuaauguaauuuaccagcaaaucccacugaaucuuuuuccaaacauaucuuuaaaguuucagucuuauaguuucgcacagucgccuccuaccuggucucccugcaucucuucuuaaccccucuauucacucuuuauguauaauccagagcaguguuuuugaaacaaucacaucaugucacuucugugcuuacucuuuuccaguagcuucccaacauauuuaaaauacaauccaaauuucuuaccaagaccaguaaagccucaaaugagauaugaugucuuccugucuagaauuuuauaauaccaagccuacuaauaauugaggaacuuuccacucauuuucucugccuugaauguuuuucuuccaagucuuuauugacuuucauuuaaucauguaguucaauugcagcccuucaaaaggcuuuuccauucauagcagcuaauaaaauaaugaugcuuauccuuuaccaauuacuuugccacauuacuuugcuuuguuucauuuucacagcaguuacuucuguucaaauuuaucuuguuuuaguguccuuuucuuuucuuuccaaaaauguaagcucuaccaguacaugugcuaucucugacuuacuuguuguccuaugccuaguacguuaaaacagugccuaguaugugguaaguuuuaaauacaauuguugaaugauuggaauucaguguguuauuuaaaaaauauaugcaugguuauaucgucauagaaaaagcaucuauguuuuuucuacuuccuuuuccuccuguuaucuccuaaaagguuaaaauagauguacucugacaauccuuugguuuuagaaagaacaacuccuauaauccuauaaaaagauuugaccaaguacuuaaguaugaccaagcacucuggauuuguguacaucuuaaucguuacaucauuuuugccacuucuuuuugguuuggguuccuuuucugguuucuggguuuccaguaccauucaauuaugaaacaccuguaauuuuuaaauaauugaauuaaaagucgaguuaugugacuucuguuaucugaauguguuaaugguguuuaaaacauguuuuuggaaguauguguuguguugauuuagaccuagucugcauaugagaauggguaugauugggugacacauauuuauuuucuuuuuagcugcagguuauauacagcacaauaucaagugaaaauguuuauauugccagagcccauuuaccuucucauaacuucaguuuauuuuuuagggugucauucuagaagaacaauuacgaauguaucuucacuguuguuugacacuuugugauuucugggagccaaacauugcaauuguuaccauuuuaugggaauauuauaguaagaaccuggugagugaauagaauaggaauuugcuccaggaauuuuaaaaauuuguacauauuugaggaaugucuuuaugguuuaauuaugaauaguuauggauuuuucuuaaaaaguuaauuuuuuucagaguagauuggaguagcucgugaauaguuuuaucuuuaacauuguagagcuuugucauaagggaaacagcauuugguauccuuuuucucuugagagcaaggguaaacaaaguagcuaaaauguaucagauauuuauaaaaucuucauuuauaaauguuucuaauaauaauugauugcucaugacacauugaacaggcacugcuguccugaguaagaaacaauccuggcauuugaguagcuuauaggcuacuaguggguggguauacauacauugugggaaaaaaguuauaauuguggaacuccagaggagaggguaucuaacccgguaucuguauuuguggaagacuucaugaggucauaauuuuugaacuuggcuuugggaaugaguagaauuuucuaacagaagaaaaagggauccaggcagaaugaacaacauggacaaauacauggagguaugaaaaagcauggucuguuccuaccauguuaaauaguucugaauuauaggccucggauaacuauggagagaccgaagauaggagacuagagaaggcagucuggggcuaggcuaugaaggguugaagauaauguacaguuaauucugguuuauucaggagacacuaaauagcgaggaugugacuuagguauguguuugagaaagcuuuuuuuuuuuuucugaaagugguguaaaugaauuggguacagacaacuuagugguuuauuguaguuguaugagcaaaugauacuauggcugagaacugaaauaggaacaauauauuuagaaaggagaggaugaguuuggaagauugaaaauuuaaagguagauuuaaaggauuuauacuuuguauauagaaaggaaauuugggauguuuuggguuugggguaaauaauuagugaaccucucaaucaaaauagaaaaugguaauggaagauuuacaaguaaauaauguuuggauuuguggauaauggagcuuauuaaaaaauuagaaaaaugcccuucucugaagcauaauuuuaggcuaguuggagaaaugacugauuguagucuugaggcaggaagaguccagggugagucuagggugucuugucauaccagaaagcaggaaagguaucaaauuaagcuagagucaugucagaagaacacaggagccaaccugaaggaauguccauugcccagaaaaugggaaaauuugagcauaagaaagaauaaugacugcaauagauuaaaacauauuaaauauguuuaaaucucugaguuuaugcuucuuuguaaaaaguuacucugaaaaaagaaacaccuaauucugaaaacuguaaagaaaauacaaacuauauuuuagaguaaucagauuucugaugaguuaauuaagaaaacgugauagaauuagaagucaccauuuuguacauuuaaugaaauaaggcaucugggcaaugaucaucaaugcuacgaaaacuguuaaguaaaaggcuugugggaccacuaaaauggguggaccaggcugauaaccugaccaguuuuaacaucacaaaaagucagaacuuaugugccuuuuuacuaaaugcaauaggaacuacuuaguacuacugaugaaagauucuugucaaaaaagucaacauaaaucugaugaaaccucuagauauagccaccaauuuacagaaaagggaagggaaaaaagauuaaguaacacuagagccauacaagcagcuaaauuuagaacaugggaaauuuuauacaaccaaugaccugauauuaaaaacaagugguauaacaaaaacauugggaaacuuaaagaauaaaagagcccacagugccaugcauaucacugaaugcaauguauggaucuuguuuguauccuaauuuggacaaaucaacuguuaaaaacacauuugggggacaauccaaaauuuggacaccucuugaugcucuguacuuucauggaauuuuuauuuuagagaaucguguucauguaguuuuugugauuaagaugagucagacuuuugaugaaccaacuaacugggauuugcagcuuaccauuuuauuuacuaagagacuaauaauuguuuucuaucuuuuuuuuccccccuuuuagaauaguuccuucaguauuucuuggcuuccuuuuaaaggccuugcuaauaccaugaagucacccuugucuaugcuugaaauggugaagacuugcuguugcgauaaacaagaucaggaacuauauaaauccagcaguaguuauacuauuuuucuuuguauucuggcaaaaguuguuaaaaaagcaaugaagagcaauggcccucauccuuggaaacaagucaaaggaagguauaugcaguaucuucugucaugagugugcacugauaucuuuggauagguguuacuauuuguauuuuguuauguuuacuugggauuagagucuuaauuaguuauaauguuacuagguaauccauuauaugcauuugauuaaaagugauagaaacaaacaucuucaaguuguacguugguagguaauaguuucaacauauaaaacuuuuguguucuuugagcccagcgguucacaagcacugguuuuuuugguuuguuuuguuuuuuaaaugagaacugaccacaguauaguagaaccagauaacuaauguucucauuugggaacuaugcuguuuucauuucugauaaaauaaacuuuggucacauuaguccauuguuuucucugucucuuuugagaguuuugcuuguucaaugaguauacuuuuaaauugucuuucuuuuuucuacuuccuuugccuauauuagcucuuuucuuagccuucuuugugcaguacaccaccaucuaccacuugcucagauuauuuguugagaccucucagggaagagaauacuagguagggacuucucaagaaucacuuaaugaaauuccuguuugagucccacagugaguaauucuuauaaggguauggugauaugguuuggauauuucauuugucauauacuguuuuaaaugccagcuucuuuauuaaaucuacaagaaucacauggcuuaaacaguuuuuuuuuauuuuguucuauuugacaguuuguuuuugaaucuuaagcaauuuuauggaagacauaauacucagaacuuuauggcuaaaagaagucauuggaguuuauucaauaacaagucuauuagacacauacuauaugucaagcacuauaguggggauaguaguagacaauacaaagauaauuaaacagauuuuuacuuuuaagaguuugucagcuuuuaaguauuuauaaacauuuaacucucaugagcauuacucauuucuguccugaauaagccaguuauagaaguugcaaaacuuaaggccaggugugguggcucacaccuguaaucccagcauuuugggaggcugaggugggcguaucacuugagaucaggaguuugagaccagccuggacaacauggugaaauucugucucuacuaaaaaaaaaaaaaaaaaaaaaauagccaagcgugguggugcgugccugcaaucccagcuacucaggaggcuggggcaggagaauaacuugaaacugggagguggaggcugcagugagccuaaauugcgccacuguacuccagccugggcaacagagugagacuccgucucaaaaaaacaaaaaacaaaaaaccaacaacaacuuaauucguaaguaggaauucagaugaauuguuuucaauucuaaccccuuaauugaugaaagaaaagaaugucaacuauuaacuauauuaucuauuguacuauuuugucaacuauuguauuaaauaguauugaugggagauuuuuaaaugcauaguucuuugcagauggcuacaaagaauuuuucuaacgccuugcauugucuuaagguauaaguaaaauaagagcaaguguucgugagggggugcagggagaaaagaguuuaaggaaaauuguuacauaaaauuguccuguuaagaucucuguaaaagcauaucaaauuguauuuaaaagauuauauauucuuucuuauuuacuaaucaaaauaagaaaagaaaggugaugggggacuugaauaaaaggaaaagccauguacuauaugaaaacauuucuacuuuccuuuggggaaagccauugaauccuuugauucacuuacaggugauuugcugcaucauugggaaauuucaagguagggccauuauguguuuucuaaguaaaaaaagugacaaggcagcaucaaaauaaagaauuagcuuaaaauuuaaugagauuguuaugaguauugaaacaaauuuucuuuuaagagauacagauuuuugugaaugaaacaauuuuauuaaagcauuuuuuaauguuuuacagaauauauucaaaauuccaucaaaaaagaauggaagaacuaacugaaguuggucuacagaacuuuuuuagccuuuuucuacuguuagcagcuguugcagagguagaagauguugcaagucauguuuuagaccuccugaauuuccucaagccugcuuuuguaacgucucagagagcccucauuuggaagggucacauggccuuccucuugauguaugcccagaaaaaucuggacauugguguuuuggcugagaaauuuucaugugcuuuccgggagaaagcaaaggaauucuuggugucuaagaaugaggaaaugguacagagacagacuaucuggacccuucuuuccauauacauugaugguguucaagaaguguuugagaccagcuauugcuuguauccuucccaugaaaaacugcuuaaugauggauuuaguaugcuucugcgagcaugucgagaaucugaacuuaggacaguauugagcuuccuacaagcuguucuggccagaaucagguaugguuuucaguuguaugcuaauuuaugauuuguuuuauauaauuacuuauguggauuuuauauuaaaguuauauauaugcauauauacaaauacacaugaaauccaaauguagaggaaggauuuaguuuucuacuacaugggcauaaaucaguacagguugaauauauccguguacuaaaaugcuauuauaugaaaagcuugggacuagaaguguuuuggauuuuggauuuguuuagauuuuggaauauuugcauaugcauaaugagauauuuugaggaggggacccaagucuaaacauaaaauucaguuauguuucacauacaucuuauacacaggcugaauguaauuuuaugcaacauuuugaauaauuuugugcaugaaacaaaguuuugacugcaacccaucccaugaggccagauacaauuuuccacuuguagugucauguuggcacucaaaaaguuuugaauuuuggggcauuuuggauuuugaauuuucagauuagugaggcucaaccuguaguuuucaagcuguuuuucaaacaauagcuuuucaaaagaaagcuuauaugcaaacacaagaugcagaacuaaagucaagagcagcucuggugcagucugagagccaugcuuucucuuagcccuuccuuccccugcuaccucucagaaaaguguauuauuacccagagauacguuacagauauucugagcaagaucaugagcucaugucugagguggcuuuuacugaagcauuuguaauuuugugcccauaaggaaguuuuggucacauuacaccauuuuuuaaaagugacuuucuuuaaauuuuugcagcaaagucauagccuuagcugcaucaaaugcuuugaaauaaaccaguuugcucugaaauuaacauagauaauucuauuaauaacaccaaucaccuauacaaaacuuacuguuuuucagauccacuuaaauuaugcagauauguuaaauacacucagacacaaacuugauguggauaagaacaaugguuaugauauuuauugccuuuaggcacuuuucacauagcaguuuuaccuuugaaguacauguucuuaagaaguuaaauacuaccacucaguaugguuacucacugucacagaaaaugauuguauuugaaaucauguccaaagauaaacagacugcuucccuccuccuaauaucauauuacaaauguugcaucuguuuuucagaggugcuaagcuuggcaagauuuccaaauuuugggaauuuauuuauuaucaaauuuauuucuauuacuagcuugauuuucucuauucuaugccguguuuucauggcggguuuuauacuucuuccaaaugccaacuuuguuuuauuucuucaguuuuuaaauaaauguuaagugauucccugugcuucuugggaaaauuagaaauuuuuauguuuccaauaucaguuuugguuugucucuauauaucugucugaauauacaaaacaagaaggaagaggaggguguuggucuaagccauccuggucauggagaacuauaguccccaaaagaugucagagcauaggaauaagaaaggaagaaagaguaugggcaucuucagaagaggcagucguggggaaaaaaguagcagaauccauauaucuuucugccuuuucugaaaauagauaaguccuuuuuaauucuuuuuaacaauuauauugcuucuuacauaguuuuuuuuuuccucauagguucguauccuacaaguacuuuaaauuuaauguguuaauuaaaaauuucuggcaaucuuuuugguuuuuguuaaaauuaucuuuauauuguuuguguaauauauuaucauuuuacaaaugggggacaaaagagauauaaagugacaaguaaaucugucuccucagcuucacuucuucauucucuaguucaguaguucucaacugggagugaguugucccccagggaacauuuggaugccuggagacauuuuugguugucacaacuagggggacagcacuggugaggucagaaaugcugcuaaacacucuacagugcucaagacaacuccuacaacaaagaauuaugucgcccaucuucagcagugcuaagguugagauacauugcucuaguucuaauccauagaaauaaaauuguuucuauagaaccuuccagauaucuccuuccuaccuacauacauauauauacacacacuauauauguauuuuuauauauauacauauauguauaaagaauguauaaagaauguauaggauauacacauauguguauauagaauauauacauauauauuuugagacggaguuucacucugugcacccgagcuggagugcaguggcgccaucucggcucacugcaaccuccgccuccugggcucaagcaauucuccugccucagcauccugaguagcugggauuacaggcacacacuaccacgcacagcuaauuuuuauguuuuaauagaagcaggauuucaccauguuggccaggcuggucucgaauuccugaccucaggugauccacccgccucggccucccaaaaugcugggauuacaggcaugagccacugugcccagccguauauuuaaaacacaaaauagaugaucuuuguuuugcaaauuccuuguuuuauuuaauauuuccugaacagcuuuucauguuaaaacaugaaaaccuaccuaauucuguuaaaugacuauuuacugucucauuauauagaugugccaaacuuuauccaguugcuaauaauggaaauguguauuguuuaccaguuuacguuuauuuaacaucuuuguaaauguauuucuguguacuuguggaaguauaccuauagauuaauucuuaagaaugaauugguguaugugcauuuuaaaugugaauagauguuaccaaauuucauaccaaaaaaacccauuguaccaguuuuuacucucacugauaauguaugaaaaagcuuccauucucauuuuuagaucauuguauggaguguauuuagaaaagcauucuaagauaagaaauaaggcugggcgugguggcuuaugccuauaaucccagcacuuugggaggccgaggugggcggaucacgaggucaggagaugagaccauccuggcuaacagggugaaaccccgucucuacuacaaauacaaaaaauuaaucgggcgugguggcgggugccuguagucccagcuacucgagaggcugagucaggagaauggccugaacccgggaggcggagcuugcagugagccgagaucgugccacugcacuccagccugugugacagagcgagacugggucucaaaagaaaaaaaaaaaaacuucgagaccagccuggccaacauggugaaacgccgucacuacuaaaaauacaaaaguuaugggcaugguggugugugccuguaaucccagauacucaggaggcugagguaggacaauugcuugaacccgggagguggugguugcaguaagccgagaucacgccacugcacgacuccgucucaaaaagaaaaaaaaaaagguaagaaaugaaacacagaaguuuguuaacaaugucaguugaagcuugguaauaggcguauuagacuuaauuugaaggcuggauagacauuaaaaauacaaagaaagcaaaaaagagaggaacucuuuucucuauuucacauucauucaccaacuucaucuuaucuugaaucuccuaacuggaacuuuucuugguauguaauucuuuaaaaauaguaacuagaaacacaagaauaauucuuacauucuugaaagaguuaaugcuuauaaauacugucuucuuuauucuuuacuaauccugccaucccuauuuauaggugaaaaaaauggaaacagagacuuuuuuguggcucaucuaaaauaacacauuuaaauuucagaacuggcacucagacucuuaaccaacuauaccacagcugccuucuuacacuauauuuuuaauuaacuuacuuaauuuucuuuucuuuuuauuuuuacagguauagagguuacaagugcaguuuuguuacaugcauauauuguguagugguaaaauuugggcuuuuaguguaaccaucaccugaauggcuuauacagucuuuauaaguuuacagauaacuaaaccaaaacuaaccauaccacuacauuaaaaaaaaaaaaauuagagaugaaugaaugaaaucugcaaacuuauuugcaaaccugaaauuauuaccacuauuuguauaauucugagugcuuuuacauuuuguuuuugcuacaaaaaaagggguaguugcuuauuggggacuuuugauuacuuucuuuuuauuuuguaaguuuuuuuuuuuuuuaaaugagucaguuggaaaaaaugauuugagagguguggagacaaguauaucacauuuuauuuauaauaauuugucuuugauuuuuuuaguacuauuccaacccucuaaauuucacuucuugcaauaaaaacaaauuuuugcuccuuaaauucaauuuaguagaaauccuuuagcauuaaagccaaaguuauuucaggaguguuagaaaaauauuucuugcaaauauauugugaguuaugauguaucuguuagucugugggacacuauucagaaguacagagguagaaaucaaaaaaggaugaugaagaaugacaauuauauaaagugaaguuaaguuuacauugauaggaagaguuucuuguaacugcaccuggauucaauuuguaguuugcuguccucuggagugugaguaggugauaggggguugugcuauuggccuucaggauuagccugugcaaaaaggaucagauguuuauguugauaacauuugauuccuuucacaaaugucuguuuugguuuugucuuaugcugucaacuaugauugaaaacaauugccauaaaaaacccaucaaaucauguucagcuuauauugcccaaaucagcaguuuuaacagauacaaguauaaggucaauguaugaauaaaaauagugcagcaauaugcaagucuuuauuaaugcuguuguauuuuagguacuaacauacuuuaguaauuugcaaacagauuacuguauguaauaaaaggaacuaugacuuggauagguucauuuuaucccaucaguuuuuagcauuuccaaggcaaauauuaucaaggcaguccagccuuuaguuugggauuuauuggagaugggcccaagagaucauucaggauuguuuaccuuaaaaauaaagaaagaagggaagaagaguuggacaggaaacaagaaaaaguuauuuagguauucaguuauggagauguauuccuaauuucuuaaccccaaaucuggaacuucauucaagauuuuuugauaguaguuuuuuagauaugccauauacuguuaauacuaucgggucaaaaacauuuuggauaguuguuaaaaauuaaagcauaagcucgccgcccccuuuaguuaagagcagagcuaaguuauuugaauuuggguuuagguaaggaagauggauuauauagauugaugauauuuauuccuggcugcaucucugacaagggaaauaaugaaauacuuaaaccuuagccaucucuucuguuuucaaauucaggugggaauagguaccaguccuugcaaaaauguguguauaaagugugugcguguguguguugaacuggguaauaguuuuacaacuguaugacagagaaauuauagguaggaaggaucuaugaucacugauuaaagagaaaagcaguucccucuaggcuguuuaggaauaauaacuucauaugcuucuuucugcuaacuggagcugauggcucaccagagcauucuuuauugcugauuaaguagcauugugaaaauacugacuugguuauguuaacuaaaugccuauguuuaaaacuucgaaugucaaauaguuuuagcagucaucuuuaacauuucacauuaccucucuggaaucacauuuuaaguucucacuugcuguuauuugagguuaauauaaaaauggcagucuuucauuuguggaguuagguguagccaaaagcuuuccuuuaauuauauccauucaugcugcuauaguugagggucugucagcauuuccauuauaaaccuccauuuucgggguuuuauaacacagcuaugaaaauuagcucugggcaaaaacuugacauacaaggccucaugagauucucccucccuccccaucccccuuuuucauuuuuacugaaguaagggugagugauuucaaaaugccuuuuggcaucugaaaauaccauuuggaguuuaaaaagaaacaauaaauuuucaggauuuguaccuguuuguucuaccacuuaagggagguuguggacuuaugaauuuaagccaaauagauauugaucaacugacauccuauuuuguauuaaacaagagacuaguuucaaagaugucuaaaggcaguugagaacuugccuaaaaugcuaaauacugagacuaagaaauaguucagaagcgauaauuaccuuuuugagaugcugugugcugaacuacaacuucuucaaagauuaagguuauuuucccuggcuucaaaauacauuuugaaaauauauauauauuuaaauuccuuuuuuucucucccuauaaggcuagaagaucaucugcuuguuuuauaacuguuuugacauuugaaguguuuguguaugagcauguagagaaaaacuguuuauuauucucuucaaauauuuuuaugcucaguaguuuuauugguaugguauuauuuauucuccccaaagauuuuugguuuuucuuugcuucuguaagagaacuggggauugccuaggcaaaaaaggagguacaagaggaacuguucacuugaggggcugcuguaugccaaauaauuuauauaauauuucaggaaaaauagaaaugauacuuuugacagcaugcaagcuuuuucuuccuuuuguuauuggguguucuauuaguaugaauggguuacagcuuuuaauuauugacaguuuacaacaaacaaauuugaaacuggauagaauuuuuaaucaaaugaguuauuucuguaguuugcucaaaaugucugcucuuucauuauauauaauuuuauggaaauuuugaggcaguguucuaauaauuuuugggaaacacauguguaugcccucaugguaauaaaaucuauuaccaguuuuuauuugaaaaaccaaguagagauauuguugcuuacaaggaguaauccauugccuuuuuucguuccuucagagaaagcauggguaucucuaagggaauacaguauaaaucuuaguauuucaggaauguauaaaauauguaaagaaaaacuuuuuuuccuaguuaaauauuuuuuauaucuuucagcugaguauuuagauauauacuauaaauuaguauuuucaccuuauuuacucuuuaucaggcuugaauuuggcauaauguauuucuauuacauauuuuauaaucccaugcaguaauauaaacuacucaauauauuagcuuugcagaguuccacuuuuuuguguuuugcugaaacauagauuaucuccucaguuuuucacgcauaggaauuaguauuugggucacuuuuucagucccuaucuaaauccgguacauagauacgaguuuuccuuaaauaaguauaaagcgauucauuuaaaauaaugugaggaaaaacuuaugugccaaaaucuugacuuacuuauuuguaaaaugaggauaauaccaccuaccucacuagaauguuuugggaauuauaugcaauaaugaauauaaggcaguuagcaaauugccuggcauaucaguaaguguucaaugaauguuagauaaugcuaucaucauaaguauuguuuucaaaagaacucauaaucauuucuucguuaugcuuuaugccuggcaacaucaauggacgugugugugugugugugugugugugugugugugugugugugugugucaggggucuuaucuuggaugguuuuuuuacccauucuuaauauaauacuucuagcauagugaccauugagcaaguuuuguuguuguuguuguuguuuuaguguguaaugaaucguuuucuuuaaaaacaaagaauuguaggaaacaacauugccucacugcaguggacccauuggaaauuguaaugcuauguuacugagugcugcuguagaaaaaguaauuuuuaaagguacaaaugugacauauauguauacccuuucuuuuuauaaucagcugauucuuuugguaagguggggagcgugugucuucuuuggugaauuccuuuuaucuucuuucuuuuauucucacagaugucauuaccucuguuuuuaaaacauuaauacuacuugccuaaucacccugccuccaaugccuuccuuccucagauuaucuuuuuuaauggcuuuauugacauauaauucacauaucauagaguuugcuagcuuuauucagauauaauucacacaccauacaauuuauugguuuuuaguauauucauaguuguuuuguacccaucaccacuauuuuagaacauuucauuacauuaaaaagaaacuuuuagugacacucuaauagacacaguagaaaauuucacauuucuuaucauggucuuuaaagccauccacagucuucuuuuaccuuaaucuguaacuuuuucuugugauucuccuuuagucagauggagcuacuaguucucaagaaauccccaagucuuucuaccuuuauuuauaucuucuuguccaacgaaguugagggucaaaguugacaaguuugaccucuugucaaaaccaauugaggguucaggccagaacaugaccaguauagcagagcugaagcugaggacugaauaagcaugucaugugagagucacugcuuagaaaaagguuaaguugggggaauggaaguaauugucaaaaucaagagucagaaguggucaguguugguaauaguagacauaggggugagauggcagaguauagaaaaagaaaaaacuagagguauuugaggagaauggaaaguguuuucagaaguuaguaguauguugaugagagguagagauggaauuaaagagcaucauauaugggaggagccaguauuccaggcaggagacuuaugcacacagcaaguuuugcuuuuugccuuugcuucuuaaggaaccucuaguagugccugauaguugcugcugucaaaacauuguauuaaaaagcaggagcuuuaaggucaguaaaccugaguucagaucacccucuuucauuuaccaacagugcaaucuuaggaaguuacuuaaucuuuucuaaguuucagcugcaucuuuguaaaauaauauccaccucauaggauuuccaugaacaucugcuuagauuucugcuguccaguaggguagcacuagcuaugugugacaguuuaaauuagugaauauaaaauaaaaaauucaacuguucuguaacaccagcuauauauuaaguccucaauagcuauauuuaguuaguggauaauguaguggauagcagcagaaagacuugccaagggauagcacugacuuugaugcugcaccuguccagaacaugaaucauaauaagcuuucaguacauucaauacauguugguuuucuucauuuaucuuuucuucauuuuuuugugaauaauauucaugucaagaagcuucaugucaagcuucucuugaaaugcaugcuuguacauuucaagagaaauguaugcuuauccguguguuaccaguugauaugguuuggcucuguguccccacucaaaucuuaucucaaauuguaauccccacgugucgagggagagaccuauaauccuccaugugucaauggacagaggugauuggaucaugggggugguucccacaugcuguucuuguaguauugagugaguucucacgagaucugaugguuuuauaagcaucuggcauuuucccugcuagcagcucuuccuccugcugucaugugaagauuucugcuguccaguaggguagcacuagcuaugugugacaguuuaaauuagugaauauaaaauaaaaaauucaauucagggguccuugcuuccccuucaccuuccuccaugauuuuggguucccugaggccucucuggccauggggaacuaugagucaauuaaaccucuuuucuuuauaaauuacccagucuaggguguuuauggcagugugagaaccgacuaauacaccagucuugaauaaucucuauuccuguugaauuuccugaauaguuacuaaaucucuaauguccuuuauuguuuuuuaccuuguguuguaauuauuuucuaaaggggagacauauucaugaaaaacaauuuauucaacaaauuuaacuaguauuuuugaaugccuacuaugauaguaggcacuuaggauauaucagugaaccagucacaugaagcauauguaguaugcacucauguauuuuuuacaugaaagacuaagaugguagagaggaaggacaaagaaacuuguauuuauuuaaaccaucacuuuuucaccauuucauacuacuugcuaaugguuuauacuuguccugaaauuuuauaugcuuauccaacaauucuugccaguguccauaugcaagcagacaacaguauccaugcagucaggauauggauuuaaugcauaaucugaauuucaucucuguguuuauugucuucuaaguacccauggguagaagggaccucuagaggaugauaggagguuuguucuucccaguugaaagguuuucgguguuauugaaaaauucaguguguuuuccuuaguauuuucuggaugacuauuauuauuuuaucuuucuaauucacuaguuaucauugaauuuuuuccacugaacuauggaaacaggugcagcaaguggguccuuugagccuuuaccuuccuuuugagacauuucggaaccagucucucaaggcugggucugcaggaacacuuugaaucuacaagugcagauugucuguauugggauuagaguggaaggaaggcauuuggaagagggaacuuagaaaauggaaugaaggaaauaaucaauaaaacaauuuaagaaaauuucucagaaccgaagauucuguaaugaaagggccuauugagugacuccagcacaacauaagaaaauagaaucacagcaggguccaucugugagaaauucaaaauacuagcuacaaagaaaagauaucaaagcuuucacaaacguuccucacccuuguuagucuucugguuuuuuauuugcuaugccccugauuauaaucuguaguuguaaucuaggucagagcugauauuuaaccccaguuccuaauaauuauauaauuaacgugggaggugaaugaagcuuuauaauuagauuuuauuuggcugggugcaguggcucacaccuguaauccuagcacuuugggagucugaggcaggcagaucaccugaggucaggaguuugagaccagccuggccgacacggcgaaaccccaccucuacuaaaaauacaaaaaauuagcugggcgugguggugggcaccuguaaucccagcuacucaagggcugaggaggcugaggcaggagaaucgcuugaaccugggagguggagacuucagugagccgagaaugcgccauugcacuccagccugagcaacaagagugaaacuccgccucaaaaaaauaaauaaauaaugaauuaaaaauaaaaauauauuagauuuuuuacaagauuacuccuacuuucaagaagcauagaauagaauagagcuuuaugauuucugauuuauaguuauuaccaaaauuugaaguuaccaguaauaugauuuuucuaggaugaaacccagaaaauugucuucucauaauuacagaggaaaaagagaaaacauaaggguggagaaagaacacuguaaaacagaaacuagagugaagaacauuggauaaaaggagaaggaaaaaauaaauauacucuguaaagaaagcauuucauuccuuugaaaguggaucaauucaguuguuuagggaauagaagugccaugauuauuuuucuuuaccagccacuggaauauuucucuuuagcaaauggcaauaaaucaaaagaugaugggaugaggcaaaagcuacuuuucccaaucuuauuuaugucacugugauuccuagucugaacccugugguucacuauagguguuuagaccacccagaucuuugaagcuuuagaugaaauucagcaaugaguuuguaggaagacaucacuacugugcucuuucauggcaccacacggugcuguuucuuaaaccaaagacaggcugucauaguaaguauauugaagacugguaaaucccauucgugacagauugguuaaaguuaacucuucucugacuauggaauagguuaaaaacaccuaaaauugugacuuugguacauugaccuaguuuaaaaaaacucaguaugauaaacuggcauuguggcuuuugguuauaaaagggaaguacuugggaagcaaguaaaauuucagcauuuacauucaauaaaugcacuagaauaagcuaccagacuuuuuuuuuuaaugauguaauaugacagugagggaaggaaaccaaucuuaauuauuccuguaauuaauuacuuuuggauuaauaaaaccucagaaggcacuauaaauuguggagaaaauagauucauuauaguuuuaaaauacuucuagcuauucucaccaucuuacuguuacccuaaagcuauuuucuuuaagauguguuuuguagaaaacaucagaguacauguuuaaugauaugaauuuacuguugccaccauauuguuuaugggaagcaguucuuagcuuucuucauccgccuuguggaaaaaggugaguaacugcuguuugaaauuuuauuuauauuuuaaagaaauugaggacaaacaaggagugaaacuagcauuugaaacucuuaauuucaauuguuucuucuuuaccuuacaagauauauauuuuucucucuuuaggguaucucuugucagauuuaaggcuuauuuaaaaugaaaagaaagcuggagcaauuuucuuuauuccauuucagucuccuaaggccuauuucccccuggugagcucauagcaacagggggguuuaagggaauucagcuuucugcaaauuaaugucucacaucaugaaaauucaggacuuuuuuuuuuaucuugaaaaguaauacagugagugcgaguauuauuucuugccagcggguggaagaugaaugauuuugucacaguuuuacugcuugaugagcaguguccugagggucaggcuuaagucugugucacuaugcugcucauuacucuugagcuaaauaagggcugauuggaucuaaauugccuagcacaugggccacagaugagcucagugagcaggggaugaccugcuauucagucugggaguaaccccggugugcaaaugcagcauuagaacacugugggagaaugagaggcuaccggcugcugccagcaaaagaaaucgaaauguaaaaacucuuugaugcugugauguuagaauuugaaauguaggaagugacagguugaugguacuuaucagcuuuggcuggauuagagaacagugucaucuugcuuauauaaugacagaagaaugaagucagcagcuaacuacugugcagagcagagccgcugcuguugccacagccagucauugcugccuccuacuggcaguuuuccuggaaacuaguaaaauauuauaaagaaaaaauccuccuuguugguuucaaggaaucuugagcucuuugguggugaacagccgcuagugaaacaaugcaaaaaaaaaauauauauauauauauauauauauuuaaaacaugauuaauugugaaaaaaaucagaaauugggaaguugauuguucuagaauuuucuagugaaccaaggauuaauccauuuaugaagugaaacucccagggcaagaaaccuuguacacccuuccuggaauaguauucuuucagggggccucaacuggguugguugaucucuuaauuacguauuuuuuucaucaucaguaacaggacugugcaaacaacuaaucuuuaaaauccagaaaccacaguguuagcacaguuugaaaggcagcugauaaaaauauaaaguaaaaaaugccccgauuauguggcuuaugcugcauaaaucucucucuuaaggaggaggugggauggaagaaaaauguuucuccuauaagucaaaugauuugaaaaaaaaaaaaaaacaaaaaaaauaguaaaaucuuaugauauaagaucucuuuguuucauuuuacuccuacagcuguaauuuuuuaagaaaucaauauuaggcugcuauuauauauauuucugguguuaaacuuagaaaauguagauggauuuuuuaaaaaguuauuuaacucaccaugcugagagaacuacuauugauauuuuguuguauucuucuacacauuacuauucauauacuuuuuuaaaaccaaaaauaagauuaaaugcuguuuagugggcuggcuucuucgcuuacuauaucaucaacaacuuuccauauugaugacaucuacauuauuauugguguucauuguguagauauaccauaauauuccaugguguggauuaacuauuucuuauuugugaaaacuucugcuauuuugaauuuuucaccauuagauacaaggcuguggggaaugugcuccugugugucuuggcagggcucuuggguauuguacaaauugugugcugcauaaccucaaggguaccauucacagcaguguaaaugaggcuuugaucuucauagacuuguuugauuauguguagaagguauuuuuuuuaaugauuugauuuaaaaaauagaaccuuagauguaauucuuaaaaaugaaugggagccauagcguauguucaagauccaauuacauauauccaacagaugcaaauuuuuaacuaguugaaaaaccuuagacuagaaaauuuuuuuuuaacuuuuuccagauuuuuaaaacaaagcuguaguucuguagauggaaaaacagauaggaggcuucuagagccuguggugaaaugauagguaaaaggauuaauaaauuaacuuuuauuuuccaguauuaguauuuuuucuaugcuuguuaguauagguaccccacuauuucucuaagccuuuuuucuuacuauuaauaucaaauaucaaauaacauuuucaguguaauuucugaagcaguugaaggcucuagagaguuuuuaaugccucucuuuuacauuuuuauauuaucaaauuuauguaucuugcaaagaauguaaauaauacagaauuauauguaguagaagaugaaacucauucuuuuccuaaacccuacccuucgucugcaaagggagccacuaugaacacuuuggagaauauuuuucccagcugcuauugcuucuccuuuuaucuacacugccuccuuuaccaccuguuuuauuuugaaggguggggggacaaaagugggauuauacuauggaaauuucuacaaccucuuucuuuuuuuuugagguggaguuuugcucuuguugcccaggcuggaguacaauggcgugaucuuggcucaccacagccuccaccuccuguguucaagugauucuccugccucagccuccugaguagcugggaccacaggcaugcgccaucaugccuggcuaauuuuguauuuuuaguagagaugggguuuuuccauguuggucaggcuggucuugaacucccgaccucagaugaucugcccaccuuggccucccaaagugcugggauuacaggcgugagccaccaugccuggcugcaaccucauuuucuucacagaaaaaaauaucaaagacauguuacucugucuacagacacacacacacgcacacacacacacaaugugcucaugcacuguuuaaaacuguguaauaucucaaacuucauguauauaaaucaaacgacauuuaacccagugaauguuuaggaacuguacauaguuuuuaguuggcuuggcucuuguuuccaagauccuaguugcuuaaaaauuugauuugcuuagcuuaucuaacugggauauucacuguauuucaauuuugugggucauuaauauauccauugucaaaaccauucgagcaaauuuucacuucagucauuucguaugugugaaucauacauagaauagucuuuugcuuauaguaaaaaaaaauuacuguauuuuucaaaauguuacaaaugugaauuugaauccugacucugcucuuucacuguagucuucaacaagucuugucacuucuuugaaccucagucuuucugaccuguaaaauguguauaaugauacguauugaagagcugauuuggagaauaaaaaagguaauauaugucaugucuaacagaguaccuagcggugauugcuuuuauaaucauuacuguguguugguuucagagaaguaaagugagagaaugguuuauuagacagaguuuuccauucuaaauuaagauuuuuuagggcuccauucugaaucaguacaaugauagguauuccaugaaaagaauacuauuuaugcuuuaaguacauaaauugcuuucuuggucacaucucuguccccuuuuauuuuucuuaugucuuuggagaaaauucugcuguauuaauuuugugcuuaugcaugaaacagaaaugucuguauuuuccagccaguacacuuauugagugcccaucaaguaccugccaugacagacuuugugcugguauuggagaaaguagagaugcauaaaaucagaaugcugcucuuaagugccccacaguguagugagguagacauauaaacaaauaaaugaaauacacugugauggauagaauaauagacagauguuggagacuuuucuuaaaacuuccaugucacuuacagaauuuucucugagauugcccuacauaaaauaaagcaugugauuagauuauguggcaguaagucagcuacacuaugucauauagaugauagguggcaaauauuagaagggaggaauuuuaagucuuuagaaguuuguguuuauuuagauagcaguucaaaaguuuuuaaaguuuuuccugacaucuuucacacauuccauuaauaauaaaaauaauuaacuuugcuacuuguacacauauuuaaggucuugagugaauuguuauuauagcacuguguuauugauacacuuugccgcauuucuuucuucugacaucuacuuuucuacuucugacauuaggugucagagaaugggaauagaagaaaaauagaugucagaagaauauuuuaauaugaaaaaauagauucuaaaaccaauguaguauugcuuugugcauuuuaaaaaguuuauguacaugcuaacaacacggaugcuacauagagcugugcaacuuccuuuuuuucuaaugcauuacacuuuugagguauacuacuagaagaugaagauuuuacauuagggaaaugaaagauuaagucaagaagaagaaaucuuuugauauguuugcuuugaaaagccuauaacacagaauguggauuguucugauacccucuuauuaaguaaucuauuuuuucuuuuaauauuaauuugccacaaaauuguauuaaauacaucaaucuucuauacauuacguauguugcaaauauauuggccccacuugaaauuugcauuuuauguauuuuuuuggauguguaaaaguuuuaagggauuuuuauauauaaaugucauaaucuuaaaaaauuauauacacacacacaaaaguaaacagcuaacaguuuuuuaauugugguuuccuaagaggaauuccaauguaauucagcaaauguuuuuugaaugcuucugugucccagaacugugcuaguaaguacucuuguguacaugaaaauguuccugcacuuguagagcuuauaguauaguagaaagcauuuauacuaucaugccauuuaaugccaccaaguuuuuaugucuccauggucauuccuuuuuaaauucugaaaugguuggaccauuaauuugauacaaaauauggaaucucuuacauucugcagacuacucauggaagaugguaaguggccucuggaauauaagaaauuacauauauuagguugaauuaaugguccagcuauuucagaauuauauuacaguagaaguuuugugagaacguguaaccaaaauaucccuuguuucccagaaggcaaguguauuuugccuaauuuagagauucaacacaguucagucuuuccaugauuucuauauggacuaauacaacacaguucaaucuuuccaugauuucuauauagacuaauacagucaugucuugucuuuugguaugcuguucugaauuugucauuuagaauguacuagugggcaccaggaacuugaauaacuuaaauauaugaacuuguuuacauguuggacagauguauuuauucucauuggaauaaugauugugggagaaugagucagauuaaauuucauauacauaaaugaaucuuuucucuuacuguuuuuuauggcauuuauuuuggaaacccugaaguuagagaauccuuucuucacccuguugucugcuuuaguucuuuucuuuauguuuaauacaaagauucaaagugaaggggauagguuaaaauugauaccugauucuguucacuuauuaucuugcauauuaagcacuuuuuauaucuccuugguuauucauuaauacaguaucuacauuuauuuuaggagcaagaacuacugguuuaaggauauauaagauuuuuaggaaaaagcaaaagguuggauaugaagugauggaaagagccuuuuguaccuaauucagcucuaacucugggaccucaggcagguccccauauuuuauuucuuucaucugaaggauaaaggauuggauuagauuacuuuaguguuucuaauuauaucaauuauauauugaauauuuuaacauuuuuaagcaaauuugcuuuucucuuuaaaguugauauaggaaauggaaaugugauuuacacugccagcacgauuaaauuaaauuuuacuaaauuaccauuauuuaguuuucugcuuauauagagcugcuuuuucucacuuuauguagcaugcauaaaauaaaauuacaaaaaaagaaugacauaggaaagacuuuucuuaagcaucaauuuauagugcuacaaauauuaucaaauauuuacuuugagugauuuuuagauauguauuaguuaaauaauuuagucaaaaaauacugagauagcuguguuauucaagaaaucuuuuucgauagagacauaauaacuaugucauaguugauuacuaaacagcauauuugcuuagggccuuuuguaugucagagaccuuaagcaguuugaguucucauuaucuuuugcuuuggguugaggagagauuugaagagaaaauuacuaauaaauugguuguaauuguagauagcuugaggucagugaagguagaagaguacccaggcaaguauuucuugggugcuuuguauggacuuacucucuuaccgguacuagauaggauaugagaaaagcacaagauauucucuaguuggaguauaugauagcacacagaauauuaaaaaguaguagugggauacuguaguaauucaguaacgcuuuugagugcuauuagugcaaaaugcuuuuugguuugugugcaaaaauaaggauuagauucuguucuuggggaaauuauuuuuuaguaaaccguacauguguauaacuaguguaaagugaaaauuaaugaguaaugaacacuugaagauauuugggggauucaucaguaggagaaggaagaaaaaggguggaaagaaaggauuaggaaagauauuuugaaauagauggccuuugaacuggguauucaagaaguaggauuuauaccugugauaaggaaggaggagggguagggagagccucuugaaagagguuggaugugaguggcaauuaccuaaguuguugaagaagagaagugaggaaaaaaaugcuaaaacaggagagugacuuaagaacuggaaguugggacggguuaaauguuuuuuagguagcgauacaaacuagucugaugaaugcagaggauacaugcuccaguagaaaguuauaccagauuaugaaggacuuugaaguuagggccagaguguagaccugggugaggaggaaaucaaagacuauagguuuuaaguagaggggugugaugagagcaguucuuuauacccuucauaugcuguucugucucccugaaucauaagauccuugacagaaagaccuuaccuguuucuuucccuuaauccgucugcuugaaaugcuccuugauuucuuuucugccuggaaaguuuauuuccuuucggguguaagugaaauauacaguuuccccuauuaaggguuuccagguuccccaagaggcaaguguuguccuucuuguuugcccuguucauauuuguaucacccagaacauuuaccacuugaaauaucuccuucacuagacugauacuuauugagggccgggaauuugucuuauucauaauuauaacuucagcacuuagguauccagcuaaaagugcaugacgugucuguugaauggugauuauauagaugguucuggcaguaauaugcccaaugaauugaaagagaacuuuaagcaaacuuuaagcaaggaaacuagguaggaaaucauugugguaauaaaggcuaauaauacaaaaaugccaaaguaauuuuuaaaaauacauaaagguaggagaguacauuaguuuugaagucaugacugggauugagugauaaagggaauaaaggaaaggaaugaucugaugacucagguugguccuguauguagucaggcaauaauauuuaaccaacauuuucaguaauuaggaaauuuuaggaauuaugacuuagacaaaccuaauagcuucuuauacuuaaauacaucuuuuacuuauguuuaacuacugauaaaauguuucacuguuccugugguccaagauuucucucauuggugcucuugaccuuaucacccuaaggauaucaaaacacuuuaauaucaucucauuuuuucuucaguuucagccauauaaaugcagagguuggaaauuuucaaugauuuccauaugccuguauaguucuuuucauguguaauguuaagagauuuuggaggggauaguccaaauaugagacauaccucuuaauuguacuccuucagcaaguugacuauguauuuguugucucuucaguuaagagaaggucuuauuuuuucugaacaggguuaauuaagccuuagugcagugcuugguacacagagaucugacuuagaaucuuccugugacuggaagacuggugugaccacaguauuuccccugaccaaagagagaggagagccucaagugagcccuugcuuuacagcuucugagaguucccuuuugaaauagggugaugaccuuuaacagaugguuacauuuaugugauaauuuuuuuuaaagcaaauaguuguaaugaaauuauguuuuuaggccagaaauauaucuuaauuccuaugacuuacauguuuuguacauugaaguauaacacacagcauuaggccagagacuucuguucccuauuucauauacaaacacaauugaccagaggagcacuugauuccuucaauuauugcccucugaauccaggagugauauggagcaaacuaaucagaagcaaacuugauagaaucauuugcucugcuauaauuuacuuacaacucuggaaaacucaauuauggaaaaaugaguggaacauuaaaaucuuuuugagaaagaguuuaccacaaaguuguauugccuauauauuuaaaauagagaauucucacgaacauuuuaguuuuuugacuguagcuuaaagugcugaaguuucacuacauuaaaaaguauuauaauuuuaaagauauuauaugauuaauuuggccuuuacuugucuuuaacuuaggguuagguuauauuuuauuucaguuaaugaugggaaagaaagagcuccaagguaguguuaacauaacuuaaaacuuuuaaauugccacuauauuaaaucauuaaaaacaguaauuuuagauaacuguuauucuaccuaaaaucuaaacauuggacaguacuuaguuuuaugccaacuuuguacugaguaaauuugauaugguccuuaugaugggcguuuagugucucuuuuagccauguuuagaugguauugaaaauuuguauucugccuuucuuuuuaccccuuucaaaaaacaucuuagagacuuucuuuuuaacaaaaaagucuuuccccacuucuccaaguguacuuuugauagguauauuguuugacuguuaggacaagaauuaugauagauacaaacaccauugaauuucuuuguuuucuguaggauaagaauauaagaacauaaaacagaauuuuguuuuauuauauaguucauuauaaaaagcauguuaauuuagugcuuauauugaaguuuuuaaauuuaaugugagacauguuuuccuuuaauuuuacugaaggucuaguguguguguguguguguguguguguguacaugcgagguucaggagaaaucaguuuugaauauucuccagcagccuuuuuuuuuuuuccuuguuaaaugugugcuauaaauugugcuucuugaaagagguaggaaggaauguggaaaaggaaaguagagaaauuaaaaaucauuucaauaaaaugcuuuaauuuaugccucugcaguuaagcagugcuccugguuaacagaaauacccuucagcuacacaggauuuuggaggguuggagggcacucauuugcacauaaauagccauuaacugauaaauucccagaggucuccuguugcauguuagugguucugaccuacuuagcuagcuggaauuuguuuuacagaauuauuauaauucuauccuuggugcuuaaacuuugugauuaaugcaugccucacaauacaauuaaaguauaauuacacaguuuugcaguuuccuauuguggaguuauuauuacaaagaucuggauuuugcaaauagaagaguuacgguuuccauauuucucacuuuugcuguuauuaggugauuaucuuaaaugggaccauuuuaugucugaagaagggauuggagggaaggugaaucauuauuaaauguagcauuuguuagcuuggaaaugauugggucagcuaauguguggucauuuuugcaugcugucugcauugacgugucacaggcauucuuaaaacuguuuugugcuuuucauuguugcuuuuucaaguguuucugaauuauaguagaaucuucacaccauuuucuaagaaaaguaguguuggguuaaauguuaggaaacaguagagagacacagugggucucaggagaucuaaauucugaugcugacacuugcugcuuaguuaugcagaacaauucaugucccugaaaguuugucgcgucaucugaaaaaugaguaguuuagacuagaaaggauuggaaaacuaaggcacuguuggucagaucuuguccauagcccauuauuguguagccauagaacuuaggauauuuuuuacauuuuuaaagaauuguaaaacaacaggaagaauaugugagcuagacauugcaucuguaggcacagcaacuuagucugggcaacauagggagacuuaaaugcuuaacccugucucuuaaaaaaaaaaauacguggccgaguaugguggcucaugccuguaaucccagcacuuugggaggccgagaugggcagaucacgaggucaggagauugagaccauccuggcuaacauggugaaaacccgucucuacuaaaaguacaaaaaauuagcugggcaugguggcgcacaccuguagucccagcuacuccggaggcuaaggcaggagaauggugugaaccugggaggcggagcuugcagugagcugugaucgcgccauugcacuccagccagggcagcagagugagacuccaucucaaaaaaaaaaaaaaaaaaaaaaaagacacuguacauggcccucaaagcacaaauauuaaaaaaaaaaaaaaauugccagcucucuggcuagauguucucuaaggcuccucucaauugacauucaguauuaaauuauaauuauaguugauuuuuuuuuuuuuuuuuuugacacugagucucacuucauagccuaggcuggagugcaauggcacgaucauggcucacugcagccuaaaucucccuggcucaagugguccuuucacuucaggcucccgaguagcugggacuacaggugcaugccaccaugcccacccccuacccccgccuaauauuuuuagagguugggucucacuuauugcccaggcuagucucgaacuccugggcucaagugauccuccugccuuggccucccaaaguguugggauuacaagcaugagccacuguggccagcccuaguugauucuuuuaaaaugcuaauguuuuauagcucuaugcauuuguuuuggguuucauuucuuucacguucacuguuuagagugaucugugaugucaugccuaauaccugccucuucaguguccauuauacauccaguuaauguuaucuuaaccaugaggaugguaaauuuucugaagauucauaacuugaaauuuagguuucuacugaaaggaauuccuaguaauagauacuaagaugucaguucuauugaaggggaggcauggggaugaaaugcuugacugacuuugaaacacuuaacaaugucaguuuggaacacuuugaaaauuuuauccuguuuuauaaaaaaauacaaauacaugccaaauaauauuguuuaauaaacaacaacaacuuuuucuauaaauuuuuucggagcaucaguuaaucuaugcugcuguguuacaguaggguuuggcauuccucacugugucauugaacauggaaaguaugggccacuguuaaaguuuggcugccuuuaagugguagucagcuacuacugcuggagaaauuuagcaucauauauuguuuacuuguuaauaugcauuaaauauaaugagcuaaguacuuuuaaaccacuuuuauucaauauugugggggaaaauuuagccccuuccagaagaaagagauggucagaaacagcugcuuuguaaaguuggcauacaaucauuauauuucuccaaagaaaaaaugguuacccuguaauaaucggucuaaugaauucagaaauucauugauugucccagcucuggguagauuagguagagacuugcuucaaggaguggaauuuaugaaauguuugcugcauccagcaagcagagcugcuauaauacagcugccuccucagugguuugcuuugauccuguggaaugaaaggacaggaggaucagcucaggucuaaaugagauuacagcugguucugcagcuuaucuggucuauugccaacuaguguggcuuugcacguccuaagggguuuacaacagaaacuguuuauugaguaucaucgguuuacucaacacaagcaggcuaauccuucccagccucagcauguuguagaauugugcaggagccaaaccaaaagcugguguagccagacccucuagagcccuuugucucgcuguauauugauuuuuaccugaguuaaagacaguaaaaaaaauaaauaaauaaauaaccaguccuguugugagcaaaagguuaaucuuaccuaaaaucuuacaaaaagcaucuguuaacccuagaagggacaaccuccuuuuuuugccuuuuuagucaagugggauuuucuaguuucgaauuuugaagaacaagauaagaaaaacagcuuaaaagaucuugcuaggcauuccaaguuaaaugcuuaagucucuucuaguagugcaauaacaaaaagcuuuguauguggaauaugggugauguguuucuaaguaguaaguuuuuguuuuauauccuuuuuguacaaagcaauuauuuuuuuugauguggcaaacaaaaugcauaaaaacaaggcuggaaaccuuaaggaaaagaacucaacugccaacauuaaugaccaguagucaucuuaaccugaucaucccuugauuaguaguauaguucuuuaaugaauaaauguuggugauuaagaguauuauaaagauacaccucuuauaaauaauucugugugugcuuuagucuuauuuuacuauuagguacucuuuuaaaccuucaaguguaagaguuuaauuauuacaguuaaaucuugaacaaagaugguuuauagugaaaaaugcuuuggagucagauacaccuggguuauaauuccauuucuguuacuuaguggucaaguuauuuaaccucugaguccauuuuuucaucaccaaacuguagaugauauuauuuacuuuacaguaucuaaaaaaccaaauuagaaaauacuagaaaguaguacugaguuaaucagguuagucaacgcuaagguaauagcucaggaacccaaagucauugaagauuauaugcauaggaucccucccauaaugcuagaaaggauauuuaaaaguuguguugcagcgaucuucgcagcuuugcucuauauauauagaucugaaacauccauugccauauuuaaagguauaugaucucaggcaaguggauagagagguugccagguaaacacccuucuguuagugcacaggaguagcuacuuggaaagccaucuguaugaaaucuaugcuaguuuaaaauuccuaggaaggccugaauaguaaacuguuauuuaggauaggugggugagcucuauuuauguccuuuccagcuugagugauuacucaguuguuuaguacacagcaaaauauauguaaauauugucaucuguguuaagugcuaaguaaaagacaaagguauguuguuauaagaagaauacaguggucucuugguuuacuuucuccuaauuggcagugaacauguguccucugcuauauguaagcacaaaaauguuacuguggaaacauuuguaggcuuucuaaaaguauuguucgagggaauaagcuaagacugauauuuaucuuaaacacauagcuuguccaauauuuaaaccuaauggacaagauguguaccaguugaaaauguaauauuuauccagucauuucuauucugucaaucuaggcucuaaagcaauagauugcacucauagaguaauaaauuuuuagugaauuuggagauaaaggcuauugguggugauugcuuaaacucuuuuugcucaaucaucugaauggugcaaaucaaagcauuuugucagacugugagaaguuucaccuagauauugcuucccacacacgcgggucaccauauaaauuacauucacgguuuuacagcauagcuggugcuggaaguuaaauugaugcccagugguggaacucguaaaacauuuuccuguuaacacgaccaggcagaguugacauuguugaugguggguucgaucuaauaaacuauugggucuaacagugauuuuuacuguguuucagagaugaugaugauacaaguuuagugauccagcaguucuuccugaaugacagaaaauuagcuccacugucuauauuaccaaaugcugggaagaguaagaguaagaggugauugaagccuaacguaaccacauguucugaaagaucaugaauuauaggaacaagcucuuuaacucaguguauaccuucuuuauaaagaaaaacacugauuuuucucaaaagaauauauuauauauuaucuguuggaaauacuuuauuauuacauuauuauucaaauauguaggcuguguccaccuuucacaaucuuuuacacagauguuguaagcugauuauuguuucugaaaggaaagcagguuuacauuuugguuacauuuuuuucuguguguuuuuuaaaguuacuuucuuauaaggacuuuaagcuuuaucaaagauuuuuaauuuugaacuacagcaacagucaaucuaaacaucuuauucccauaagaguaacuuucagggguuaauuucuacuggcaguuacaaacaauggguacugucuuaagauuuauuuugaacuacuuuugcauuguucuuaaagcuuuaugaaacuuugucuuauuugaaaguaauuuuuuuuuccaauuucuaguuaaaauucacaggaugguaacaaagcccuacucuuuuaucaguguaagcaaguaucuuuccauuucuuccuuguuugacauuauaucugcuccuauagcacuguugcacauucauacugaaucggugaucuuuuuguaguuuuguuccauuuuaugagauaucacaggucuuuuacucaccacuuuaacauuucuuaucccagcauaugcauggauuuuuuuuucaucaggagaugagcuuuuuugaugugcagauaaauguuaucaauggugcuacgcagaugaaaccugucauguacaaauagcauguaucaagcccuaagcaugcagauaccagauaaaucgguucauuugcugaagccuugcaaaaagaaauuagugcuauaauaaacgccuuugaggcucucagcccuaauaauggagcuuuauaauaaaccccacagaucauugacucaauggauaaucuuuuaggaaacuuuuuccccuccucuaucuuuuccucccuuuuaaagaacuacaguaaaagugguaaauagcaucucuauagggaauguaugugguaugaaacuacauaucuggaaaaccauaauuuaaaauuaagaaauuuauuuacugcuaaauaugauauuauucuaaacgagcuuauacuuuuugaugauuuucauaauugaucuuaaacauguauuagucacugcuuuuucuacauagaauucauauuaaacauuccuccuaaguuagugcauuuuguacaugagguuacaguuggauuguugacuacaacagaggcacagagugaggagaucaaaauaaggcagaagaggagucagggagagaaauugagaggaggcauucagcuuguacuuagaaguguuuauaaagugguagaaagcagaagaaaggggauggggcuuauacacauuuauguauacacaaaacuuuacacauaauuucaaggaguuugcagauuucuaaagauuauauauguacugcagguuuagcacuauauuacaauggugacuagacuguuauuuccauuaggguuugguuauacuuuugaugaauaaacacuuuaaaaaauaucccuagguacuuuuugacucuuacuugacugaguuuugaaauccaaaaagaaaaaaaaaaacaagucacuauuggagcugaugaugagguuuguagauccauuaacacaauuggcaauggucacuaguuucugguuguauaauuuacugcauuuuuugagugugagagaaguguugaggaugcagaaugcuuaagagguuuuagaaaaauuauuuaucaaagaacacuacuuuuccagugcauuagcuauuguaauuauacauugguacaaucuguucacauagaauuggauuugauuuaaauggagguggggggaagagacuggacauuuucaauauuuauugauacauaguccguuaagguaaauuauaaagcaaauuucacugugacgggaacauuuggguugauguaguuaauaaucagucaacauuaccauuagacccuuuauuuauaaaaauuuauuaccaacaauuaggaaaaaugcucacaaauggacuucagcccuagcuuacuuacuguggaauaguugaccucaaaaaucuuuggcucuuuacuuuuaauaaaaugacuccaaauuucuuuuuugaagcaaugcacgcucccccacauagcauauagccacuaaccacauguaaaaugugguagaaugauugcaguugucauuagaggguagcagugacuauguacuacuguuuucgaaaaagacugcugggauggugagagcuaagcuaguuuuuagaggauaguuuuauuaauuagcuuuaaaagguggucuccauagguucauaaacauaauaccuuacaucuagggaaaacuaaaaugaaacuuuugaaagcagcaagaacugaauaaaguuuauugagaggaaauaugauaauauacauaaaaugucucagcauauguuucauauagguguucugugcuggauagguagaaaaauaaaguaguuuuucuuaaaauuacccuuaucucugaaauucauuuguccugaaaccaguccagaauuucuuagauuguugggaacggcuucuaggagacuuaaaacagcuauuuugucuaagucugccuuuguacuauuguagauacuacccugugguuauauuucuaauaaaauucuuuguuccucccaccucccaccccaagcuucccaagugugaauuccuuuaggucaggucugcaucuuuuucaucuuugaaucucuaauuccuacauagugcuucuuauaugcccuuuagagcauaauauacuauguaauaacauaguggguaaaacaccacaacagcaauccuuuuauuaugcuuacagauucuguaggucaggacuuugaaaagccaagggcagcucuuaucugcucuaccacgucuggagccucagcuaggaugauucaaugucuggaaguaacucuaauucaaugucugugaguaacuaaaggccgagacuagaacagcugaagcuggaggauccaguuccuagauggcuucuucuucaguaauacaucuaguuucuaagcuagaauggcugguggacaagcuuagcuggaacuguugaccugagugcugucuguggccucucgaacaggguauucucagggucauuggacuuccuacauugcauuucagggcucuaaaagugaguauucccagcaaacaaggcagaagcuuuauggccuuuuauuaccaaaccuuauagccacauaaugucaugucugcugugcucuuuggucaaaucagucacaggaucucucagaaucaagaagugucaaagaauuguggccauauuuuaaaaauuacacguuuuucagcaaacaguggaauagccaaagcaagacagagauagagaugcagggugggggaggauugggaggaggaagaaaauuaaagauugugagguguucuuaauaucauaguaauuauuggcuccagugcugcuaaguuagauagauugguggucucuuccaaaaugaaaaugagggcauauuccauaaauauuuuguucacacuguugcuuguauucuaacuuucuuuuuuagucaccaauuccuaacugccccccggccugagcucauucuuuuuucuucuaugagaauucaauacauaacauuuuggauaagaucuagugcaugugugcuugcacaguuauacccuauccauuuacauuugaagaggaagauaauuguauuugaaaucccaaaaaccaguauaacaacuucacauauuuuauaaggcauguacauuuuguugugagauuauuuucagagaugaucucaccucugagugccuuuaaccccaaggacaaagauccuggaccuuaacuagugguccuacccacgugauacucugguaguagaaaacuuggagacugacuagcuucauauucagccauaaucucccccucuuuuacuuucguucauuacguuguacccacacacuugcuauuaaauuuggaggaugaguuccuggaaaugggagcccuaacugaauacaagcagugcaaguugucacaaucagaugaugaucauucugcucuucuuuuagaaauuacuaaccuacgaugacgucuguaguuccuuauaguuauaaugccaaaggauguacccaagccuuaauuguggccuuuacccucaaccauuuccuugaaggcaucuugugaugcuguaaaacuuaaauuuuaacauccagcgugaaaauuuuuauuuuuuuuguguguguuaacuucaggacuauaacuuguuggucauaaugaugcuuauaggugaagcugaugcuuaugggucagcaccgaagcuuauggguagcucugcccaugcucacuuuuauuagaugagagcauaagauaacgcuuaagcauuggcaaaauguauagauauagauauacaaauguauagauauaauuauguaucuauauauguguaguauguuguaaugaguaauauagauucguauaugugcaaagucacacugcacauacucaucagguuggguuuuuuuaaugaaaauauuucagagacaacuagcauuguaacauuagcacagugcaguuaaagaggauguuuaaauguauaaauauauuaggcaauccuuaauaagcauuagauuaucugggaacaaaccaugaggaauauauauguuggguauauaaguugguuuucucucauuuccagcuaccuuaaagacuuuacuuuuggcucuaacuuuuugagaugacaugauccucuaugaccuguuccuuaucaauacuauaguuacauuauacaaauguauaguuacauuguucuuaucaguacuacaguuccuuaucaauacuauaguuacuggcacuugacuaaagguaauaccgucuacuaguaauaccacacuguuugugaaucccuucauguaccaugcaauuucaugucacuaugcuuuacucauguuauuuuaacuuucugcaacucuauuauuuuuuuaauuaacuaauaugacuucuguaacagguaauggcaugucuucuccaggaagucuucuuugaauccuguuuuuuacucuuuacauaccucugucucggcacuuaacuguacauucuuugaaaggaaggacuauauuugauaacaucuaguacaauggcucauguaauuaacagacauugacguguucauuaagaugaucugaacuauuagguagaaugauuccugagucugauuguacucuucgacucuagguccagauuuccaaaaauauuuucgauaguguuacuucaauuuucucuuuucauaucaaauuauauccuccuguuauaauuaacugucccucguaacuuucaguuuuucucccccaaaauuuggcaaugacaggcugcuccuuccuuucccucacaaaaugcgaaauaauuaguguuggcuuuuuccuucauaaaguaacugaaaaugcacauuagcucuuaccuggauguuuacagaagcuucuuaauuaguuucuuuuaucuuuagucaguucuuguucugacccauucuguuugccauuaccugauuaaucuuucccaaagcacuuuuuucauuauaucacccuccaguucagaauccuucagugucuucuuaccacuuuaagaaugaagucuugauuuuucuuuuaacagcaggauuaaccauuuuuguaucucuagcaucagacauagugacuagcacugaguaacuucuucugaagugaaugaagaaaacauaugacugaacaaauggaacaccauuuguauucuuaaauuuauugccuuccaaugcuacuauaaaaauucucuauuauaaucaaagugguuacguuuuuuucauucuucaaacaccuuguucuuuuauauauuccuuuuaagauguaaauuauauuacacuucugcuuuucuggcuuguuauccacuuggauuuuauccaaaguccuuacauggcucacaagaucuuacauggucuggaacccugccaccucuccaguucaucugcuguucaucugucacccauugugcuucagccacuuuggacuccugguuguuguuccuugagucugugaaacugugccaggcccagcaccuuugcacuuuuucuucucacuggaauauucuuccccauauaccuguguguuucccucccuuacuuauuuaguucuuugcucaaaugucaccuucuuaaaagauguuuccugaucauuguacaaguacaauguuauuguacaaaguucuaucaaucaucauccccauacugugauuucuuuuuuauacauaaagcucaccacaaguucagguauuacaugguuguauguuuaauuaucugucucucauuagaauauaaguuccagagggcagagacuuugucuguuugcuaguuuuguacccuacugcuuagaacguaugcuguauauguugaauuagagaguaagugauuugauuuuauauaccuuuguguuuuuacuuuccuccuuuucaccuaaacacuccuuaccuauccuuugagaaucucuuccacgcccauuuucuugugcuuccccccaaagguuuuucuccucugaguugguaaaacaaucuuauacuuuguuuugcacuuauaccuauagaguaaaggaguauuuucaauccuccuccaugacaggauuauguaugaucuuguuacuuagucuaugaacugcuaguugcauggucauugccuuaucuguugcaggaauuaaauaaggccuauucaauaaaugaaauaauuauugaucagaaaaucaaagauuguuuauugaaaauauauaugccagaucuauucuaaguguuuggccuuuauuaauguaauucuguagguacuauuauuaucccuuuuuuuuuagaugaggaaagccaagaaggugacugcccacagcauggugcaccauaggauagcagcaucugccugguagaaauguagacccucggccgggcaugguggcuaacgccuagaaucccagcacuuugggaggccaaggugagcggaucucaaggucaagauaucaagaccaucguggccaacaugaugaaaccccgucuuuacuaaauaugcaaaaauuagcggagcaugguggcacgcaccuguaguuccagcuacucgggaggcugaggcaggagaauugcuugaacccaggagguggagguugcagugagcugagauggcgccacugcgcuccagccuggcaccagagcgagacucugucucaaaaauaaacaaaugaggccaggcacgguggcucacgccuguaaucccagcacuuugggaggccaaggugggcagaucacgaggucaggagaucgagaccauccuggcuaacacggugaaaccccgucucuacuaaaaauacaaaaacauuagcugggcgugguggcgggcgccuguagucccagcuacucgagaagcugaggcaggagaauggugugaacccaggaggcggagcuugcagugagccgagaucuugccacugcacuccagccugggugacagagcgagacuccgucucaaaaaauaaauaaauaaauaaaauaaacaaaugaaauguagacugucagaccaacugcgucaggaauuaaaaacaaauaguaaauauuaugauugggcccaaugcugaaguugcagaaagaucuuuagugaggccaagacauuaguaaauuuguagaaagauauacagauaauuuuggugguagucaacauugggaacuacuuacaauaauaacaaggaaguggauccuuguuacuacuguguuauaaaauacagugaaacguaacugaaaaacuuaaguaauuuuauacucauaaucaucuacaaagucaagacuaaugaaaauaugaggguaaauucuaaaaaugaugacuucuuacugguauguuuucauaccagugcuaguuacuguuuuugggacacaggcaagcaacuucauuuuaggcacuucaccccuuuuauuguauguaagacagcauuauuauaggcaugcuugguuugcuagguucaucacuggauuccugauuuguuguucuuucccagucuugcaaacuaagucaauuuuggagcauaggaaaauuguaaauuaucacacaucguugaccuuuggaaucccuauagagccuggcacuccccagaaguauuaaacuuuuaacauguaugcaucugguauaucaccugggauuagcuguuauacuacuuuauaacuaccuuuauuaagaacuuacauaugaaugagugaauacagcaaugcgacauuuggagcauguauuauuuauuuguguaguaaaaugguauuugaggcagcuguagcauagugauuaugaauugggguauugaagcuagacuguuuggguucaaauccuggcucugcugcuuacuaagagcaugacccaagcaaauuacuuauccuuucuguacugagauuccuugucuauaaaaugaggacaauaaaguaccuacagauuaaauuaguuauaaaaggucaaacacuuagaauagggcuaguacauauauuaucauuaaacaguuuuuaauucucuggccaacccuaauaguuacucuuuauugaauaugucuuauuuaauucuugcagcagaugaggaaaugaccauccaacugcuaauuggcaaaauaggauguauacuuuaguaugucugucuccaaagcuuguaucuuucuagugauguucgaaugccucuaagaacauguuuauuaggauuuagaagcaguagugcauauugucuugccuuacagucuaugaaagugcauauuauuuugccuugucuacaaaguauuuuuaccuaaaugcugugacuuuaaugcuuuagcagcuccauagaggacaguagggccuuauuuccauuuaacagaugaaaaacugaggcuuaguaguuuuccagagucacaagcugaucuuuucugucuuagacaagagcucauuugaagaauucuccuugcaucucaaggagcccuuauuuuucucuguaauuauaugugacgguaagcaucauugccacugcugugcuuuaucaucaaaacagucaauaaacucuugcuuugauuucacauauucauucauucauucauccauccauccauccauccauccauccauccauccauccauccgucuaccaccuacuuacccccuccuccacauaugcacagacacacagauguacuggggugucuguuacauggaggcauugcaaagugugcuugaaugcuacuugccagccugguuucucccugacaauuugggcaugcacaggauugggacucaggauugaaacuaccauuaucucaaauugaggcuuuguaaaagucucuucauaccuagaaguugucuauuguuuuuucucauuuuuugaagacaagauuggauugaugauuuuuuggauaacuuccacuguuuaaauuucagggauuuuuuguuuuucugauaaugccauuaccuuaguuauguuauauucuuccuggauaauaaggcagaguaagcccuguuucacagauacaagcaaguaugaugagaggauucagugucuaagauuuuuuagugaguuuagcugaagcuaaaaaugguuauagaguguccugauucccauuuaguuuuccaucagaucaauaagauacuuggaauaauuacucauagugguuuggaacaacuuuuugacuuaaaauuuuccauuauauuuuucacuaauaaagauuuuuuuaaaguuaccauguuugcaguagaguuaaaagaauucaauuauugcuguuaauccuuaccagucauauuuauuauauuaugcuuuuuccaugugaugaaaaguccaucaauagacaauuuuaauuuuccuuaaacuuugaggcaucauguauuagaaauaauuaauauacaacugugaauaccaggaaagugguauauaggaugucauaccuuauucuauaacaguuauaggagaaacaaugguaugccaagauuagaggcgaaaacuauaagcagugguccaguaaguguucccagaagccugccuaaguuacuagggaggagcagaaacugagagaccagacuggcagguagaaguuucagguacaggguuccaugcgucucauaugauagaugccucaauaaauuugugugucuguggggauaagguaucugugugggaguagagaggugggggcaaaauggauaaguaaacaugaaaucaaagcaagaaguagcagacaaauaaaaacaggaaaucuuggaaaguggggcaaaagagcagucagaugaaagaaucaggaaaauacuugaagauaaugaggaaagcuaaaggaggcaggguaacugagcuaaaauagaagcguaggaacaccuggauaauugguaugugaaaguguggguguuuauauaguguaaugauaggcuucuaaacuuuucagaauguuauuuccuguggucuucacaauaacccuguuagguggauauagcaacaauuguuccuguucuugacucuaaagaaaacagcgaguugggagguuacuuguuuuuccaaagccacacugcucuggauagcuaugcuaauaaccauguuuauuacgcagcauaauuacuccuuuugucucaauuuucucauauauaagauuugaauaauaauuaugccuaccucauagggugagaaacgaugcuuauaaaacacuuugcauggugcuggucucauaguaaauaccaguaaaugcuggauguugcuguuauuuccaccaugagagcugcaauuugaauaacuugacauucagcaaauuuauuuucuacuauacuguauuguaucuuuuauaauguaagagagcugguuacauguguguauuuccuuaucugaucuuguauuuccaaacugaucuuaaugugaaaucugucuuuacucaaauaaaacaauugccaaguguugggagauccuacauccuuguguuaugucuuucaguuucugaccagaaaucacauauuuuuccuuuuaugcaaaaaaucuacuuacauauuucuacuguuuguguugaagaagguaaauaaugccucauaaaacagccaucaccuagaacuauauuacauucuuuauaauauuuuauguauguuuuguguuuucuuuuacauuguuaccucuagugacagagcuucuucuuugcauuuuuguaaauguaccuucagcagauaugcaguggucacaucuaauauaauuuauuuuucaguagucuguauaauuaguuuucugguucaaacaugugauuuuaaaaaauuaccagugucugcaaggaguauuucuagcuauuuggcuauagugcaaaaauuugguucuuccuucagacuucuauuacagugcacucuuggcauuuccuguauuugucacucacugauuucuuuaugcuuaaauaaauuauuauuauaaggucuuaaacaacuagguucugguuuaaaauagcagguaaucauuucuucuuauccagacugaaaaagcuugaacuuucaaacuauugagcaggaaacauuuugcauauucccggggauauuagcugcuuuucaaauccaaaaacacaaagugggugcacauuuccaacacaagugugguuuggggucagugucuuacccuuaguugaaacuugucuuagcuguuuuaacucaaccuuggaggauguaaucuauagcuuuaaaauuuuuuaccucacaaugguuuuuuuuuuuuaauuaauuauucuuuuuuuuuuuuuuuuuuuuuuuuuuuuggagacagagucucgcuguugcccaggcuggagugcaguggugcaaucucagcucacugcaaccucugccucaagcaauccuccagccuaagccucccaagaagcuaggacuacaggcacaugucaccacgcccggcuaauuuuuuguauuuuuaauagagaugggguuucacuauguugcccaggcuggucuugaaauccugagcucaggcaauccacccaccucagccucccaaaaugcugggauuagagguauaagccacugcacucggcuuuuuuuuuuuuuuuaaaccuaauggauucagaacuuugaguccuauccccacguuagcucauacuuauacucccugguaccucaacguuuuguuguggagaggucaaaggugguucacauuuguuggccuuucucauuauugccuugaauacauguuuucuagcaucucuucuuauagucuuuccuaauguuagaauucugauguugcuccuggcccuucaaaagacacagcuacauguggcuuuuccagccccuuuucuuaagcuuucugaaauuccuuuauuuuauuuauuauuauuauuauuuuuaaauuauuuugagaaagucuugcucugucacccaaguuggagugcaguggcacaaucucggcucacugcaaccuccaccuccuggguucaagcaauucuccuaccucagccuccugaguugcugggauuacaagcguguaccaucaugcccggcuaauuuuuuuguauuuuuauuagggaggggauuucaccauguuggucagguuggucuugaacugcuggccucgagugauccacccacccuggccucccaaagugcugggaugaaauuucuuuaaccuaaguagaaagagaagauaauuuaucaauguuuaauucacuuaaaacuuguguauguguaggcgcauaagggugcaugucuuaguguguaaaaagaaaagugggcuucagagucagauuuaaguucagaugauggggccagcccuuucuagccaugugaccuuugggcauauuuagcuuuccuacuguuagcuucgucaucuauaaagaggauuaaugauaccuaucucauagaguuguuccgauuuuaaaagaauuuaauuaauuuaaggaauuucuagcacauauauagaggucgaucagaaauguuacuccuuccuagggaauagguuuuaguuaguaaauaaaauggcuuuuuuagauauggugagcaaaauccauccuacucaaguaccauaaguuauuuauugucuuuugaaaccaauauacuuugaaaaagcuauaaagggcaguagaaauggugguauuauuuuacauggauuccacuguguagaaauguacugugaacuuugcuauguugauauaggcaguugaguuaguugccagauagauuuuagugguuuguuauuuaucucacucuaagauaaaggaacugaaaugguucucuagccacuaguucaaguugaaagcaucucaagaaguuuuuacagagaggacauagcagauauuugguuagcuuuuaugagaauuguuuacuguauacucuuuccccagccauuuguucacuuguuuuuugaauauuuccuguaguauuaaguaauaucccauaauuuuccaggaauuccaauguaaaggggcucaaggcccuaauguuauacaguuuauacuuagaauuuuuacucacucuuggguaguuaugcgaaauauucuaagaugugaucuuauaaccagcuugaucuuuuugugggauugcuuuagauacacaugcuaguucuguguuuuguauaguucuuucauguuauccacuuccccuaaacuguuuaaaaacaucaaacaucuuuuuuaaaguacuuaauuauuuuucuuaguggaaugcuaucucuauuaaaggaagucuucuccauaauuuccauugguuauuuuuugcugcuuucuguauaauugaaaaaaaaaugcaaauguaaauguauccaugcauuuaugucuacucaguugaucuggcaguaauauaaacagaaacaggaauaauagcaugguuguacauuuaguuuuaaauaaucauauuaucagugggugcacaacauaaaugccuucuguuccacaucacuaagaagaucucuuauuucccucucuuugguaaccucaauuuccugcacguuucuauuaaggucuagagauaucuaaauuuucgauugaauuaaucagcaaaggugaguaaaugauuaaucaaaauuugaggcaguaucgaauuauguuuuauuauuuuaugaagagcaacuuguuauuguauauuauugccuaccaagugagaaugauuaugaaucuuuugggaccaaaguaguaagauuguaucuagcauaguuuugucuacuacacaaggccugugucuucuaaacaaggaaaguauuuuaauuuaaaauaccacgcauaagccaguuguacuuaccuuccucuugguacauccauguccuaaagcccucaggagaaaauuguuuuaaaaauuguuuucaugucuagauuuuaaguaaaaaucacuugucaugugugaguugcaaaaugcagaccuucauucugaagcugccucuuucucauuuggaucugacauauuaaaaagcauauaauuaaugguugacauuaguaguuaacauuaacuuuaugaugcuuaauaugccaucauucauccaucaaacaaccagaaaugcauaaugucuuggcauaaagguuuuaauuauauaaaauguuucucauaugauauaaauggaaaaagcucaaaauguacuuuaagaagauuuuuguaagcauuuauuaaggguguuagcuguauuuuuauuucuuuuuaggaguaugcaucaacaauugugucaggaacuucaaagggacaauguggaccuauuuguacagucuucauuaucggcuaaagagcgccaccuugcugcaguugccagugcacuguggagacauuucuuuucauuuuugaagagucagagaaugucacagguagugccuuucucacaacuugcggaugcagcugcaggucagcauuaauuauuaauuugcuaauuucucuuuuugcagacucuuugucaguauuuuccuuuauuuucuuaguaacaaacucuuguauagcaaacauuuugucagccagaaagaugaaacaaauuacauauuaauaaauugggauccuuuggcuuauuuauugcuaaaaauuaaaugauuauuuacuaaaaauaagauaauuuucuauccugaaaauauugaauauacauaagcuuuucuuaugcauguaauauuuuggaagguaaacuagcauuugauuacgugugauucaaguaguuuauuuucaaauuguaugagcagauacauagguauaagaugaaguuaauuuguguaaagagcaaaagaauauaaaauaaauaccacuucaaucccaagaagaugagaucagaaugacacugaauauauaggauguuauuguucugacuucuacuagauucuacuuuaaguuguaauuuuuacuuaauuugauuauuaaccuaaagacauguccuuaggcuuuaagggacucuggaucucaugaaauuauagguaagaauuugaauauaugcgcauauauaucauuucuaagaagaggccauugucuucucaaggggguauuuugcucaaaauauguuaagaaguauuggaauagacagugauuaguaugguaacuccauguacuugaaugaaguccauuuaaagguauuuaauuuauuuuuaaauaauaguuuuaaaaaccuaagauuuaaaccaauauuuauccuaguguauacgaggaaaacugagcuuaaagugcuguguaaaagacuaaugauuuaaauuugaaaagauuuugaauucugauaacacuucuauaauuaggacuuuacgaugauagauuaaagaauugugacaggacaacaauuuuccaacuacuguaaugucuaugaaaauaaauauugauauucagccaguuuaagcagucauuaauagaugauauaacuuguguacaugcaucaucccaacugccagucaacaaaaauaauaaugcaucaguucagucagugcugucuuagaugcugaagauaaaugguauauaaauagaaagcaaaauauguguacuuuggcuuugauuugaaauaaagacuugauaguuuaggagagaaugauuuucuucauuuaaaaaaaguuacugaauaccuaguuuaauaggcauuggagagauacuaauggagaagaaggacaaaaauacuuguucugauggagcucauaaucuaguguuggggcauaggaagaccacuaaaugaguaaauaguguaauguguggugauaaaugcugugggaaagaguggaauauaggauaggaauacagaaggccagaggcaguugugauuuuaaauagaguggucaggaaggcccaaguaaguaauauuugugcaaagaacugaaggagaugagagaccaugcuuugcagaagucugaaggcaagaacaugucugguguguuugagaaacuauagggaagcagcaaaggcucauguggaaugagaaagggaaagagaacuaagagauggaucaagagguaauggagagcuaguuuguguucugccuuguaagugguuauaaagacuuuugguuuuacucugagauuggaagcuguugaaaaguuuugagcagaggagugauaagaguccucuggcugcuagguugaggcuagacuuauaggaagacuaggcaaggggaaaagcaggaaggcaguuagggaacuauuguaauaacccaaaaaugagcagcuguggcuagagugguggcaguagagguggugagaaguggucagguuucccaucugaagaaaguauuuucaagguagagaugacagaauuugcuaaguggguaagauacgguaaccaaauagauaaagagaggaauuaaggguaacuauagccauuugcugagaugaggaagauugaggcuagaacagauuuuaugagggaagauuaacauuuuugguaauuuuuuuuaagauguucauuaaauccaaguaggcauguuaaguaggcacuuagauaaugauccuagaguucaggaagagguccaagcuagagauuugaaguuggaaagcauccauauauaaauaauucuuuaaaaccaugaaacuggaugagaucacccauagagcaaguauggaugaaaagaaaaguuugaggacugggccuuaggguauuccuuuguucagauuuguagggucaggagaaacaagaaaggagacuggagaggaaugaagguaaguuaagaaaaagcagggaaguguggugccguggagcccaaagagaggaaagugaucaacagcucaguuucuauagauggaucaagugagauaaggucugagaauuagucauuggauuuaauaagagggaagucacuggugaccugaaagagcaguuuguauguaguggagaggcaaaggccugauagaagaugauuccagagaaaaggugaaaagagcaauuccagacugcaaauuuagauuaaucuuuuugaauaucacuguuuaagagaaguagaaaaauggggauaguagcuagaggggucaaagaggaagguuuguuuuuguuugguuuuuaaauaacaugggagacauuucaguauauuuaaaaugcugacaggaaugcuccaaagugaaggaaaauugcaugguacaaacaaagucacuuuuguuuuagugcccagauaaaaugggaucuuauagagaacuuggccucaguucaucucuaguagcagaagagaaggcagaauaagugagcccagaugaaggcaacugcguaaaugugguagcagcuugugauaguucucuucugauguuucuuguuucucugugaaguauuaagucaguccaucagcugaaaaugaggaaggggcagaaggugcuggcuguugaugaagagugaagagaagauaugcaauuguacccuaagagaauaaaagacugaauggacuagggaaaugucauaggaaugcuggccaauucuaagagccuacuugaagucuguagucauaaauguaaagugguaucagucagcaugguucuucuucagccauuuaauacugguacauguggggaaaaggccaagaguuugaauuaaacaggugaugauuuuuccaggcgaguacacaaaucaagaaaggagcaagaguugguaguauaaaugaaugaguauaauaauggaccaugcaaucaaguguccuaaaaagggacagggaaggcauggagacaaggagggaugaggaaaugguuguaggaucaguggauuuuagguccugauggaaucaaagaauuguuggaguugggggagaagaggaaaguuggaaagcuaguuuggagucaaaaauugggguacuuuacaauugaaauuacugagauuguaguuacugguaaugccaaggucgcuggguaucagcaugggagugaauggcugacguagaauggaagauagauucauuaaaucagaggaguucaagaaaucaagaguccaugacacuggagaaaaauaaucacaaaagauuauggcaggagugcuguuggagagcaugauagugagcuacagucuacaaagaaugagaggaggaggugaacuaggaaguaguagguaaaugcaacaaagauagugacugauauaaccugaugauaugaaauucaaagcuagcaauuuuagggaggaagaggggagaauagucuagaagcagcaauguggaccaaggaguaaucucacccuguugguagaucaagugguauacggggagugggaaaauagacagccaccccguuucagaaagcugcauaggaguucuuaauaaauaauguauuggcaaacaaauuaauaucauacaaaaugaguuuauggguucccaagaaaaaucacaaaauaaaacauauuuguuuagcaugguuaacuaaggaauucuaguuccuagacuuuguggguucuaaaggaaguggagugucauugauuguaggagaucucuguuuaauagaagagaauguccagugucuaaggugagaaggaacuguucaccuguggcagaugacaggcaaauuugcuuccuuagaagacuagaugcuggacauauuuuauaaauaggucuuuugaaugguggaggcacauuagccaaaaccucaggcauagaauuuguaauuagagggagccauuauagaucuguaaugauaaugcagagauaaauucuucuaggccuuucuuggagaucuagaugcuacagaaauuucuaugacaacaugaauuuguucaguuuuagcuuuuuguuugcucuacauuucuaaguagaacauuuuauuauuuguuacuuaaaaaaaaaaaaaacacuuguuauaauuggccaggggugugugggucagaaaugguuuuuaaagauuccugacuuuaaguuucucucauuuugaaucuagacuuuacuuugcuagcaauggacaugccaagcacagcuccaucagauuuucagccucagccaguuauaucaauuauucaacuuuuugguugggaugauaucaucugcccucaaguuguagcaagauauuuaagucauguccuacaaaauagguacgugcuuuuauuucaggcauacacauuaaugcaaaccugugacagaucaguauccuaggaagcuaagaauuuucacaaaugaggacugaucucuacuacauauacucucacuuugucagguuuuugcuuucagauauaucagccuuucgacaguaguaauaguaagaacacuaacuuauauuuuguggccugcuuuaaaaaaaaaaaguuguuuguuaagcccuuucaaaacuguuuuuguaagacugccuuaucaucauacugaagugaccuuucuacacaucccacugugaaagaaauuacacauuuauuauuacugaaucuguaagauacugguauuuauuacagucuucguuuuaaugauagcuuuccuuuuugcugcuagauuuuuaacuguuaacucacucuuaacucaugagaucaugaguuuucacucuuaacucaugagaucaugaacaagauacuucaccugaacaaugucuuccuuaucuauaaguauuuccugccacauuacacaagagaucugaggaaccucauuggaaaaaaaaauagaaugaauaaaguuacaauagaaauaguguagaguggucaggaagacuugaauaagaacaucaagaugagagaaaauaaaauaaauauacaagccuaagaggucuuaguccucuuuuuaguaacaacugcuuguagagugagagagcauauucaugaccacuucucuguuuauuuuuucuaggguuuuuauuuuuauucuacuugccacuuucuucauuacuaucucacauagcuaguuauaauaagcccuugcuuuucucuugguagccauagucuuuccugucuucguccuuagcauaaaccuacacauacgucguguguacacauggcauauguguagguuuaugagaucuuaguccucuuaggccuguguauuuauuuuauuuucccucaucuuaacguaguuuuuguccaagcugcccaucaguggaaaugaagagagauguaguuggugagcuaagucuuuuccuaaggaagcuucaauaagcaguaucauuaaguauacauuuuuucauugggcuuucaguuguaagguaagagaguucaaauucaguuggauuacuuuuacaaucccuuccaguuugggaauucuuuaauaguaaugaacauuuauauuaugcauuaaagacuuuugcugaaauaauuugaaauaauuucuacuuaaaaaaugauauuguuagcguauuaguaacauuugaagaaacugaaaugcaaaggugcuauauagcuuugggaaaguuauaagguaauaaauaaccagucuguguucuucuucauuguguccuuuuuuaugacaacuuauauucgagguauuucaaaacauuuuuagauuugugguuuguaugaauuuuaaaaauuuuggacauuacauaacauuuuauauuuagguuaagaccauccccauccucucuacccugacuaaugaauggguuagaaaucagguuuaguggccaagcacgguggcucaugccuguaaucccagcaccuuggaaggacaaggcaggcggaucauaaggucaggagaucgagaccauccuggcuaacacggugaaacgcugucucuacuaaaaauacaaaaaauuagccgggcaugguggcgggugccuguagucccagccacuugggaggcugaggcaggagaauggcgugaacccgggaggcagagcuugcagugagccaagauugcaccacugcacuccagccugggcaacagagcgagacuccgucucaaaaaaaaaagagaaaaaaaaaaccaaguuuagccagcccauugucuucauauaaauaauuauuuuuuaaaucuggcaaaugguuuuggaauucuuugugagguaauuuuuaguaacaacucuccguauagugagagagcauacguucaugacuacuucucuguuuacuuauucuaacggacacugauauuuauucuacuugccacuuccuucauuauuaucucaccuagcuaguuauaauaagcccuugcuuuuuccuugguagccacauucuuucuugucuucuuccuuaacauaaaccuacacauaugccaucaguggaaaaaggaaaauugaaaauuauaacauuaaaaaugaaaagaaggauauuuguuuaacaucuuuuuggguuuaucuguaguauucauuuucaacaaugcaugccuacguuaguguguuugucugaaaaaucaaugaggccaaggaguugcagggauguuagaauguuuuucuuuacuucuuaaucucuauacucaggaaacguuuuuguuuuaaaaauauuugucaauuuguuucuacagcacauuaugugaagcacuuucucauucaggcuauguaucuuuucaagccuuaaccguaagaucauggauucguuguguuuugcaaauguauauuaaaaaccucucugggccugaugauuugcucauagauaaaaaucuggaagaggcaguugguaaguaaguguacguuuuuuggggaggauggggguaucuauggaaagcuauuugcugucuagaucauuuguuauguaauuaauagaaaauauacaaaauauucguaauuggguaugaauacaagcagaacuuaauuuccuuuuguagccuguuuccguuuuuuuguuuuguuuuguuuuuauuuuccuguuacuauauaugacaaacuucucugcuauaaaagauaaaagaacuuguuuccuuggaagccaaggacagaaauuugcuucucaggugacaagcuauuuuuuuaaagaaacugaucacgaaaaaaguagaacucugaagcgaguaaccagauaucacacugugaacacccuaaaaagaaaaauacccaauuaugaauaauucucucccauuuuauauuagauauuuugccuuucuucugcuuuacaaguagucauugagugauaucuguacuuuuuaaaaaaugucccaugcaguucuguugucuguaggacaugucuuuucccaaagcuauuguuuguggccacuuguuauuuucaugaagguuggccugaaaaaaauccuccaaauuuauuuuaauauuuuauuauauuaguugguguuacaugaauaacuuuuggggcaaggauguucauaagugagagaaauuuaauuugaaguccuuguguggaaauuugaauuuuaaaagaaagcaugucauaagugaagaauacuguauuacuucucauauauacauuauauauauguuguaugugugguuauguauauaguauguuauauaaauugauauaacaaauacuauuuuauuuuaacagaaaaagaguacaugaaacaguuggucaaacugacaagauuacuauuuaaucucucagaaguaaagaguauuuucucaaaggcccaaguugaauauuuauccaucucagaagacccuaaaaaagcacuuguucgauucuuugagguauuugucauuuauuaguauaauuguccagauuaauuacaauuaauuuucagaaaaaccugaaguauucuuaaaguuuuucuauaaaaugaauucuuauaaauugaaucauauuauugauugccugcuauuauaaaguucuggaggaagaaaaaugugaaucuaagguauaguacaauucacacuuaaggacagcagaaaaauuacauuaaugaagaauaauaaaacuaaagaauaccacaaaaaagcuuuacucuaaggcuaaucuaaauuguaggaauauugacacaguugcuggacaaccgcauuguucagaugcuugggaacugaauauccuuguaaacauuccaugauacucccaccuuaguguuuaucacccuguagcgaacaguguaggcauaagcaccaucuacuucguaugauaguauaguuggagcauuaaaauccaauccauuuguuuuguuuuguuuccauaauaaacaguaccauucaaaauuuuauuuuuaauuauuaauuguacagaaauuuaucuaugugagaguguuuguuuugcaaaccuaguuguuaauguguuuggauuagugucuuuuguaagcuauuaauuguaaaaguugguuuauuuucccacagagugguugguauuagcugcagugaaaauaauuaaaaucaauaagcucuuuccauaaauguuaauucuuccauugguuucuauuaaguuaaaguacaauuguaugacaauuagagaugucaugcaaucucuaaaaauauuugauaauaguaaaugcagauguaaaauacacauuccauuuggacccuuauuuaguuguugauuggaucugaaccugcaauuaaaugccuguggugugcuaggagcuauaauggaucagaaauagagcuagaaaucaaguucuucauugauaguuuucaucuagcccaaauuaauuguucuuucaccacuaagaaaaugaguuuuuugcugaaugcuagauaauauuaugcuagaacuucguagggauuugaaaaaucaaaagaaguaguucuuuaucucagguggccuuuacuucucuguggauauaagacauacacaaagacuaaaauaguaacacaaggcauuauaugcuaagugccaguugguugacagaucaaucaguagguaaagaauuuaaagcauuuuaguauaagaaguuuggauuuuauccugugaagauugugaaggcuuuguaaguuuuuaaguagauaugauuugguuaaauaauuuuuuuaaugaaaauaaguaacaauaauauaacuuaaaggugcagagaacuguuggccaaaagcuaaugagguuuagaaggaaucaaagauugaaugguugugggauuucugaauggauaugaaauaaaugcuguguuugacuaaaagagugaugauaccuuaaggagaaauaggaacaucaugauuuagggugacagagaaguaggugaggaauucaguuuuaaauuuauucauuuuuaaguugugucaggucuccccaagauuaucccucgguucugugauucauaggacuuagcauauaguuguauucacagcuaugacuuauuaacagagggauacgaagcauaaucagcaaaaggaaaagaugcaugaggaaaagucugaagaaaccagggacagcuuccaagauucuuuucccagugaaauuacacaggauaugcuuaauucuuucagcaaggaauugugacaagacaugugaaacacuaccugccagggaaguuccuuagugacucagugcccaugguuauuauuggggacuggucacguaugcccucuuugccucauacuuagagaauuccaguuccagaaggaaagcagguauucagcauaagccauauuauuugcauagaccaguuuaggaucaaggaauuguaggaagcuuuucaaaaucuaagaccccaaauaccagccaagagccagccuugcaagcaggacauuuuaagaguagcagucuugggucugcuguauuaacucuuuucugcacagaaaugauaguaugacaucuaaguuauuauuaucaagguaccgagaaauacauguuuuuuaggcuagggaaguuaagccuaagcauagagcaauauugagaagucuaaggcacugguguucaaaaguguaguccauagaccccugggaauuacugauaccaccugcucaaaacaguauuaauauuugcacaaauaguguaaaaucuuuuacaugaaucaacacugcggcccaagauuauacuaguauucauuauaauugauacugccaugcauuuacagaagaaaaagccaguuucacuuaagaauaucuucaaugaagcaguaaaauuauuuauuuuauuacguuuugacucuugaguacauguacuuucaguauuccgugaacgacaaugcaaagugcacuuaaagcacuuuugcugcauaccaaagcaaugugguugccuaaaugaaaagcacuugugugauuauuugaguugcaagcugaacugacugcuuuuaucuuaaaagaacaacugacaaaguaugguuauucagacuuggcuauuuggcagacauuuucucaaaaaaugaaugaagugagccugucacuucaaagcaaacaacugacaguauuuguugcuaauaauauaauucaagcuuucaagaaaauuagaauuuugagaaacuuguauuugucaucgugaucuugagagcuucccgauacuuauuuucugaugagaaugguggugguauuagcaggugugauuuuuuuuuccugauauaaauaaugaagugugucaacauugggaagcuguguaacucagugaaccacaauuuuccaaaugacgaauauaggcuuuuuaaaaagcauucauggauguaaaagauucacucaaaauacaggauagaccaauggcuuuuaauuuaacagaauauaaaauguuuauugacaugguuucagacaccaugguuuaguuacaacuaaucuguaggaaauaccacuugucaaguuuugguauaauagcaaagaggaauucucaugguuaugugaaaaaucuuucaaaauauuucuuauucuuccagccacauauauuuuugaagcuguauuuucuucaucugcagcauaccacaauaaaucauacaggagcagauauaagaaucaagcugucuuuuauuaagucaggcauaaaagagauuuguaaaaauguuaaaaaauacuacuuuucucacuaaauuuguuuuuuguuugggaaauagucuuucacuaaaauauguuacuuacauguaauguucauuaucacuuuucaaugaauuaauaaauaaaauuuucuaauaucauaaauaucaauagauauaacccaaauaauuaaaagcucuucaagauccuccauuuuuaagugugcaaaagggaacagagaccaaagaguuugagaacgucuagucaagggaaagaaguguagaaaacaaagggaagagagcuaaauagagaggaaugggauuagucaaguauaucucuuguucuuaucugcuaaucucacagucacucauuuagguucacugacuuucuuaucuuuuucauuucacauuuuauugucagcauguccaacuuuaaugucaccauggaugacuucuauuaagcuuucauuucaaagcuucuguaguacucuuucagucuuucagugaaagaaguagucuuucacuucuccccuacuucauccacccacuuccgugacuaaacccggagcaguggaaucucuuggagcaucugaaagcucauugacuaccaucaucuguccuuccagcucaugagugaccacacuguaaucuuccccucucuguuauccuaggacaacauucucccaaggccucacuuccuucccuauucaccauaauuagaccccuuagggccuuacuucagcuacucuuaccaacauucucacaaucuugaaucuuuuuucuuuuggucacaccuacaaacccucaaccuuggcucagugcaaccaccucuucucuuuccuuugucuuacaugcugagugcugcagaagaaaaaucacagaacuguuuguauuggugcaauucaugguccaauuugggucauuggaauucauuauaaguucucaaaaaugguuugaaaauuuuauuaguuuacuuaaacuuucuuuuuauuuuuuuuuuuuuuuuauuuuuuuuuugagacagucuugcucugucaccaggcuggaguacaguggugcgaucuuggcucacugcaaccuccaccuccuggguucaagccauucuccugccucagccucccaaguaacuaugacuacaggcacacgccaccacacccagcuaauuuuuguauuuuuaguagagaugggguuucaccauguuggccaggauggucucgaucucuugaccucaugaucugcccaccuuggccucccaaacugcugggauuacaggcgugaggagccaccgcaccggccacuuuccuuaaacuuucuaauccaucucuuagccagucuucucuugauucuuuugugaccuuucaccccuugcuuauucuaaccuuuccucaauuuauucucucauuuauuuccuuuccucuucuucucaugucucuguucuucucuuacugauucaccucacauuucucucuaccacucuccauuuugccaucucuaccuucucugcccauccuuuuuuuuuccaagaaguuaagcuggcaucagauggcucauaaaauucuaggaagaaaagugaauucauauaauaaagcugaacuuuuuagagguuuugcuuguaaaaauuuggcauuacuuguagguuuuccuuguaggggaauuuggggauuuugaauuccuaguaaucugggaaauauggugagccaaccugucuggaagucaugaugugauuuaguuacaagguauguguacauaaguuucacauuuuuuuuucacugauauuuugcuaagucggcccuucuauaaguaguuauuggugaguuuuuaagauuucuuccuuuaaccuuuauuuuaauaauaaaagacaagacuuaauucuuuuuacuuguguuuuaauuccuaugucucuuuauuggaagguuacaaaugaaggcuuaaauguaaaggguaugggugcguauguagaaaaagagagaaaaauuaucuuuauguuccaaaucuuuaugguauaaacuuugggaaguuaaauaauguuuuucuuuauuuauaggcuguugguguaacuuacgggaacguccagacacuuucugauaaaucugccauggucacaaaguccuuggaauaccuuggugaaguauuaaaauauauuaagccuuauuugggaaaaaaaguuuucagugcagggcugcagcugacuuauggaaugauggguauguauuccuggcauuauuuugcuaguaacauuuccuuagguugagccuauacuaucaugauggauagguauauauuggcuaaaucacuacccuccauacaaucauaagaguaaucugaaauacagugauuuagcuuaaaauaauucauguuggccuucaaauguaucucugucuugcucuaucucuuuucaauacuuuugauuguuuuaauauuaaaauuaugaucaauacagaaaauaugcuggcaccaauugcuuucaguagucugucaugagucacauuucaauaccugaauaacuagaauggaccuuuuuuaaaaaaacgcuuaucuauuguuagaauuaaaaacaucagaaaacuaucgcuuacaucuauuucuaugcucugcucuguaugaaggagauaggauuuaauacagcacuaaaaauauuuaugcuucaaaucuuguuucucacaauacucuucccuuuucaaaaagaaaucauuuucuaugcccguucuauaacaauggaguuuaucuuucuuuaggaagucagugauuaacauaucuuuuuuucacgaaaaccauggugcuaaccaaaacuaggaauuggauaaagguaaaugagaaagauuuccuuagaaguuuuuauauagaauuuaaguuuuuuguuuuuuuccuuuauuucucuguggucaaaaccuuuuaucuguucccuuuaaucuuaugaauguaugaguaagccugauucggguugucugaaaccuuuuaucuuuguuguaaaagauaaaggcgaaugugaaaauguguaaauauagaagauguaaauuacaggaaaagcuauagcaauucaggcaucuuaauuuuagagaaaaauguaagugagaauuuauaaguuuaauaguaaaauacacauuaauaaauauauuggcauucaugcuuauaauuuauuagugucuacaaaaguuuucuguuuccagauuuagauuuuugccaagauaaaugucugauauagacaugggacaaaauucuacuuaggaaaaauugaagacuuucuuugcuuugcugccuuguugauuuuugucuccaugcgcagaucuguauucuuuccuuuugucuagguuucaaagacuaggaagaguauauugcuacaguguugcccauuuauuuguuaggaauuaggauagguaacuuaaugauuucuucauguuaaaggauuagaauaaaacagagaaagagcaaaguauaaacuuuggagagcuccaagguguuuuaaaauguguugggguugggauagcauaaccauuugagggaaggaguuaaccacugaaacacuguacucuauuuaccuugacaguuccuaacuggggacaccucugcuguucacuuacaagguugcaagacugcuagugaaaggcacagaacuguugaugaaaucaccuuucauauuaaggagaaggcaucugugaucuuaauuguagcucaguuauuucugaaaaggcaugguggauccaucaacuucucuccucuguagauuuuguuuuguuuuguuuuucucauucuucauaucugauaguuuucuguuuccauguauaaagcuuucaaucaucccugucucuuuggccauucuuccccauuuugcuuuguaauugaaauucaagucaugacccuuuggugccaagugcaaauuuccccacuuuucccacauugccaaguagacuugaucaucucucucauuacacuucaucuauccuuuucuugugauaugauauuauuuauaguuugccauuuguuaaaauuacuuguguacuugacaugcccccaccaaauuucaaacuuguaguagccaucucuugaauuuuuuauucccauugucauguauuuugaacaaaaaagaacaauuauuauguaucaggugcuggauugagaguuagggauacauuaguuaaagagcuccaaaguaggagauaguguauacuauauaaauauuuauggaauuuaaugacuuuauuaaucuagcaauaguauauauuuuuuaauguucuuuuuguuuuucuuuguuguuguuguuuuugagacagagucucccucugucaccuaugcugaagugcagugacgugaucucagcucaccgcaaccucugccucuggguuuaaacaauucucgugccucagucuccugaguagcugggacugcagaugugcaccaccaugccugguuaauuuuuguauuuuuacuacagacaggaucucacuauguuaccaaagcuggucuugaacuccugggcucaagcagccugccugccucagccucccaaagugcugggauuacaggugugagccgcuguacgcagcuuuuaauguucuuaaaugaacaaaauuacuuucuaacuauaaagauuuaaaaauguauauuguagugaucccaauuuuuacguaggguagaaaguaggcaaaauacauaggauagaaaauacagaggauagaaaaugaguaaauacucaagagcuuguauagugguuaucauugaauggagagauuguauuaaauuuuuuuguauuuucaguuuuauuuguuaauaaauaauauauuuauagccagaaaaagaaaaaaaaaaacuuagguuuuuacaaagguacuguauguauuuaaaccuuucccaguuuuuuacuuuaaaaaucuuuuuauauuuccauuuugcauuuuuaauaacacacacacaaauauucauugcugaaaccuaaaaaguaggugucugauagcaaggaguaaaacaaauaucuccaccuuauaugaacuccuaaagcuuacagucuucaacaaaguguuucaaccguugcagaaaaugaaauacaguaguuuccccuuauucaugagggauauguucaacaccacuaguggaugccugaaaccgcagauaguaccaauccuauguaugcuguguuuuugccuauacauacauacuuaugauaagguuuaauucauaaauaaggcacauaagaguuuaacauaauaacuaauaauaguauuaauagaacaguugugacaauagacucuaauaaaaguuaugugaacuuugugucucucucugacugccuuccccacccccucgucaaaauaucuuauugguauccuauaccacgggcaacuaaacuauaccacgugguacccuauaucaccgguaacuaaacuauaccaugugguacccuauagcacggguaacuaaaacuguagaaagugaaacauaccuguauugcaccugagaguaauaagaaucauuucauaugccagugaugauagcaguuccccuuacagguauauuaauguuuuuagaauauaaguucuucuaauauugcugucauacugaaauucuccaccaacugaagaaaugaggagcaagccagcauuauuuaaaacuuugcuaagugaacauuguuucuuuaugauugauuauuguacuuccuuuuacaacaaaagaugaauguugcuguuuguucuuaaaagugauaauuuguugaguuuuuuucuuuaacaucaguauacuuuuccauaagcauauuuugguuuuccuucagagcuuaaauuuuaaacucuuuauuugauggaaaugacuuugaauuuuaucguuuuugcuuucuaggauggaauaaaauauaaaaguuuaugcaguagauguaccacugugcuuuuuggauaagcauuuaaucuguuuuuaaauucauuuuucaguaaggagaccucaauaguaauaauauauccuaaugggaauuauauaucugcucuuaauuacuuuauuaaacaaagggugcucauuuguuaagcuuuauuaucaucagauguggcaauuaacagacuucuagcaccaaggaagccauaauauauuucaaguagcaaagaaaucuguuucucuucauucagaauuaaaauuuuguuuguuuauauuaaauaauggaaagguguaaaaacugaaguucauggagguuaacugaaguugguggagguuaagugauuagcuuauagcuaauccugcuuuccauguauuaacaauuaaauuuaauuauacuucuguugcaaacuggauugaggccacuuacauguaagauuaaaauaugaagaaauagggguaccaacaaauaaauauagaguuucauggugaggcccagggaaaauuaguaugcauauaaaaccauaauguauaauccuacaguauucuuuaaaagguggauuguuaauuugcauuugggcauccuagcaacucagagggaaagcagaaagggaaauccugaauaauuucaacauucagccaauguagucacauaauguauaaauauauuccacuguaugugugaguguaaacagguugacuagcccuugucuaaaauucuugggacuagaaguauuuuggaguucagauuuuuuuggauuuuggaauacuuguaguauacuuaaccaguugagcaccccuaauccaacagugugaaauuugaaauggucuaaugagcauuucuuuugaucaucauguuggcacucacaaacuuuuggauuuuggagcguuucagauuuuauauuuucagauuagggauacuuaaccaguguauauauuaaaugccaguugcucggaaaauguauguuuuccuuggcccaaaacucuaugaaaaauuugucucuuuagugaaauauaugaauugacauaaauauuuguuacuucuacuauaugucucuuccuauucccuacuuuaauuuggucccaugugcuuucaauacaaauuuuuaaauuaagugacaaaauguucuggucagaggauaacaacaacaugcuguuacuucucuucuuuguuaggaauucuugugaaaucaugggcacaaaucuuugccacuucuaaagcccaaaaauuacuauuccggaucauagauuguuuacugcugccacaugcaguauuacagcaagagaaggaacugccugcaccuauguugucagcaauucagaaaagucuuccuuuguaucuccagguauaguaucugugguugcuuaaaaguuuaaaaaaaaaauauugaaacuuugccuuaaaaacauaguuuacuaaaugcagauuuaaaaacuguacauuauaaucucaaaugcuuguguggcacauuuauugaacauauuuuaaauugcuuuuauguuuggcuuuggaaacaaaaaugaaaaagcagaggagcuuaaaguugagagaggagguagaugagcacagacacuuaugguagugugcucaguauuuuuuuuuucagaccucaucuauuagacuaugggugaggagauauaagagaauacacuguagaggacaucagagguaaaagagcaaaauggguaggaguuggagggcuuuucauuucagagggagcaacauguacaagggcaugagcuuuaagaaaauauagaaugguucuguuguggcuggagagucauaugggaggagccauguaauggagggcuuuauauuccauccuaagaaguuuggacuuaaucuuuuacauggggaccugaugaauuuggagcagagaaguagaagugacauaaugauauuuacauuuuagaaagaugauucugguggucauauguaagauaauugguguggagguuuuggaaagcagugguaacuaguuccuuguaauaauccacauauugucagaagguuuugaccuaaggcagugggaauaaaacccauaacagcagauuucaaaaacauuugggagcugugauuaagaguacuugcuaauugaguguuguggaggaacucaaagaagugaaaugcuuccuagauuccagaguggcuaucugcguagauaguaguucuacuuacuaacgugggaaauccuggagaugucgggaugaagguaaggauugguuucugagcagcuuuaguuugagguaggcaguuggaaauauugaucugccauucaggaaaggaugagacuggagguguacuuuauuauucauuagugucugauguuaaagauaagugcuucuuaauuugagguccaacaagggaagcugaggaggaaagggaaaauggauuuugauuauguaacaaucuuuuuucaaagauguauuucuuaacagaguuuuaagauuccugagaaguuuuaaauuuucccucuaauuuuuauucauaauagcauuuaaaaugaaguuuaguguguuaaucuagcagaaugacaaaaaggggaggcagccacaccacagccugaaccgccaaucccacagagggagagaugaauagaggggaguggugagcagcaggagagucuggaauauuucuuccaugugguccucuuaaacccaaacaguccauuuaauaagaauucucuuaagcuucguaagugguaaauuuaaaaguuugguguauuaucuguuugguagaacuggagcuaugucuuuaauuucuucaugguacccagcucuccucuucggaauuuucagaaaauauucauuuauuacuucaucuucuucugauuuaaugugcuuuuccuuaaacuacucaagaaacagaguuggugguggcggguggguugggggagggguucauuguuugauuuuuuucaguuguuuauuugguacaguuuuaacagcuguaugcuauuuuucauuacaaauaaacuuucagaauuucuuauuggguaaguacccguuuacaacuaaaauggagacuucaaacauuuuaaauuauuucucuuggaaaauacguugugagucaccaaguaccaaauuaagaguuaacuuuuauaauauaauguauugcuguguuggugauuaucuauauuuaguagcauuuaauauuuacuaauacuagcagaaaacauuauuuucucucagaguauugguuuaaguauuaaauacuguaauauauaugaaaguauuuuguuaacugcuauacaaauguaagagauuaaauaaacagacaugcaaccagauaucaagaguucugugugacuguauuaaacucuucacuuuucuaaaccuuaguuauccuagcuguaaaauggagauacaauauuacuaacucagugguucuuugagaaauuuaaaugaaauagugaauauaaagcacacagcacagugccuguuauaggaaaacuaaguaaauuguuauuccgagucuuaauuuccauauuccucgcccuuuguuauuacuuuaaaaaagauuaucagauuuuuagcauggaagacuuuuagcaaaaauuguauagucuuagacaaaauaaccaguaccuagaaaaaaaugaccuaaagguguuuuauaacuuuguaaguacacauaaauguaguugaugagcaagauguucaaguguucugaugauuacaggaaaagaaucugccuuugucuuccuacuguucuccccugcuuccuuuguccacaccucagacacacaugcuuaguuagaugccauaucauauguauugcccaggcuuaacuccuuguaauucguauguacauuaucuguggauuacgugagguauccuuuuugauuuuuauauucucacaugauuauuaaugcuggggacuucauuagugaguuucuaaauauuguuuguucuuugaaacuuuaccucuuaguauuucuuacuuuuuuuccuuguagggcauguguaucguguguugucaaucucaaaauccgaaugccuauuugaaucaauugcuagggaauguuauugagcaguauauugggcgauuucuuccagcuucaccauauguuucagaucuuggacaacauccuguuuugcuggcauugagaaacacagccacuauuccaccaauaucaucucuaaagaaaugcauugugcaagucauaagguacaucuaaauauuaaauauaggugguauguacaaauuauuaagcucuauuaaagugauaaaguggcauuucaaacauauuggcaacccuuaggauacuaguaguucagaagcuuuuuguuuuccugagaagcauuaucuaagauuuuauuaaaaugacauuugcuuauggcagccuaagacaaugcucuuuaaauuccuucucuuuucucuauguagcuauuaccuuccuuauauauguccuaaagguauauuuuugcuuuuuaguuuuucaucagauaaacaauauuuguauuuuauacuguauaaaacacaguaauuauauuuggcugggugugguggcucacaccuauaaucccagcccuuugggaggcagagguggguggauuacuagaggucaggaguucgagaccagccuggccaucauggugaaacccagucuguacuaaaaauacaaaaaaauuaguuggacaugguagcggauggcucuaaucccagcuacucaggaggcugaggcaggagaauugcuugaaucugggaggcagagguugcaguaagcugacauugugccacuguacuauagccugggugacagagcgagacaccaucucaaaaaaauaaaauacaguaauuauauuuuauaaagauaauuaagugaaaaaaugaaugcuaauauuggaaaugaagcacccugaagucuuguuaguuuagucuuaacucaguuuuauuaagcaaaugaaaaacaaaacuucuuaaauauucuacuaagucuauauccuuuaacuuuaacauuagaaaguucaguaauaaaaaauguuuugucauugccuucauguauuauuuauuuuuauaugaaauuagcuuuuaaacuuuaagaugcuauggugauguauguuauucuuaucuaguauuaguuuucuguguuuuuuaaugacccaauaauaucuguuaccucucauagaauuccaugccuaaaaucugucuccccucucaccuuuuugaguucuuaguguccuguuacucagguuuggaagcuuuaucuucuuugcuuccuuuccuugcccauccuuuggcaauccuguccuccuuuuccuauuucucuucccuuagugcauuauaccuagacuauugucagaaucuccugacugcuuucugcaucucuagucuuuucuucuaguccacccuaaacaaugcccccagauuacuuuuccuaaaauacucuuucauuaugaaacuucccugccauuaaaccugcaauaucuuuuuuguccaugaaauaaauuucaugcuccuuagcucucugcaauccaucacuuaccguuuccaaauguauuacauauggugucauacaaccccuaauaagauucauauugccccuccaaaaugccucauaccucccuaugucacagcuuuauucaaauugcuuucuccauuaaaaugucauuuuuuugggcuaaaucccacguauccuuuauaaaaccuacaccugauaugucaguguaccauguauguuuccuuuuuugaaaucauaugcccuguacagcucaauuugcagaauuaugauaguuuugccuuacuuguaucugaauuuccaacaggauuguaguaaccuaacacaguguuugagauauugcauaaguaauuauaguacaaacuaaaugacagaugcugaagugaaauugaaucuguaaaacuguuuaaaaccccaguguuuaggaucccagaauuaguugacuuuccuauuuacuuaacacacagugaaaauguuuuucuugugguuuauaguugaaggcuuuuuuuuuaauacucaggaaagauauagagauugucuucuaugacuucuuccaugccaugcuucucuauuccugcacucccucaucugaguuagggcucuuuucucugaauuccugagaauucugugcuuaucuuugucaaaagcaccauuaugcuauauuauaauugucuuuuucuuuuucucauuuaacuucuccacuccauggugggccucuugcuuucagagaccauauuuuauucaauuuuauauucuuguucuuagacauguaccuggcauuccacuggcgcccaauauauguuuguucuaggcauuaggaauucagcaguaaacaaaauuggacaaaaccucaaagaaugaauuuucuaauauguaguauuuguuggaagucacuguagggaauagaaauaauuacuaagacauaguuccuguccuuauguuuauaauacuuagugguuucucuuccuuaugguuauuauuacuuugcaaauauauauauauauggaugucuaguuuauauuuagcuguauuugacagauuuucacauugucuagacauuuguagaaacuaagcaauuccaacuuuuauuuauucacuuaauaaauguauacugaacacuuguuaugggcccggaccuguucuaagaggugagaauauacaaagaugagucaaauuauuauccuuaugaucgcucuugaguucuaguacuaaauuuugucuugucuugagagauaaugcuaaauccuaaauuaguucucugagucuuuaacuugcuggaggaaggaaggagauaaagcuugaguguccuaucuuauuccuaggacaguccucuguuuguuuggaaaaauaagacuccuuccaaguccuuaaauaaauagauaugaagagagauuucuuuaugcaaauuugacauuagagaaaauguugcggcauugaggacccaauggaggagaucagacuuguauuagaaagggaaaaaaaaaaccugcaaauuaacaguuaggcuuucauuuggauuuugaguucauuuuaaaacaagguugcuuucaauuuaguuugugacuauauugugcuuuggcccucagaacacaccagaaagauauacagucagucauugcuucuaaaauccuauguuugaagauagcaugguaaaauauacauacuuuauacaaguggcacuguauuaauuugggggguaaauuuugccaauaucuuuaaauuauaugccauuuggucuugcucuauugaagcuuuaagcagagaauaaacaaauuuugcuucuuuucaggaaauccuaccuugaguauaagggguccucaccuccuccucgcuuagcauccauucuggccuucauccuccaacucuucaaggaaacuaacacagacauuuaugaaguugaacuacuccucccuggcauuuuaaaaugcuugguguuagucagugaaccacaagguuuguuuguaagcuuauuuuuguuaccauuuucuuuuuacaaguuaagaaacuacuguuuccccucaauuuaauggauaguuacaaaauauaugugauucuuuuauaucucuugauaugggucaugguuaaagaauaaacuccagcuagcagcucagauuagguaugauaaaaugguuaaaaacugagauguuuugguccauuuuaguuuuggcuuuuuuucuccccuugaggcaaauaguuuauuuaaggguuacuucccuugauuagauuuguuaaccucucaaagaauauuuguucaauuugacuucaguauuaaaggcaauuuguuaaauaucaaguaaugagaggucaucauacuuuuuuuauucagguuuuugcuggaauaucuaagcugauuuuugaggcaaaccgguagggguccuuugauucuacuccuuuuguuuucagucucaucagccuuacuuccagugauugcuuuaaaauaacauuuauuggccuggcauaauggcucacaccuguaaucccagcacuuugggauagagcucuuaggucagaauaaaucucaagcacugaccucaaaggagccugaauuugauuagauuaguccuuaaagcaauuuaugccccaguguauuacuaaaaacauuaaaacaaucacccagaaauuaauuaguggagcuuaacagcugagugugaucagggaaagggacagucaaagagaguccugccaaaaccauugucuucacauggagacugugggcguaccugagguuacaucaccucagaagcaauaucuaaggcagugagagggcaagaggaggaguggacuucauuauuuaaaaagcccaauuuucaccaaaaaauuacaggacaugcaaagaaacagacacauacaauccauauacugagaauaaaagcaggccacaggaacugccagugagagcagucagauauugucuuuaacagacaaagacuucaaaguaacuauuauaaauauagaacuaaaggaaugugugauaaaugaagaaaacgaaaguaugguggcaauagggaaagaaauuuuaugaaaagaaccaaauggaaauuuugcugaguugaaaauuucaccagaggggcccauuaguggauuagaacuggcagaagaaagaauuagcaaacuugaaaauagaucaauacagaucauacaaucuaaagcacagaggacaaaaaaaugaagaaaaugaacagagcuguugagaaauguggaacaccauuaagugcaccauauauacaacaggugaaccagaagaagagagaaagccaaaaaaauugaaaauaaaauauaauuucuaaaauuuuuucaaguuuauucaagaauauuaacuuauacauucaggaaguuccacuaacuccagguaagguaaaugcaaaaagauccacaaacagauacauuauaguaaagaugccaaaagcuaaaggcaaagaaaaucuuggaaguagccagagaaaaaugacucauccucuacaagaaaccccaguaagauuaacagcugacuucucagaggaaacugggggccagagacagugggauagcauucacaggaauuaaagcaggaguguagagggggaccugucaaccaagaaucuuuuuucagcaaagcuaccuuucaaaacugaagaugaaacagaccuucucaaauaaauuaaaacugagagaauuuguugcuaacagacccaccuuuuaacaaaaugcuaaaggaaguuuuucagacugagacugaccccaggcaguaauuuggauccacauaacacacaaaagaauucuaguaaagauuaucauauaauuauuaagacaguauaaauucacauuuuuucaucuuuauuaucuuaacugguuuuuaaaaagcauuuguauaaaauaauauuguugggccuauaacuuauagaaauauaguauuuuaucaauaacaauaaaaaggagguggugagagaaaacaguauuaggcuaaggaaaggacuccacauggcaacucaaauaccugggaauaaaugaaaaaaaaaaaaaaaaaaaacagaaaugauaaauaagaagguuaauauaggaugaguauuccguauccaaaaugcuugggaacagaaguguuuuauauaucagauucuuuuggauuuuugaauauuugcauauuuauuaugagguaucuuagcagcaggacucaagucuaaacaugaaauucauuuauguuucauauauaccuuaaacauguagccugaagguaauuuuuuacaauauuuauaaauaguauaugcaacuugucacaugaagucagguguggaauuuuccacuuauggcaucaggucagcucaaauacuuucagauuuggaagcauuuggaauuuuggaucuuuggaaugcuggaccuauauagcagaaguuaagauauguauuugcuguucucucuuuucuuagcuucuuugaaagacauaaauuuauauaaaguaaaaauuacaacaguauacuuuuaaguuuuaacauuuguagauauuauauaauaaguauaacaauaccacaaaaagggagagaaauaaauagagcuauauagugcauaggauuuauguuucuguauuucacuagaauuaguauaaauuugaagcucugauaaguuaagguauauaugguuagcuuagagugaccacaaaggaaauaguucaaaaauaauuaauaauuaaaugggcuaaaugccccgauuaaaagacacaggcuggcaaauuggauaaagagucaagauuuaucaaugugcaguauucaagagacccaucucaaugugcaaaggcucaaaauaaagggauuaaggaagauuuaccaagcaaauggaaagcaaaaaaaaaaaaaucagggguugcaguccuagucucugauaaaacagacuuuaaaccaacaaagaucaaaagagacaaggccauuacauaaugguaaagggaucaaugcaacaagaagagcuaacuguccuaaauguauaugcacccaauacaggagcacccagauuuauaaagcaaguucuuagagaccuacaaagagacuuacacucccacacaauaauagugggagacuuuaacaccccacugucaauauuagaucaaugagauagaaaauuagcaaggauauccagaacuugaacucagcucuggaccaagcagaccuaauagacaucuacagaacucuccaccccagaucaacagaauauacauucuugucagcaccacaucgcacuuauucuaaaaaugaccacauaauuggaaguaaaacacuccucagcaaauguaaaagaacagaaaucacaacaaacuaucucucagaccacagugcaguccaguuggaacucaggauuaagaaacucacucaaaaccgcacaacuacauggaaacugaacaagcugcucccgagugacuacuggauaaauaacaaaaugaagccagaaguaaagauguucuuugaaaccagugagaacaaagauauaacguaccagaaucucugggacacauuuaaagcaguguguagagggaaauuuauagcacuaaaugcccacaagagaaagcagaaagaucuaaaauugacacccuaacaucacaauuaaaauaacuagagaagcaagagcaaacaaauucaaaagcuagcagaagacaagaaauaacuaagagcagaacuaaaggagauagagacacaaaaaaaccuucaaaaaaaucagugaauccaggagcugguuuuuugaaaagaucaacgaaauagaccacuagcuagacuaauuaagaagaaaagagagaagaaucaaauagaugcaauaaaaaaugauaaagggguuaucaccaccgaucccacagaaauacaaacuaccaucggagaguacuauaaagaacucuacacaaauaaacuaaaaaaucuagaagaaauggauaaauuccuagacacauacauccucccaagacuaaaccaggaagaagucgaacaucugaauagaccaauaacagguauugaaauugaggcaguaauuaauagccuaccaaccaaaaaaagccuaggaccagacagauucacaacugauuucuaccagaguuacaaggaggagcuggaaacauuccuugugaaacuauuccaaucaauagaaaaagagggaauccucccuaauucauuuuaugaagccagcaucauccugauacuaaaaccuggcagagacacaacaacaaaaaaaaauuuuagaucaauaucccugaugaacaucaaugcaaaaauccucaauaaaauacuggcaaaccgaagccagcagcacaucaaaaagcuuauccaccacgaucaagucggcuucaucccugggaugcaaggcugguucaacauaugcaaaucaauaaacauaauccaucacauaaacagaaccaaugacaaaaaccacaugauuaucucaauagaugcagaaaaggccuuuaacaaaauucaacaguacuucaugcuaacaacucucaauaaacuagguauugauggaacgugucucaaaauaauaagagcuguuuaugacagacccacagccaauaucguacugaauggacaaaaacuggaaacauucccuuugaaaacuggcauaagacaaggauacccucucucaucacuccucuucaacauaguguuggaaguucuggccaggacagucaggcaagagaaagccauaaagcguauucaguuaggaaaagaggaagucaaauugucuuuguuugcagaugacaugauuguauauuuaggaaaccccaucgucucaguccaaaaucuccuuaagcugauaagccacuucagcaaagucucaggauacaaaaucagugugcagaaaucacaagcauuccuauacaccaauaacagacagagagacaaaucaugagugaacucccauucacaauugcuacagagggaauaaaauaccuaggcaucuaacuuacacgggaugugaaggaccucuucaaggagaacuacaaaccacugcucaacaaaauaaaauaaaagaggacacaaacaaauggaagaacauuccauacucauggauaggaggaaucaauaucgugaaaauggccauacuccccaaaguauagauucaaugcuauucccaucaagcuaccacugacuuucuucacagaacuggaaaaaaaacuauuuuaaauuucauauggaaccaaaaaaaagugugcauagccgagauaauccuaagcaaaaagaacaaagcaggaggcuacuuugucacgcuaccugacuucaaacgauacuagaaggcuacaguaaucaaaacagcaugguacugguaccaacacagauguccagaccaauggaacagagcagaggccucagaaauaacaucacacaucuacaaccaucugaucuuugacaaaccugacacaagcaauggggaaaggauucccuauugaauaaauggugcugggaaaacuggcuagccauauucagaaaacugaaacuggauccauuccuuacaccuuacacaaaaauuaacucaagauggauuaaagacuuaaacguaagaccuaaaaccauaaaaacccuagaauaaaaucuaggcaguaucauucaggacauggggaugggcaaagacuucaugacuaaaacaccaaaagcaacggcaacaaaagccaaauauauaaaugggaucuaauuaaagagcuucugcauagcaaaagaaacuaucagcagagugaacaggcaaccuacagaaugagagaaaauuuuugcaauccaucuggcaaagggcuaauauccagaaucuacaaagaacuuaaacaaauuuacaagaaacaaacaaccccgucaaaaaaugggcgaaggauaugaacagacacuucucaaaagaagacauuuaugcagccaaaaaacuuacgaaaaaaugcucaucaucacuggucauuagagaaaugcaaaucaaaaccacaaugagauaccaucucacaccaguuagaauggugaucauuaaaaagucaggaaacaacagaugcuggagaggauguggagaaauaggaacacuuucacacuguugggagugugaauuaguucaaccauuguggaagacaguguggcaauuccucaaggaucuagaacuagaaauaccauuugaugcaacaaucucauuacuggguauauacccaaaggauuauaaaucauucuacuaaaaagacacauguacacauauguuuauugcaguacuguuuacaauagcgaagucuauugugaagucaucaauacuuggaaccaacccaaaugcccaucaaugauagacugaauaaagaaaaugugacauauauacaccauggaauacuaugcagccauaaaaaaggaugaguucauguccuuugcagggacgugggugaaacuggaaaccaucauucucagcaaacuaacacaagaagagaaaaccaaacaccgcguguucucacuuauaagugggaguugaacaaugaguacacauggacacagggaggggaacaucacacaccggggccugucaggaggugggggacugggggagggagagcauuaggagaaaugccuaauguaaaugacaaguuaaugggugcagcaaaccaacauggcacauguauacauauguaacaaaccugcacguugugcacauguaccccagaacuuauaguaauaauaacaauuuaaaaauuuggaagacuacguuaaaaaauauucacuuaauguaguaagaaaacaguaaaggagauuaaagaaacaaacacgagucauuaagaaaacaaaaaguaaaauugcugauguaaaucaaacuauaucaguaauaauaccaugugaaaggauugaccaguccaaugaaaaggcagagaugaucacaauggauucuuaaaaaaacaagaucuacccauaugguauuuacaggaaacacuauagauucacagauauaaauagauugaaaguaaaaggaugggaaaagauaguugugcaaacagcaaccacagaaagcuuaagugacuauacuaauagcuccauaugaauuacuaauuuauauggaauuacaggggacccagaauagccaaaucaaucuuggaaaaagaagaagaaagcuggaaaacgcauacuucuugauuucaaaacauguuacaaagcaacaguaaucaagacagugugauaguggcauaaagauagauauguaggucaauagaauagaauuaagcguucagagauaaacccauguuuauggucaacugggguuuuuuuguuuguugacaagagugccaagacaauuuaauuggggaaaaguagucuuuucaacaaauuuugcuaggucagauagccacaugcgaaagaaugaaguuggacccuuguuuccuaccacauacgaaaacuaaccuaaaaugaaccauagaccuaagugucagagcuaaaauuguaaaagucauugaagaaaauauaggaaaaaaaucuucaugaccucgaauuuggcaacagauucuuagcuauggcacuaaaagcaugaaccacagaagagauaaauuggacuucaucaagaauuaggagcuuuuguguuucaaaggacacuguuaagaaagugaaaagacaacccacaaaaugggaaaaaauacuuguaaauuauaugugauaaggagugugcaucuauaauauauaaauaacucuuaagaauaaguggacaaauaacugaauuuaaaaauuggcaaugaaucugaauaggcauuucuacaaagaaaauaaacggccaauaagcaccagaaaagguguucaacaucauuagucaccagggaaaugcauaucaaaacuaccccgagauaucacuucauacccacaagguuggcuauaaugagggagucagauaaugaaaaagauuggggaagauguggagaaauuggaacucucauuuaaugccauugggaauguaaaaucauguugcuacuuuggauaauaguccaguaguuccucaagcgguuaaauauggaguuacuguaugacccagcaauuucaccccuagauauauauauauauuuaagagaaaugaacaaauauguccacacagaaacuuguaaauuaauuuuuauagcaguauuguuuauuauagccaaaaaguagaauacucaucguuugauggaucaauuuaaaaauuuugauauauuuauacaauggaauauuguuuggcuauaaaaaagcaugaaguacugaaacaugcuauaacauugaugaaucuugaaaacauuauucucagugaaagaagccagucacaaaagucacauauuauuucauuuauuugaaauauccagaauaguuaaaucuauagagacaggucuaggcaugguggcuuacgccuguaauuccugcaauuugggaggcugaggcaggugaaucacuugaggucaggauuucgagaccugccuggccaauacggugaaaccacaucuuuucuaaaaauacaaaauuagccgggcgugguggcaugcacuuguaaucccaguuacucgggaggcugaggcaggagaauugcuugaacccgggaggcagagguugcaaugagcugagaucaugccacugcacuccagccugggcaacagagggagaguccgucucaaaaaaaaaaaaaaaaaaaaaaaaagaucuguagagacagaaaguagguuaagggauugcuuagaaggaaucgggauagcuaaagaguguggaauuucuuuucaagauauugaaaauauuguaaaauugugaugaugguuguacaacucugaauauacuaaaagccaucgaacaguauacuuuaaauggguaaacuauauaguaugugaauuauaugacaauaaagcucuucuuuuaagaaauaaaaaggccaggugugguggcucacacauguaaucccagugcuuugggacgccaaggugggaggaucacuugagacuaggaguucgaggccagccugggcaacauagcgagaccuccaucucuacaaaaagcuuuuuuaaaaaauuagccaggcaugcuggcaugcaccuguaguccuagcuacuugagaggcugaggugggaggauggcuugagcccaggagauggaaguuagagugagcuaucaucacaccacuucucuagccugggugacagagcaagacucugccucuuaaaaaaaaaaaaaagaaaauacucauuuuuuuuaaaaaaaaaaagguaguucaguuaaagaaaaaagaaacugcaucuaaaaugagaaguuauuuuaaaaaguuguaaaaaguuuucaaguaaaaggcaaggaugcuguguguuccuuagccacgagccucaucgcauggaaaacauucucuacuaccuaauauucauuauguucauguucaucauauauuuugugcuccugcuauaauuuaggguuacaguuucugaacuuuuuuuuauucuuggaaaaagcacuuuuuucucugguuucuuauauuuaaugugucaaaaacaacauaagaauuuaguagcauucagaacauauuggguuuucuacauccuuucuugguauuuuugcauuauuuuuguguacaagcacacaauuuuaaaggauuuaguuaaauauuuaaagaauguaaguauucuuuuuauacuuuauuauccuuugaaaggaagauagcaucacaaacaacauuuugcauacauauuuggcuaauuuuaagugaaaagaaauuguucacgguaucuaguuugcuacuuacauguuugugagggggugggaggaauaugcuuaugaauuuuuaaaaaaucaaucugccugucuguaaaucagcugaauuuguaaaggcuuucuuuugucgguauguuacuguuuguaggauuaggaugguguaacuuuuuugaauaugggcaccuuucuaagagaaaaauaggucuucauguauuauuucagacuaaaaaguagacuuuuaaacuuuuauauuuucuuaaaauggaagauagguauacuuuagaauaaaacaaaaacuuagaacuauuucauuuugaaaaauagaaaaaggauguacauacuuuaagaaaacaacauauuuuucuaaaucaagaguguucauaaaaaugaggauccagauggucaauucagacacagugccuaaugcuguaauuuuuccuucuaguuaaaaggcuggccacagagaaccugcaauacaugguaaaagccugccaaguggggucagaagaagaaccuuccucccagcugacuucuguguuuagguaacuggaaaauaugccaccuggcaaggaaacuauugccagccauuugacagccaacauguuuuuuaaauaacuaauuauccaaaacauaauguguuacuacuuguuuauaguauuucaauuauuguauuuuuggcaguaguuuuguuacacugugauguuuuauugaaaaauaaaagugccagugaaaaagauaagugaggggacuuaaaauuaccugugaauuuagugaggaagaaucuugcaugaacagucaugugucucuuaacgauagggauaaguucugagaaauguauaguuagccaguuucaccauugugugaccaucaaauagaguguacuuauacaaaccuaggugcuauagcccacucugcaccuaagcuauaugguauggccuaaugguccuaggcugcaaaucaguauaacaugucucugcacugaaugcuguaggcaguuguaacacagugguaaauauuuguguaucuaaauguauccaaacauagaaaagguacaguaaaaaugcaguauuuuaaucuuauuguacugaacuaccauuguacaugcuaucugucauugacugaaaugucauuacgugguccuagacuggguuugagagaguaaagugggaaaugugagucaugaugacagguacacaggccuucagaccuugcuaaacauguuccgcuggauccauuguagaaguacaugucacugcuuuucugacuugcuuuaguauacuaacuguagcuucagaaagcuccguuauguuuaauuugugaagcauggacuuuauagaaguagaucuauuguucauaagaauaacagugcaacuugaggcauauuuucuuuuucuucccugucuuguucccuuuagagucuugugcuguuagggcaauacguuuuuguauuucuuucugaagauuucuuccaguucaccuuuauuauuccuaucucugccuuaccacuaccaugagaaauaauuugcguucguuuccuucauucuauguuggaucuuugauaccuccauuuuucucaucacauaauuagugccugucaaguguuuauaguuuauuuaaauugugaucagucaguaacaauggauuugugaaaauugugaagcccuaggaggggagaaaaggauuuucuaugaucaaagauugaauguuaucuauaauuuacuaagcgagguggcuuuucauuuuguugauugguaguggaggguagagguuuuaaggcuaaauauagaauuuuuauuuauaaagaccuucuaugggucuaaagucuuuuauucaguuaaggaacauaaaauauauuaggaauaacuugcuuuccucauaaaaauauuguuugacuuauauagagcuacaaagaacuaaaaaauaacuaggaaaucugacuuuuuucuguuacugucucccauauccuuuccacucagauucaauauguagaauauugcaaaaaagucccgggauuagauuuuuaccccuucuucucccucccaagcuuccaacucuucccuucccugcuccuccccacagugcuuucacucuggucauggcucaacuuaaauaagccacuucaauucuuuauuuuaaaguguuuuaaauaguuuucauauugcauccagauucuuacaguaaacuuuuaugaaaugaucuuuguuauguucaguucauaguugauugccacguagauaccaacacaaggaauugccccaggaguaauccuaaauaaaccuguuuuacuuucaggcaguuuauccaggauuaugguaugagguacuauuaccagguuuacagcauuuuagaaacaguagcaacauuggaccagcagguugucauccacuugauuucuacccuuacucagucucugaaggauucagagcagaaauggggccuuggcaggaauauagcacaaagguauguuugauaauuuaauuacauuggggggggcagugauuauaaaauuuauauuucauuuuauagaaaugauuuauuuucuuauuccccaaaauuuggguauguucuuuugagaugaaaaauguuucaguacugugauuaucaguuuuacaaagugugaauagaaguagcauggcucaucagcaaacuuagcaaaaucaauacauaaauuugcauguuuuuccuuucaaagugaccgcuuuagaaagcuguauauuucagcagugcugcuguugcucaaaacgcauuucaguguuccucauugggaaguggacuucauagccuuggaugucuuguuuuuuaauaaaauuuaugguggcaaaucauaaccguuugagggaugcuugauuuauuuagucaacuguaucauguguaucuagugaauaagugacccaauuagacaguauagguuuuggucaaaaauaggaaauaagacuuuuuuuuaauaggcucauaacucaacugaaaauagugcuggacuauuuagagucucaacauugugggaauaagccuauauuuauuucuuaaagaaauuguuuuagaguagucaguacucacaguggaauuuuuguguccuaaagguuauuaaagaaucaaaauacaguuauguguugcuuaacgacagggauaaguucuaagaaauguguaguuaggcgauuucaucauuugugaacaucaaauagaguauauuuacacaaaccuagauggaauagccuauaccacacaccuaggcaaugugguguggccuauugcuccuaggcuacaaacuuguauaacauguuacuguagugaauacuauagacaguuguaacuuaugguaaguauuuguguaucuaaauauaugaaaacauaguacaguaauuauaugguagcaaagauuuuaaaaugguauaccuauauagggcacuuaccgugagugcagcuugcaggacuaguaguugcucugggugggucggcgagugaguggugauaaaugugaaggccuaggccauuacuguacacuauuguaguagacauuauaaacauaauacauuuagaguacauuaguuauuucuaaaauuuuuaguuuuucaauaauacauuaaccuuagcuuacucuuuuuuaccuuuuaaacuuuuucuuuuuuuaacuuuuuuacucuuguaaaaaagcuuaacacacacauuguauagcuguacaaaaauauuuucuuucuuuauauucuugaauaagcuuuuuucuauuuuuaaauuauuuuuuauuuuuaaacuauuuuguaaaaaaugaagacacacacgcauuagccugagccuacacagggucaggaugaucaacaucacugucuuccaccucuacaucuuacuucacuggaaggucuucagggucaguaacgcacauggagcugucgucuccugcaauaaggaagccuucuucuggaauaccuccugaaggaccugccugagucuguuuuacaguuaacuuuuauuuuuauaaguauaaagaggaguacacucuaaaauaacaauaaaaaguaaaguauaguaaauacauaaaccaguaacauucuuucuuauuaucaaguauuauauacuauguauaguugugugugcuagacuuuuauaugacugacaguacaauagguuuguuuauaccugcaucaccacaaacaacacgaguaaggcauuacacuaagacauuacaauggcuacaacaucaccaggcauuaggaauuuuucaguaccauuauaaucuuaaugggauccaucauugaccaaaaugcagcccaucauugaccaaaauguuuuuaauguagugcaugacuauaaucauaugcaugugugucuguuuaucuguacaaauacacacucuaaugaauaugcauauuccaauuuuuagacaaaaauuuuuuauuaaacaauauaugagaucuuucuugaagacaugacuauguugauuauagcuuuagcuaacuaauggaauccauuuuuucaaugccauuucauauaaaaggcagggggugcggacuggagagaucauccuuguaaagcuuuuguaugccagaauggaacaucuccuuucuucugcauggugacuuggcuagccuccugugguuuucuaaggagagaagauugaaucacuucaaauuguagcuugaagaaaugguguuuauugucaugucacaaaacaagcucaugcacagacaugucucacaucuggcuucucugagcagucuucaaauuugagugaaaaaacuagagaggcugugugugaaccacccuaaugcaguauguuguuaaaacaaauauucuggccuacuaccuugugugguuaugcaggcccauaagaaguuugguucuaaagauucugaacagaacagguauuuagacuagugagauaacuacuaggcacaauaaaucaucuaaaacaccuuccaaauacagggaaguacuagagaauguaggaggagaaacaauauuuuauuuucaaacuuuguuacuuauaagaaguuaaaagaagaaaaugggauauauacugaaauugcuacacaggucuauuuuaugguuacagaauuuuuguuuuaauacuuacgcuugugauacaagucuucccauuguaaucauaccaucauuguccuuaaauaauauuccaugaaugcauuuuauuacccgugagcauuauaauauuucggaagguuaaugaacuuuuacaugucauuuuuagcacacauuuuauauauaaaaaucauacuuuaauacaucuuaacaucuagguuuacucacaauagauauaaagcauuacuuuuuaagaaguguugugcuaagccugcuggauggauggcugaauagauggauggauggaugaugggcagacuuaauuuguaaauacugaaaugaaaaauaaugaaaauguuaauauauuugcuuucuuuucuuuuuucuuaaacagggaagccuauagcaaacuuuugucucaccuuggacagaugggacaagaugagaugcagagacuggaaaaugauaauacuuaauauauuuugugauucauccugucuauuaauuaucaguaucuaaagccacauuguuccacucuaauuccuacuuuuaauuaauuguauaauguucuguuuaaaauaauuucuaggauuuuuuuuccuuuuauaucuguaaguaaaaaauguauaaauaaggaacugaagguuaauuagcaacuguguaauaggauccuuggaacuuuuuacaaaacugcauucuaccuugaugaaauuuuaguuaaacuaaauuaaagaaacauuuucugagaguguu

SEQ ID NO: 13905 - RNA, 9804 nt, Homo sapiens
gugcgcaugcuccgggugucccggaguuguccugcgccgguguucccacgugcggccugaaccugagcgcauaauguuaugaggagaugggagcacuagugauucgcgguaucaggaauuucaaccuagagaaccgagcggaacgggaaaucagcaagaugaagcccucugucgcucccagacaccccucuaccaacagccuccugcgagagcagauuagucgugaguggugcgagggcguuucggggcccgggggcgcggagucccugugcugcccggcugucccuagcguggguccggaggccgagggaucggcgucagccugcucggccgcagccgcucggguuggcggagcguuggaagggggagccgccaggccggugacauugagacuguccuccgcgcccgcggugaggucggcggccccgccuacuuccgagacccagaggcagcagccagugcucccgcuaaccaggcccucgccggcugcugucacggacuugauacagggaaucaaaauccgagagggucacagagcuuucucuaggggucuucacuggacgauggacgcagagccugaccuggaauuuugauuuccaucuaaaguauuuuccuaacaguccaaaugauuauguuuauuuuuuaaaaaaauuaaagugguuaggccgggcgcgguagcucaagccuguaaucucagcacuuugggaggccgaggcgggcagaucaccugaggucaggaguucgagaccagccuggccaacauggcuaaaccccgucucuacaaacaaugcaaaaauuagccgggcgugguggcgcgccuguagccucagcuugucgggaggcugaggugggagaaucucucgaacccgggaggcggagguugcagggagccgagaucgcgcgacugcacuccagucugggcaacagagcgagacuccgacucaaaaaagaaaauaaaagaaagcguuuguguuaagcguuuaggauauuacaggaaauuuuccuugauuuuaauauugugacuuuuuuccuuuccuuagucuauccagaaguuaaaggagagauugcucguaaagaugaaaagcugcugucguuucuaaaagauguguauguugauuccaaagauccugugucuuccuugcagguaaauguguguuuaauuaagugaauacacaauuuacuuauuuuggggcuucaggaaaaugauuaaguguggcaaguaguaaaaagagugcucugcaaguguguguugugaucaaucuacacgccuuggcaaaguuuaagcacacugguguaagacagcaagacacuuaugccuugguucacuggauauuuaccagaauucuaaaauaacuuguggaaguauugauacaagcaacugugugaauuauuucauaguauuucagaauuuguaggauuugguaaggcauuacuuccagugguugucauuugagugacaaaagcagagcuuuaauauuauuuucucauucuucuguggauugagguauguucuaaucucagagacuccuuuaguaagugguguuguuggauuuugugggguguuccuguuuguuuuuuuaaggauguauucagauaggauauuuaaaauuagaaggaucaaagaauacauuaggaaugggaaccuauguguaaauccauauucuguauuauguaaguccugggcacaagugcuuuguauauagugaugaacaaaacuaguccuuauuuucacagggccuaugauguugugaaggacacagccauuaaacaaaugagcaacaaugugaccauaauuaugggaaaaguacgugcacugcugaguauauuggagggaccucuuugaaaugggaggaucaaggaugguuucugaggaagugauaguuauguucaggccugaggagggaucaguuggaguuaaccagaugaguuuuugggggcaggaagauucuaguuagggguaaaguuugauuaaaggccaaggaagugccaacaacuuccagauuuuuuuuuucauucuaaaauauucugguacugucccucucucucuggauauuugcacagauagaauuauuaauauaauuuucacuacagaggagaaauaaaacaagauuuguuaaucgcugcacauaguaauuguaggguucaguuaucaccacaugcucacaugaaaaaaguauaggguuaaugucuguguucuuacgucauuuuaaaauagguguugaguaauacuccccaaguauucuuucucucauguuacuuaauuaugcaucugaaaauucacucuugggagcaaaaaaaaauuaaugcuuuguauguauaagacucaguuauacauauaaugcguaaagagauacguauauagugauauuaaaauuucauggggacauuaggaaaagucuagauuccuuagggagagugauaaugaaaacuggaauugccuuuuguuuauguucugugucccuuuuuuuccuucgggcaguucaugguugugaugccucuagacaucauugauacugugccuuucauauggcaaauaauuuauuuguugucugacuuuuuaacauauuuauucaaaauucugucaaauauuucagucuuuuugccuuuugugguaaaggaauacugggcccacucuaccaucauauaaacucuucuguauuuucuuccaguaguuuuauaacuacauuuuauauuaaaaucuuuaucuggcauuaaauguggucuuugauguguggaauagaucaguugaaccucuuuucaaacagauggcuuguuguguaaauauaauuuguugaagagcccagaccuuucuccacuuacuuaaaaugcaucucuagauacacauaugggucuauuuauggacucaucaguuuuacuuauuuuucuauuuauacacuagaaccauaguuuuaauuaauagagcuuuauaauguguguugauauuucuuauagucuucucucauucuuuuaaaaaguuucuggucucuuuucacacauuaauauuuuuccagaugaauuugagaaugaaauugucagguucuuuaauaaguccuauuuggauuuugaguauaauugaaugggaauuuauggauuaauuugaggagaauuaacauuuuaauuauuaagucuuugagugguaaagggaacguuguuacugugaugggagcuuuuuucacuuuaaauuuaaacuguuuauugcugcuacaguagucuucccuaaucagcagauagguuccaagacccucaguagaugccugaaacugagcguaguacugaacccuauauauacugcuuuuuccuauaaauauauacuaugauaaaguuuaauuaacaacuaauaaaauggaacaguuacaacaauuucaggguucgaagauucauucuuauuauccauguuagcacucucgccauaugauuuuuuuuccucauuaagucaauaacuuuuaccuuuucacuugaaggaagcacuuuauggcuucucuuuggcauaacugaguugccagcaucacuacccuugugcuuuggggcuauucuugguaaaguaaggguuacuuggacacaagcacagugaugccacacagucugauaaccagaauggcuacuaagugacuaacaggcagguagccuguacagcauggauacacuggacaaagggaggauucacauccuagacaggauggaauggauagcguaagaauucauuaugcugcucagaaugguuugcaguuugaaccuuauggauuguuuacuucuggaguuuuucauuuaauauuuuuggucuguaguugacuucagguaacuguagauaaagccagguacuacuauauaucagaaagugagugguuuuuauaguguagcuacccacauugcuagguuauuauuucuguuagguuuucaguugauucucuuuucuaaagauauaucuauguagaauuaaaaacuucucuuucuaguauuuuuacuucauucuuuuauuguguuguauacauuaacaugccagugaaaguaggcauucucaucuguuccuuccuuccacaggaugucucaaguguuucagcauuaauuauaauagaaugauacuuguuuucgauuaaaaaauacuuauaucacguuugggacauuuucuucuauuuuuaauuuccuaaggguuuuuuuuuuuucagucgagaggauuuugaaucuucuuagauuuuuuugugucaaauaauuauuuauuuuaguauugacuauuaauuagaaaggaaaucugaauacagaugugcuuggaguggaaggaagaucuaccuuaccugggaauaggaaaauagcuuugagauuuggaaagugaaaaaguugagaagaguguuucaggccuaguuugcaauauaaagauacaagagugugugaugccuuugaagaaugguuagaguucacugcaguuaugagaaaaugugaaaugugaauuugggagaagugaguugggauggagagugauaggggucagaucguaaaggcccuuauuuuucuugcuaaggaguuuuguuuuauucugaagacaaugggaagucauuaaagaguuaauggucaaaagugauguuagauuugaaaguagccuggcgggggaacaaagugcauuuuaucuaauuagaagagaccaaauaggagguauuugcagucauuucugcaagagacauuggcuuggacuagggugauuuaguaguaugggggagaugugagugaguuugagagagacauaugaugcagugucaacaggauuuggucauugauugguguaaugaguaagggagagggaggugcaaguauaaucucauuuuuggcaugagagguagguaguguuggucauugaaauugaggauaugggaguagaacuggugauagguuuaguuucagauaauauugaauuugaggagcauguaggucauuuaaguggagauaccuguuaagcauuuggguugggaaaucaagaaaaggucuugguuuacgaucacagcuuuggaaguaauuaacuuguaggcaguaauggaaguuagaggagugugugggauuacuuuggaagaauguguagagugagaagaaggccugggcacucuuaaaugucacacacugacauuuaaggguaagcaaaaggaaaaggguccaugaauaaaaccccgaaggacccacugaaaaaaccgauggaaaacugugaggggguggcauggaaaccaagggggaagauaguuauaaguacauuggaguggucagcagugucagauguagugagauacuauagugaguucaaaugaggucuaaaaaguguccucugaauuaagcaacuaggcagucauuagagauagcaagcauuauuucuuuuaaacauuaccugaagagaaggaaacuggucauaaaagagguguugguuuuggguuuggugggcauguuaaaaaacauaguaacuauagcauuucuauauuugaccaaaaagcagcaguaggcacagugcaguaaaaaaaggaaaagaaaagaaagaaugauaggcauagcuaggaaacaagaauggaaugcagagcacacgugcugggauuaagcugggaugggacagauagauggaaggaugggugugcauagguuguuuuauuuauacuggaguguauuggaggcguuaguuuauuuucucgggagaaagaucacuagcaauauuucaauucauucaagguguuugggaguacugaguaugaaauacaaagcugggaaacagaauagauguuaucaagccagcuguuaggguggcaucagaauccugcccuuuuaaaacaggugcaguuuuuaauaaauuauuuucauuguucuuuuaaaacacgugaaauaauguggugaguggaugguauacauuugauuauuauuuucuagagaugccuacauuucuuaaugauagagcuauaguuaugaaaaggcaauguggcaaaaguacuauuaaacuauggcucauuauaauaagaaaaugaaguuuggaaaaucguauauagaauuuguguuaauccauucuugcacugauguaaagaaauacaugagacuggguaguuuauaaagaaaagauguuuaauuggcucacgauucugcaggccauacaggaaggauagcagcuucugcuucuggggaggccucaggaaacuuauaaucaugguggaaugggaagcaggcacggcuuauauugccagagcaagcagaagcggggugugggggaggugcuacacacuuuuaaacaaccauaucuggugagaacucuaucacgagaauagcaccaaagagggaaauccacucccaugaucuagucacuuuccaccaugcccuacguccaacuuuggggacuacaauuuggugacaugagauuuggguggggacacagauccaaaccauauuaguuguuauuugaagaggaauaguguagauuugagaaguaugaaaguagaugucaaaucuuuucucucauccuaaaaccuuuuuuuuuugauacuagguaaaagcugcugaaacaugucaagagccgaaggaauucagauugccgaaagaccaucauuuugauaugauaaauauuaagagcauucccaaaggcaaaauuuccauuguagaagcauugacacuucucaauaaucauaagcuuuucccagaaaccuggacugcugagaaaauaaugcaggaauaccaguuagaacagaaagaugugaauucucuucuuaaauauuuuguuacuuuugaagucgaaaucuucccuccugaagacaagaaagcaauacgaucaaaaugaagaaaaucacagaaauuuccuauguguacuccucaucccuccugcuguauauuuucucauuuuuugcguaauaaauuauguuaauuaccaaauauuuaaugcucucauugugagggcauacucuuaauauuuauugagcucccugacuuuucaagauugccauagaauaucuuuuguuuuauuuuaauuugguuuaggcauauuucauaagugcaugucagcaugacugagcacaucuguaccuuuauuauggugaaagaguuaauuuguuauuuuaggcacauauaccaacuuuuaaauuggucauauuaccccuugggaaauguccugaaucccucaacugaguuuuacuuuccaaguuagguguuuaguucauucuucucaugcgauagugaaaguaaaagcuuuccugacccuuaagacugacauuuucucguuagggaaagagacucgauagcaggguagacuaacaguaguucccaaauaaaggcacacaggagaaaaugaaucaauagaaucuaauuaaaauuacuacuccagggaauaagaaguauugaggauuuauuuuauuuugaauugguuuuaaguauggaauaauugucuuuacaguuauaaaaaguaauuagugguguuuacaaaauguugggaauuucugcuuugacagauagguaagucccaugggaauuucugcuuugacaaauaguuaagucccauggccuucagagaggcaggaagcagaaacuuucaaaaaaguaacauuucucuggauuuaauguggaaauagagaaaaauuuaaagaauaauuaaaaaaccaugguagaugaaauuuggugauuacauauaguuucggauguuaaugcuaguugagagaagagaaaaagauagcaaguagaagcagagaacaggaucauuggaagggaccugagaaauugccauuucauccauuuuagcaaauuuaauuagcauagcauguaccaguacuaggaucuugagugagugugugaguuuagcucugccuaauauauuacuacuugggggaucuuugggagacuauaucuucuuggagauugaguuucuucuauaaaauaagcauaaugcuacccuaaauguaaggguuaucaugaagauaaauaauaaaggacuacaaaggaccaagcaaauaggaauuauuuuuugcgguggagaaacaagugccuggggagaauauaugaccgaagauucuguaguuuaugacuuaaacaggcccagaauuuaguuuuucaaauccuaguaguguguuuuuucugucuugccaaaaagcagcacaccucaaagaagggaaaaggugugaauuguggguauauuaggguuauuagugcuuccgagggaagauaggcaucacuacuucccagagaugccccuggaaaugauauagaggauguugaagaauucaaugugaugacggaaugaggcauuuguaguaaugcugagaacagaaaaauggacuaaguggaaaauuuguaagcaugacuuugaauguagauuuguuaugugaacaaacuaccuaguuuauuuuuaguucaauacaauaauuguuuuaagaaaacaugaaauaacuacucaauauaaaaugcauuuuaaaacuguaaauaagucaaaacuuuauucuuuuuaucauaauggucacuagcugagucacaaauacuaguacacucuucugagccaucuucuuuauucauaucuacauugugugguuaggcaucuguuauguggugucacaugauaaaauaaagaacuucuucccauaccauucaucaguccuauacugcguuuuauuauauacaggagagcacuugguagcagugaugucagaaagugcauggaauuuagauucagaaaacaguuuagaucucaggaucaccacuagccaugccaucuaacauuuuaaaaguaauuacuguacuagggucugauugaagugcuuuacguguauuaacuugcuuaauauuuaccauagguacaaggauaaguagccauauuuuagaagcauagagagcuucaguaacuucaaagauuacuuaguaaguguugaagccuggauuuaguccuguuagguuauuuucagaaccuugugcuucuaacugauacgcuauguugccuuuguaagauuaugagaauuaaugagaugucaugcaaagugccugaggcauaugaggacaggacuacucaaugcucaccguauaugagaaucaucuguagaauucugggaaaauacagaugucugcugugagaggcugguguaagucugggagacgccuggguucauggauucuggaucacggguguuuaaaaaauaucuaugaccagugccaccagcauguuccaaauugcugaucacuugugcaggugaaauagcauucucuggucuaaaguuuauugugaaagaagguaaggaucagagaauagacagaaggguggccuugaaggaguuugaagaaaggaagcuuuccagaugauggaagggagaaggaaagaauuucaggagauucaaagauuuggggauagggugaggagaggaaggaaggagauuaauagacuggacaggaaagccaggauccagggagcugauagaggaaaagcucucaagaagggagaagccuucuacagcaaaguggguggauuugggaaaauucuaccauaaauaaauaggaugaccauauaauuguuugcccaaacuaagauacuugaaaagggacaccaauuacaucaugauaacagggacaauaggcauaaacuggaauguccuggacaaauuaggagguuugauaauccuaacugcaagaggcacuguuggaggacuuaaaggccaccugcgagcuggauguaacugucuuggcuccaacuugccaagguuuagcaucucaccaucacucaggaaugauuccugucuguaccggggggcuuugcuucguccccaaauacuuguguauggacauccccucuucuguauuuacucaaugcccucaaaacacccauaaucu

SEQ ID NO: 13906 - RNA, 10829 nt, Homo sapiens
uauagauguaaacaaacacaugugcauacacauauacacacagcucaaggcuaaauuuuguaaauuuaaaccuuccaaauuuauuuuaaauguuaagaguccaggaguuggcagcaaagugcagaaaacagaauauuuuuacaucuuagagaugacuauacaggaaaugacauucauucacucuauuauuccacaauuauguaucaauaugugugggcaagagggcagauggcaauacaguaaacugaaauugaaaaagggacagcauucucauggcacacucaacuacucuaccuguuuagcuggagguaacauuuauaguuauaacugagcacucaugaaugguuuuggauugaggcuaaaucucuauaaaaugggguuauuucauuuggaaaaagcacuagacaaucaggucuggguucaaacccuaucugacuugacucuuucauauuacacuuaccaaaaaaaaaaaaaacuguagaagauaaacagggaagacaaugauuagcucuacagauuuuauauugggaauaauaaagugccuugagggcaaugaaaaauaucaaugcccuuuuauuccuccccaaaaauucuaugucuaggguuuuacccaaagggaauaaccauagguauguauaaaaauugagcuauagccaggcacggugguucacaccuguaaucccagcacuuugggacgcugagguaggcagaucacuagaggucaggaguucaagaccagccuaaccaacauggugaaacccccaucuacgaaaaauacaaaaauuagccaggcacagugaucggcaccaguaaucccagguacucaggaggcugaagcaugagaaucgcuugaacccgggaggcggagguugcugugagccgagaucgcgccacugcauuccagccugggcaacacggugagacucugucacaaaaaaaaaauaaaaaauaaauaaauaaaaauuuuuuaaaaauugcacuguaagauagucauuacuguacagcugaagaaaaaaauuauauccccaauaaacuaugauacauccauagaauaauauuauucagaauuaaaaauguuacagaucauuccaugacaagggaagugguucaucuuuacacgaaauuacaaagcuauauaucuacacuaagggccauuuuuagaaauuaaaauaucauaguauuuuucuauauguauauaaaaauagauaccaaaaugcuaauaauaguuauaucuggguauaauucuucuuuucuuuucuuuuugcuugucuggauuuucuaaauuuucuuuucuuucuuuuucuuuuugaagacagggucuuucucuguuguccuggcuggagugcaaugguaugaucacggcucacugcagccucaaccuccagggcucaagcaauccucccacuuuagcuucgcaaguagcugggaccacaaccacgugccaccauaccugacuaacuuuuuuuuuuuuuuacuuuuuggagagacggggucuccucauauuucccaggcuggucuccaauuccugggaucaaagaauccucccgccucggccucccaaaguucugggauuacaggcaugaauggccaugccuggccucuaaauuuccuauaaugaacaagaaaaacuucuaaaguaagaaaaaaaucuauuauaucaugaggguggaggguaggaguagggacaggaucaggaaaaauaacuaauggguacaaggcuuaauauuugggugaugaaauaaucuguacaacagagccccucagcacaaguuuaccuauguaacaaaccugcacuuauaccccugaacuuaaauacaaguuaaaaaaaaaacagauuugaaaccuugaaauaguaacuauacaugaacuauagaaacaaaaaugagaaguucccaauaucaccaaaccuguaagugggugcaaauuuauccaauuuauagaaaauggagaaaccugauauucaacuuauacucgaaacuccuaucauucaagaaaugaauaaugcaaaagaaggaaaaacaucugaagaagugcugaguaggaacaagcugagagaacagacuuucugcuagugauagacagugugaaacuuuagaagguaucgugguuuaugcaggguuaaucaaaauggaguaggaagacugugugcuucaaauacaggggaaauggaguaaguuacaaugaugaaaagaauggaucuuacuacaaaagcccacuuaccugaacauuuuucccucuugaagacaauggauguuaugccuacaccccaacucccuuuguauccacauccucccaggaucaacuugaacaaaaaauccugcaccagacagccucaaccaaauaccauaccaaauacaugggauagauuuaauugauucucaaauaauuuucaguugaaacucuuacucugaucuaaacuucaggcuucuuuaaaugccuacaaauguucucucucuaaaguuaccuacgcauuuguuuuuguuuuguuuuauauuguauaaaguaggaagauguaaagaugccucauuuuaggagaaagguaacagcuagaauacagaaucaugucccuucugcaccagccuccccaaggaagauccuuagaaguuuccacagaaaagaauuugccuaaaauauuuuucaaaugcuuuaauaacauagacugagcuaagucaauugagagaaagaaguuaaccaagaagcuuugcucaaaaacccuaaaagguauguaaagcuuauaacuauaauaacacauaaagguuuaaauugaaaaugauguuaagaauuugaaaaugaucuaagaaucaauuaauauauaugccaggugauugguacaguaucuggcuggggguuuuucuaaauuguaucugggaagauguaauucuuuagcauaucacucaaaggaaaugcugauaauaauaacccuauuauuaauuucaauaggugaccacuagauugcccccauaccugcaaauauaccaucuauuccccaagacccgagagcuguguuaaaauccaacuuuucuaacucuucauuauguuuauaaugaacaugaaugagcuuuccuguguauuaagcuagaguuucacgcuugaguuuucugaaucuucugucauacaaacagaaguggauacaaaucuuguccauauuuacuggugcagaggcuagaaugcauuuuauccuaugugucaaacuuaaagccugaaacagcuugcugucagcuucagaaaccauuuuuacaagcauggcauaccgccucaagccaaccaaauccuaaagcauguugggcugcccacacuucaaaucauuuggaauguucucauguuuugugguugcaaaaguaccaauuuuguggaucaucuaguucaaauugagggcacaucuaaccuuaaacagaaaauuccccggaaauugaaacuauaacugaccaggaucacaucagcucuuaagaucuaugaucucaggcugguagucaaacaucucaaauguuguguuuugaaaguugaagaaaugcaacauaaacucugugaaacucauucaugugucuucaaggaaacacuaagaacucauccuaaauauacauaugucauaguugcaaaaaaaaaaaggaaaaagugccaccugcaacaaaguaaaggugauuugcagcaaauauaaacacauuucugguaaacagcuagcaaauuaaagaaaaaaaaaccgccuaacagauuacuucauuucauuucuaauuuucauacauaagcugaaauauagcagcuucagcugugaaaugugguaacaaacauaacaaaggugaaugaaauaguuuugcuuguaguaacuggagcacuguauuuauacauauuguuuuuccaagcauuaaugggucccucucucaaaucaagugcuuaagacaucauuucacaaauuggaguaccagaacuuccccaagguuugccucucaugccuuugaggucuacucucuaaaucccagaucuaugaagaauguccuaaagguuauuuuugaaguauuaaaagaagaaaacacuauauugacaaacuaaauuuuaccuagaauuugccuauugaagcuuaagaaaugccugguucaauuauccauuggcaggguaauucaauccauuugaauagauaaaugugguuaggauaugguucccugauccaagccuuguuaagaguucgagaacauacugaaaaccagugcuuuuuaacuuaacugauauugacuaaaaugcugaaaagaugacaagcccuagcaauaacuauuuuuagcugauauuuuagaccuacuguuccuggugcacauguauuauuaggucccuaaaugguuuucauguuuuuuauauacucaauagcauauacagauaugguauauauaguuauacuauauauaguauggauacauaaauauagauauaugugugauauggauauauacauauacaaauccaccucuguguguaucauuuccaaaauacucauucacaaaacaaucaacccaaauuaaauaaaccauaaacaaaaucucaaggugcucaaguaacucuaggaacuaagucacauccacuuaggaacacuaaauucuuacuuucuugcuugcaguccagcaaacuuaagguaaaacaguaacuacauagggguuuuaguuauguuuauuuuuccuaagcaaauuuuucuccaagaauguucagcuugcugaaauuuucagaaaaugcuugagaugguggguucuuuuuuugaguuucgguacugguauacuuuacagcaaagugacaaaacuguacuuagagauaaaaaucuauaucccaaacaaaauuuuacaguauuacugguuauucugggaugauuuucuucgaaaacuucccauuacaaacaauauguuuccuacacuaucccgucugccuugguaguauacuuuucacacacaaaauuguacguaacgcauauaccagaaauacgucaaggcacucuuuuauuuaaauaagcucccacauucuguuuuuauuguucaaaaugaucugaaugcucauaauugauguaaucaauuaugucacuaaaauuuuggcuaugcaacauuuuacaaaauauagggacuuuucaucagcaccuuagauuuguaguuggcaaugugagugaauaaggcaaacaggaauagagguguggcagagaccuaggggugugagaaaauggggcuuccuuuacccacgggacacgugggaaaaaaaacuuauccacgucugcaauaaauguacuuuuauguuagguuucauuaaaugaaacacguauuacauaccucgucaauggauuagaaugucugaagcaguaucagcuuaugcaagaaacaugagguuuuuauccaugauucuuagaaacacuacuccuagaacugguugaaggcuucuuaaucuaagacauaaugaaaaacaagcucacccaauaaacaaagagaaauccuauuuuaaaaacauaugguuuaaacuucauccuaccucacuaaaaaccugcaugcuacuauagggaugccuguauucccuaagugucgagacucagucucauccaagacuaaacgaucucuuugaaaauuugggcaagcccugggggaaauuuucauaaagauauguuguuggauuuuuuuuuuaagcacucugagccuccacaacauauuuuauuauuaaaaagaagaauguuuccgaaaaggggcagaggagaaaagacugaaaucagggcgacguugaaaaccggccaaggaugcaacacacagcgccgcaagcugaaccacauggaagagggaaccucucuuaacuguuggagcgcgaaaggaccuuucgcucucgcaaacaagguaaauuucagcccucaagcagcgagaccaccguguaaaaguucaaguggagcucaucuccuuccucucacucccagcacugaauucucaaccagaacagcccagcaggaaaggagccggcauggggugccccucugcagccgaccguuuuccuagaaggccuaaccgcucagacgggcaggggaggggggcgggcggcccgggagaaaccgaguccccgccggguccccaccguguggcgccgaccgaaauaacuccaguccagcugcaaaaacccucccgaaaacccaagcuucuccggcacaacuucggucucuccagccucauuccuccccgcacuccgccaaacugcucgcccugcccagcgcagcggaugcaagcgcuccccgccccgagcggcuaccugucccgcgggccggggaucgcgggccggggaucccgagccucaccucaccucaagcgaagggcagcgcgcgggcgcccgcggaagagcccagggagcauggcuccauguagucccucccggaacuuuccugacauagcacuucucuccuccgcugcagagaacaacgcugccaggcggaggaggaaggaggacaacgaagaggaggugguggcggcggcggcgauacaggcggcgguggcgggagcuggagcugaaagugaggagcaucgcggacgagcgccgccgccucgcgagccgccgagggguucccgcccccaggguaaccaacgcucccucuuaaaggcgccggccccgguuuuagaccgggaggugagugagagaagagaaagagggaggaggcaaguaaaaagggagggggcaaguaaagagggaggaggcaaguaaagagggaggaggcaaguagagacggagagaucccuggaggccacgcccgagcugccccagggcggaucgccggccccuuucgaccgcucccugcccugaaccccucuaugcucaggucgcaucguuccuccgccugggcaaaggcaucgaggguaccgcaagugcgcccacccggcacuggggcaacccucgucguuggccugcgcccugcaccccgcgccucgcucccagacggucgccccgccccuaaucccuggcaguccuuuuaggguccugguuucccgcucccacgggcccccagagugcaccuccaguggcuacugcccaguggauuugcguuccccgaggcuacucgcguuucuucuuugguuauucuuccucauuuccaacacaaugaugagggucucacgcaggcguccagaagacugaaauaacuaaaagccagcuggggccccuagaccaaugcuugaaggugucccugauguguggcaugggagaauugccagguauccuccuuuacccggugcucuguucucuuccaauggccaauccccagcuggccucccacuggauuucuaaaacgauucacuuucaucaacacaugggcuguaaagaugccaaacaacucaggaagaccccccagaaaaaguaucaucuugagacaguggaaaaugcugcuuucagugacaagugauauuuucagcuauuaucaacauaugugaucauuacugaggccacagccucagguggugaugcccaggaggcucccagcaucagcagcuaucgucacccuaggaagagaccacagcagcagugggcaugagcagcagaggguugcuacuguccacggacuuguuuuucuaccucauaguuccaacccuugcuucuuggaccuaugggacuucaguauaguguugugcaguuuguacucugcacuguguccucugucugaggaggugggcaggcaauuuggaguuaagaucuagccuggguuccagagcaccaguccuagcaccaagcucggagagaguggcauuuccucauucacacaaaggcacuugcauaucacuacccugagacugaaccagaacaucucaguucuuugccuccugccaccuacagcugugaaagaagcacuuguguugaacuuguagaagaauaaggcaagaggagacuauacaaaagguugaagaaacuucuguaaccagauggagacgaaauaagcccugggcucaauaaaagcaggagacauggucuugccuggaccaaacuuuuaagaugggaaaggagauuaucagcgagcaaaagugaagucaggauaguuggauguggccagcacacaacucaaacugaguuagcaaaaccugcagcaaagggcauuggaauuuauugguucauauguuuauaaaucccauaaguagaacuggcgcgcgcacacacacacacacacacacacacacacacacguucuuagaaauccuuuuuacuccagauacucaaagagcaucaggacucaauuucucucccugucuucauugugcuuucacugcacugguuuuauuucucuaaacagagggaagaccuacaucuccagucuuaacauccaaccuccuuagcaauuagucgcaucagaaagaaagcaagcugaagaaugucucaccagacccacguggauccugcguucaucucugaacuaaccauuguaacuaugggauggaaugcacacugccaggcugggguuauuugccuuuaucuacaaaaaggucaagggaaauaauuguauguacccuucauauauacccaaaccacagggaccgaguagaaagaaagagguuucccaaaggaaaauuaaaguguuguuaauaaagaaggcaaaagaauguugaguagauaaagacuauaaaugcccacuacaauccccauuccccaguauacacacaucaccaccacugucaccaaggggacugaccaccucucugcuccuuuaccaacagucucaggaucagaagaaugagaaugcugaugggucauggaggugcuaguaauugagccaaccagccacauccuuuggccucagagccacugagaagauccugagugacauuugugacauuucacaaaccaccugcaaacaaacaauauauaaaccaugauuguauucaauuauuuuucccuaaauuauaaaccugccuccauguaccucaagcccacauucauuguuaggccuuuuuaguuaugcaaucaauuuaauuugauaagagcucauggaaauucccugauauauauauauauauucaacuugggggaaaaaaaaguggccuacgaauaaucacauuucaguauccaagugccaaagagcccagcuuuguuuuuaaacuucaguaacuuuaucuuuucagagagaaagauguuaucuuucucucugaaaagguguuuauuuugccuaccaaaaagugacaaaaaauuucaggcuuuuuuugucucacacaagaacuuuucuuuuacaguaguugcuaaaaaaaaaaguuuuguauuuuuuucuucauuugugcauuuuauagaaauccucauauaucauagaaauuuagacuaauaaacuggaagagacuuuagaauaaccuaaaacaucccuuucauuucagagcuaaagaaaugaaagcucaaagguugacuuguguaggguacauagcuguuuuuuaguaucugugaugucccuaacacacaugugcuuuugcuagacauuucgaaggauauagaagcaaaagcauagaauguagucacuguccucaaagagacauaacuaucuaagauauaagacaauuacagaacaucacaauauaucauauaauuuaguguaaaaagugugggaugaucuccguguauuaaaaauaggcaucagaaaaugagacacuauggacuggaauagucuuggaaacacuuucuagcgaggaagcaauuagauggucuuuuuuaaaugcagaggaaaaaggaaagauuuuccaagcaagaaagcaaacaaaaugagaaggcauugaugggaaaaagaucuugccacuugcaggaacagaaaugaaaccuguacugucaugguuuagaaaaguuuuucaaacuccaagucaugaagucauuuuacuaaguuuugacuaguauuauuuuaauuaaaauaucagcaugcaucauacuuaauaaguauuauuuguuaaacuuguguuucauuaucaugcguguucugaguuaugacaugaauucaaugucuuacuuugguuaauguucacaguaagcucaaaagccucugguucugaagcuaaauagacuaggugugaaacuguuuugaggcaagacauugagcaaauaacaucucuccaagcaucaauuucuuuaugugcaagagauuuucugcacaguccugugcacacaguaagacuuguaaaugccaccucuuauugacuagauuggauauuuucaacccugacugcacauuagaaucaccugagagguuuuuuuuaaaauaccguugccuggggcccauccucagagacccagauucaauuucaggguugacucuggacaucagugagauuaaaagcugcccaagugauuccaaugugcaaucauggcugagaacccugaguuggagccauagaacacaucuagcaccugaggagccugucucuuuccucagugaguacauugacuuugauaaguuacguuucuucccauagauagcaugccagguagucagcagauuucuaacuacuuucuacucugcauuugccccugaaaaaucuucaacugugguguaaacugcucaugguuuaccucaguaacacagcaugaauccugagucauaauauuucaugugucucuccacauguacauuuuauggucaguuguaagcauagagucguuucuggagguguuaaaaggcaguaaaaauaccaccaaaaacucccuaaggaaaagcagaaaggcuagaaguaaguggcauuagaaauccauaagcugaauaauuagcagaugacucauuaaauuccagcuauuuucauccuaacuuuuaauaguguaguuucuaaacauaguaauuagugaugugcuuuuuguaauuuuacauucaguaaucccucuuaaguguucauaac

SEQ ID NO: 13907 - RNA, 33628 nt, Homo sapiens
cgccucucuucucccaccgccugucggcugacgugucugcaguuccuccgcgucuacugcgagucaggccgugauggcggacgccugggaagagauuaggcgguuggcggccgacuuccagcgggcgcaguucgccgaggccacgcagaggugcccgacccucccucuccuuuguggagcccaaauuaggccgugggcggacacgccuguaucugggacuuuagacccgcggcccugcaucccgggucuucucgcugcuugucaccauucucuccuccucccucugucccgagccuggaucgcaguuccaaguccaaggcucggcgggaaaguccucagccuaggacgcccuggagccccccagcccagcugcagcgaaaugcuggcgcgccccgccccaccauggacggggccggugauuucgagcugccuuuauugagcauuucuuugacccucccucacccaccaaccaccaaaucacugugacaucuuggcuauuauacacuuccugaucuagaaugagcucgaaaggagaggcuaacccccgcccccaguacaguacuuggcaaauaguauguugauccuuaaaacuucuugcccuuuuaucucucguaacagaccuagggcuagaccccugaccccaucuguuauucagggcacugacauuuucuacaagcccacuaaccuuuggaggauguguccagaggagccuaacucugcuuuuuaaaaauaacgcuaauagaagccuuucuauucuuugacuacuuccuaccugcgauguuuuauuccuuuugagccggaagacagcaauccccuuaugcuguauuuucuaccacugauagcaaacucguaacugcauggguaacuaacguggguaaaaguuaugguuucacuaggccacauccccugccugcuugcagaccauguguguaagugaggcaauuaugcacuuaauuuaaaagaaaauucugauuaaacuggaaauuagggcauuuuuuguuuuguuuuguuuuguuuuuucuuuuuuccuaccuaaauaaaugucuucaauuuucccuucagauuugaagauuggaagcaggccuguaagagacaacagacuugaaauuugugaugggaugauguguaccaauuaaauaaaugauuuaagcauauguaaaccuacuuacucugaaagguuuuuuuuuaacuuauugaaucaguuagugaaaaauacagauauugugauguagaaguuagugacuaaacaaacuuuuuaaaagccuguuuucauacauuguauuaauuuuauugagcgccaaugucucaaguggacuuuugaaacaacuuuuuuucuuucccucagguuguccgagcggaacugcauugagauuguuaauaaauugauugcucagaaacagcuagaaguaguucauacacucgauggaaaggaauauauuacuccagcccaaauuaguaaagaaaugagagaugagcuacauguccgaggugguagguaauucuuuaguguuuuuuuuuuucuuggauuuuuggaaggggcaaaacaaacaaacaaaacccguaaacauguaauugcauacuaaauuauagauuguaagauaucguuuucaauuguuaauuugauaaucaggcuuaauauuuuuacuggguucaugcaaacauggucauauaauuuaaaugaacucaaauguugucacuuaaaauauuuuaucauuuugaguuauguguacuauacaugaauuaauuguuucuuuuuacaauucauuaauuuauugcaugacucagggaaggguauucagcugccuuuuauuaggugguaauugugaagggggacaguaucuuacaggauuauagauuuuugaaaaucaaggcuguauuucuuuuuaaggcuuacuuguacuuacaaauuagguaacucaauccaguguggugcuacaccaaucauauuguaugaaaugcuguuaaaaacacgcacaaaguugguuuccuuugucuucuuaaaauuugaacagacuaccaagcauauuugaauacuauuugauuaaaauagaagcaauuaugaaagccucucuucauauuaucagaguguaacauuggucuuugucuuuuuuuauuuaucuauuuuccuucauaguaccuuuaaaauaugagcuauaauuugaauuacuuaacagauuuucuuaugcugauauguagaagccuaccuuuuaguaucaaauaauugaaaaaaaguucaucuuaauuuaguugucaauaucucuuugaucacaguagauaaauucugaauugugaagggaaaugaauacccuucauagauagagccaauuugugugccaguuggugcucauaauuggccugauguuauuuaaaaaaaaaaaaaaaauugaaaguaaguuauugcuuauggcuucagccaugaagacuuagccaucagcuaaugguguguauuugaagacauugauuauucuggcucucuguucuaugcaggacuuugaccaaaacuuaaauguuagaauuuauagcuuuggguugguauguacgcauagaucauuuaaaauaaaugaaugucuuuucuucaaaggucgaguaaacauuguugaucuacaacagguagguuuuaaauuuauaaaauuuuugcuuuacuuucucaauuuuuugauacugugaauuuguucaaguauucacuaaugcugguaucauauuuuguguaguguuuauaaagaaauaguuauauaagccucgcugauacacugaauugauuuaacaaguucugauacauuaaaaugauuuaauaaauucggauuuauugaaaugauuuaauaaguuggccuuauuaaagaguuggccaacucuucccuaguuggcuuucuuauucuuaacuuuuuaccaaaugaacucauaguuauuuuauguaaguauagaguuuaugucauuuugggagaaaagucaccaguuucauguuuauauguuuuuaguauaugaaaguaauagagaaacauuuuuaaaaguagaagcuauuuucaaaauauacaaauauauaugucauuaccaagguacacuauaaacaagaagccagcgaauuuucuguaaaaugcuaucuguuauaugaauauguaauuuacugcuuuauauaaacuuacuagcaagugacaguuuaauucuucagaacugaaaauaacuaagcaauacaccucuaauuuuuuauuuggccaaugcuuuucguauuauuucagauugauucaaaauuuaagaauaagcaauuucuuucuuucuuuuuuuuuuuuugagaugggagucucccuauguugcccaggcuggucucaaacucuugaacugaagggauccucccgccucauccucccaaagugcuggaauccaggcaugagccaccaugccuggccggcaauuucuuuaaaaauauaguucuaaguauauaauuucaagcuuaagaaacaauacaaacuaaucauuaauagauuuuguauuuguuuuccagguaauuaauguggaccugauucauauugaaaauagaauuggugacauuauuaaaucagaaaagcauguucaguuaguguugggacaacugauagaugaguaaguacaauaaaguacaaauuuaagagcacuuuguuuauuuucuuucuuuuuuuuauaguguuuaaauuuaggccaauuauggccaguuagacauuucauuuauaacucuuacaguguugauuuucaugauaagguuuauuucacuuaaaaaguaaguguuuaagccacauaugguggcauguaccuguaaucccagcuacucagaaggcugaggcuggaggauugcuugaccaggaauuugagaccagccuacguaacauagcaaagauccugucucaaauuaaaaaaaaaaaaaaaaaaauucaguguuaauguauggaauacuuagaaauaauauaaacuucuauuuuuuucuuaauaagaaaacguaaaacguaacuuuuacguuccuucccguauaaucuuaacucugaaagcaaauuuguuccaaaaauguuaaugaaaaucaaauacaaauuuccacuuaaaaaaaucccagcaugccagccugggcaacauggcaaaacccauuucacuaauuaaguuugcuaauuaaaaaauuagccaaaugugguggcucgcaccuguagucccagcuacucaggaggcugagguaggaggauugcuugaucccaggaggucaaggccacagugagccauaaucaugccauugcacuccagccugggugacagagugagaccuugaugcaaaaaaaaaaaagaaaaagaaaaagaaaauguauuguuugauuaaucuuacauuuagcuacacuaaugagaaaaaaguauuuguuagaauaugagugaugagugguguucauguacacacacauuucauuacuuuuggggcauacuucauuucaacggaaauuaaacauaaaaugaggaaacagaaaaaacauuccuaauucuuuuuucuauuauuuucuuguuuucacuauuaggaauuauuuggaucgguuggcagaagaggucaaugauaaauugcaagaaaguggucaggucaccauaucagaacuguguaaaacuuaugaucuuccugggaacuuucugacacagguauuuuuuuuccuaauaauacaaugugucuuuuuaccaaaggauuuuaaacgaagacuuugaauggaagggggaaaaaaaaaugagacuuccucaccaucauuugauuuauugcaggugucugacuugauauauguuguaccaauauauuugggggguacuucuaguacauuaaugguucugaggaggcaguuuaaaaaugauuguaaucauccuaaaccaagagacacccuaaaacuaauuuauagacuaaguucuagggcugcuuugaugcaauuagcaaauguacaauaaaugcauggauuuauuuaaugcuuuugauaccagcuauauagaaacuguaaccagacaauuaaauuucugauugcccaguuaaauuuuaagaaauaauugaugaagauaauuuauaggggguacuacuggcuucuugugaguaaaggucaaggaugcugcuaaacauccuacaauguacagaacauccugccaacaaagaauuuuuuuguuccaacugucaguaaugccaacaucuuuugacuucaccauuuauccucuucuaaacagucaguaugauaggaagaagaaccaaggaaucugacauucucuuaacuuuagguauuugugucaguacucaaauaucuuaugugugauaacaaugcugccugaaaacauaggcuauuuucuuguuuacuuuuuucuguuuuuuuuuguuuguuuuuuuagaaucauagaaauucauuugguagaguggaaaggacauaagcuuuugagauuuuuaaaagaccuugauuugaauacugucugcaccacuuauuugacaucaggaaaaucauuucaucucuuuuaugcuucacauuauguaucuguaaaacaggaaauauugucuuuuuuauaggcuucauugaaaucuagugaaauaucuuaacacaauggagaaacuaaauaaugcuaguucuuuuuauauuuacugaaacaagggagaagccaaaucucucuuuagguaucuaucacuuuaagaaacuccaacuugcaaaauuggccaaaccguaauugcaugagauuaauguauaauacaagcagauuuacuuacucauauuaagaaaaugagcuucccuaauuccauuuaaaauaccauuuauaguauagaucuguuuuauguaguauuucaggagcugaaauuauauuuuacaugggcaaacauauguuaaucacaggacaaaaaauauauuuuuaaaauacuucuuuaaaguauccagcucaaauccaaaugauuucuuauaaaacuguuucugaauacauuuuagaaacguaguuuuuaauauguuucaguuccauucugaauauagcaguauucuaaaagcucauuaaguuugaaaaaaacauuuuucuauaucauaaaaauaaugagcugagcugacuugaguagauuuaacuuaucuuaaaaugugaaauauguccagacuuauuucagauguaccugaugccagucguaguauagcuguggagaaauacucugcugaacuugaaagaagguuaccaagaagucagauuaucugccauagaucuucuggacggggauaaauuugcauuagagaggaaagcuuuugaggucuuauguuucccuauguugcagaaucuggaauaacauuuauacuuuuaguauuagaagcuccagaaagggucuucuccaauacccauuuguaugucuuggcucucuauauauuggaggcugccuauaucuagaaaccaucauaucaaauaaucaucauauugauagucauuuuuauguuagaaauagcccucauuaacaagagauaauaugacagcucaaccuuuuaacauguaagcaagcaauuugacucauuucuuggcucugccaugagauagugaacuuugcuagacacugaaucuucacuuuaguugauauaucuuguaaucuaugcuuguugaaacuucucaaucacaugacugauaccucagcaugcagcaugacuugaguaugacuaugcaaaugcauauguguaauucuuuucuuuuaaauuaauaaaaauguacaucuuuacccacaggcacuaacucagcgacuugguagaauuaucaguggacauauugaucuugauaauagaggaguaauuuuuacggaagcuuuuguagcucgacauaaagcacguauccguggacuauucagugcuauuacccgguaaguauauuuuaaaguauauauauuugcacauuucuuugaucaugguuugcauuuuuuuccuagcagcggaaucuuuuucuuuguuuuaauaaagucucauuuaggaccccaguuuauuaaacagauaaaagggcagcuuuuguaaaauagaaauugagauuccagaguucuagaaugcagccucucucuccaguccgcaucuccuuccucucccuaccuucaccacccuugugaccccauacacacuuuugcagagugcaguuuaaauacugcugcccagaucaguauauaagugucacccuugaaucauggaaagaacaugcaauuuaaagucagaagaauuugguucauagcuuuaucacauaauaggcacaugaccuugagcagauaagucagucaccuaacuucuuugggcaucauauggggcuagagaauuuuaugacauuuuuuacuuucuagcauucuguaauuguaaugaauaacaauguuacuugcaaagucacugacuuuucuaaaauaagaauuucugaaauauuugggucugugugacagacuccagcauagaauucagaaaaccuauauucucaauuuucuccucucuccugugucaucaacuucaucucaguggcuauaugcccuaucagcauuuaaauauguccaaaagucucccauuuuaaaacaaaccucucugaaccccuuuauucuauaucaucuaucaugcuguuuguucccucucuuaaagugaaccuucucaacaguugaaaucuacauucagugucucaguuaccuucugucacuucuuaauccaccuaucuagcuucuacuacauauauagcacugaugucucauuaucuguaagucuaauggauacuuuccguuuauuugacuugacuuugcagcagcauuuaacuccaguuacaacuuccuucuugaaauacucuuuuuuuaaacauaacacuuuagauuucuucuucucucuuuuggcugcaucuucuaaguuaccuuuucuagcucuuucuuucacuauccuuuaaaguuucacgccaucuuuucuucccaguucugugcugucaucuuaggugauuucacauggcagccacagugauuucccuuuuugucauucaacaaaucaacaagcauuuguugagcaccuaaugcauguaaggcacugggguacaaaagggagaagguuagaaggagagcauguauucuaaugaaaugauuuccucccucccucccucagugcaagagaacuuuuuuuuucugaacaauuugagaggagguugcugacaugaugcucuaucaccacagauacuuuaaucuguauuuccuauagaaaggggcaucauccuauauaacuauaauacagucaucaaaaacagaaaauuaacauugauugauuacuaccauccaguccuuagauccccuuuauguucuacugguuauuguaauaauguccuuuauagaaaaaggauccaauucaggaucacagauugcauuuaauugauaagaguccuuagucaccuucaaucuggaauacuuacuugauuuuuccuugacauucaugaccuugacacuuuugaagaucacaggcugauuauuuuauagaauguucauuguugguugucugcuguuuuuucauguuauaccuauuuguguuaugcauguuaugcauaauuuuucauauucagguuaugugucuuuugauaggaauaucucagaaauaacacuauauucuuguuauugaaucauaucagguggcauacaauuuagauuuuuccuaauagagauaccagcuaggcuuguaaagcuacuuguuuuccuuuguaacuaauaaguauuugucgggagggcaauuugggaccauggauguuauccuguucuucaucagacuugcaguuuauucauucauuuaaaucacuauggacucaugauucccuaauuuauuuauuggauuauaaucugcugucauuauuuacauguucauacuggcccugauuuagcuagugguagcgccugcagguugccuuuugcauacccccaucauucuugaaacuuucuuuucuuucuggcuuaagauguuccaggcucaguucauacuuucccugucccaagccucaaaucagcccuuucuccagagaucccugcuuucuuuuagcagaguaugggauuuagaaaccaagaucuggauacuacauuacuuaucacuauucgguucucacugcucccaggcccucucaaaguagacaagcuagcacaagggcccucaauccccaggcugccaaucaguaccagucuguggccuguuaggaaccaggcugugcagcaggugagggugggcaagccagcauuacugccugagcugcuccuccugucagaucaguggcggcauuagauucucauaggagcgugaacccuauugugaacugcacaugcaagggauguugguugcacgcucuuuaugagaaccuaaugccugaugaucugagauggaacaguuucauccugaaaccaucccccacaacccggguccgugcaaaauuugucuuccaugaaaccaguuccuggugcuaaaaaggauggggaccguugaacuaggagauacauauacacauguacauacaccccucuauacaucuguauuucuguaucuuuauguguauugaaaacugugaguuugugcugauacuuccauuucuaguccaauaccguaaguuucauuucauucuaguuuccuucuuuuccauguuuguagcuuuguucacugacuaagaaaaaucuaacuccuauuauccuuaauguauuuaguuacuugauuaauuccccuuaugugacugguuucccauugcuacugcagcucccuuucucauguggguguucucuuuauuccauguaggcucugacagucugugccacaucacccuccuaacacaagaaaugggugguuguuucuggggaaagaaacuggguagcugggugguaggaauggagagggauucuucaguuuuguaacuuuuuuguacccuguucauuuauuacuuugucaaaaacuaaaaacuaaaaauaucuuuguuccuauuuauaaauauuuaccuuuuuucuuugacuaauuauuguggugaugguaauuuucaucaaaaucagcuguguuuuucucauucauaguaguccugaguuucgcuauauggagguaccaucaaauaaugagaggaaaauaaguuuugagccucaaaagauguugcuagguuguguggcuuccagauaguaccauuuaaggcaccauaucuuuguauuugucucuuaaaaauaacgaaccaucccacuuuucuagucuaacuucaaaggagacaccugcaucucugacuuuuaaaaaguuuauauuuuuuguuuuuauggauauuucuuguuaucauggauagccagagagaagagcaggaagcaguuagugagaagaaugauguauguagguauacuaaauacguuguauuccaaauugacguaaaaauucagcuaaaguuucaucauacaaaaaaagcuagaaauuuugcacaacucaauucauuguuuauugaacacccacaauaagcuagguaccuagacauuuuaagaugaaguccuucaaggagccuucuacauuuuuguaaggauguguuugcguagaagggaacaaaagacaaaaaacaugagagguuguaacaauuauaagguaaacaaaggagagcaaaauucacagaggaccuagaccuuguugguuuggagguuugcuaugguuuggaugugguuuguacccaccaaaacuuauguugcaguuugaucaccaauguggcaguauugggaaguagggccuaguaaguguuugggucacaggaguggcuuucucaugaauagauuaaugcccucccaccagggugagugaauuauuguucucaugggaauggauuaguucucaagagaguauauuguugaaaggauuauggcuucauugguuucuccccuuugcuuccucuuucacuaugugauuuauuuauacaugucuucuccuuuuccacuuaccaccguaaauugaagcagcuugaaacccucaaaaaauguagcugcucaaucuugaacuuuccagucaccagaaucaugagccaaauaaaccuuuuuucuuuguaaauuacccagccuuaagucuucuguuauagcaacacuaaacugacuaaagccccugcugugcuuccacauaauuuagcugaaaauuuugaguaaaacaauuuaauaaaaagcaaauugauccuaagaauuugguaaaaauaauaauuuacucaaaaacacagaaguuuuaaauagucaauuuauuuucauacaacuguuucugcuuucacaaguuugaaguagaaaauauuuacaauauucuaaauaaucaacaauggaggauugaaauguuagaauuacuuaagucguuuuguuauaugcauuaaaaaugaaaagacuaaccuuaacuagagagaacaggcauacuggcuuaaaaggaauagaaaagaaauuguaaucagaauaaaaagucuagauucuuuucuuguauccuuuaaaaaaaaaaacuauaguuauuacaaaugagauacagucauaggaguccaccccaaagaaaugaaaacauucaucgauacaaagucaaaaacauaaauguucauaggagcauuauccacaguagccacaaacuagaaauaguuuaccugucugucagcugaugaguauauaaacaaaaugugguauauucauacuagggaaugaacaucaauaagaaggaaugaacuacugaugcaugcuucaucauggaugaaucucaaaaacacagaaaggagaccacauauuaauuccauuuauguuaauggcuagaaaggcaaauuuauagaggcagaaaacagauaguuaucuagauuuaggaguggcagcaggaauuaacugcagauagcuaucaaguaacuuuuugggugaugaaaacauuauaaacuggauuguagcaaugguugcacaacucuauaaauguauuaagaucauugaauuguacacuuaaacgaugggguagauuucauguaauuuaaauuauaccuuauugcaauaaaacugguuaacaaaagaaaugcauagucauugcagaaaauagaaaauacucaaaagcaaaaaaaaaaaaaaaaaagauuuuaaauggaucccucucagucacccuaaucuagccucaugucauuccaaacauuuucagugcacauaugaucucauuuuucuucaaaaauggaaucauaugacauccacuugaauauucccaaguaaggaaagagccucccagacagaaaaaacauugaagaaaaaccuaaagaccaaggcaaauaguuacguaucauggaaaucugagaauuuaguggaauggcaauguaaacugauccuugauugcaaguacaaauugauuucccugauauuucaguagcaaaauuccaauuaaggauuuaaaauuugguguaauuuuugacuuuauuuuuucuuuuaaacaguauuuuucuuaaauucuaauuauccuauuuuuaaguucauuaaucuauaacacuauaaugaguaagaaguuuuuuuuuuuuuaacuuuccauaaaggccuacagcugugaauucuuugauuucaaaauauggauuucaggagcagcuucuuuacugugaguuugguuuaaauuauauuuacuuaauuagcugcugaauagacuauuaauguaaaacuuacuaacuuuaauguuuuuuccucuuuuauuguuaauguaacuaaaauauuuccugguuuaaaaaaguuucuuuguaucaaguuuuauauauguaccuaucuguuacacucaccaaacguuuaauauugguuagcccuagaggaguauaaugaaaaaaaaaguaagcauuuauaaugaaaauauaugucucacacacucuauuauacauguacauauagagauuuaaaauuguaagauuaagaauaguuuuuacuuuguuucuuaugauuuuguuacauuaucuaauaugaaaguaaauuguguuucacuaacaauuuuuaccaagagcugauagcaauaaaaguauauucuuaucauucaaacaacauauuaacucgaaaauaaucuuuguucauuauguuguuugugaagcucuugggagguuuugaggguuuuuuuuaaugcuuugcugaaaauuuuuaaaagcaaugauuuugucuuucaacucagauuaucugugcaaauguaagaacuaaaaugaaaaauggaaaagaaauaucaaguauugaaccaaaaauuaauuuucacuguauuuucagaauaugaacuuuaaaauuuuuguuugacugauuuaaaauuaaccugacuuuguuggaaucuauauaauuaggaguugguauaauuucauuauaauguaaaguucuucaaauaauaauugguaacuucacaacuuuguucagaauuuagaauggauuuacauuguacagucauacuaaauugaggaucguguguuguagucuguugagaaauccggacuuuuuugauguauucuaauuuacucagcauugcaauuuuaaaauucaugcacaaacuaauuuuuauuuccauuacagacuaauuuucauuagccuuucuuuuugccaaucaucuuuugaaugugcuugcugauucacuuagaaauagcucccuuccaucugcuuuuuccuuuuuagaggauuuuaauuucuaaaacaaaauguuuaguuaaauguuaugguuuaaauaaaaauauaaauuugcuauuaauggcagcaccuuccgcuucguggugguggugaugguagugauauuuaguuaguauuuauuauugagucuuuauuauaugccagcuacuguugcaagcaauuuacuugaauacaacaauucuaugagaugauauuguuauuauccccauuucacagauacggaaauggagaaauaaggaaaaugacuugucuaguguuucauagcuaguagguggcagaguugagguuuagacuuagucugacuccaacauugauccucuuaaccaaggcauuacacuucucuuauagguagggcugaaaugucuuacuucaacguaaacagcggaaauggaauaacucuuuaaacugcuuauaguuguauuucacacuacugauucuauuauagucuaggugucuugauuuuuuuaaauauuaaaaaacggaacuuguuaacacuaauaauugcauauuaccuguucuugaaguguuuuaucaucuguuuuuaguaaauuaugagauagauaauggcaugcuguguuuucaccaaaauuacucaaacuaaaaauuucaguguuaacauuaacuagcuugaguuacaaguucaacaccuuuagcuaguugccaaaaugcaaaacuucccugaauuuauguuuugaauauucucauaaauggcaggaaaauuuugucuaaaauauacuaccuuuauuuaugcuauuucaacuucagauugguuuuuuaaagguuaagaauaaguaaauuaugaaauaauaaaguauuuuacuuuuuaagauuuauaccuggucugauuuauuuguauucauguggguuuguuuuaagcugugcuugaggaacuuguuaauagcggacgcuuacgaggcacugugguuggugggagacaggauaaagcuguguuugucccugacaucuacuccaggacacagaguacuuggguggauuccuuuuucaggcagaauggcuaucuagguaacuuucuuauuucuuuaaaacuaaaauuuauuuuuaacacuaaacucauucuuuaaaaguauuauacuaacccuagaguccuccuuugaucuguggguuauauuaaaaauaauaauaaauaaaaauuuaaaaaugggaacccuagaguuuacauauacuguccucucugaucagaagauuauaaugguucccuuugaguauaaaaguaaucacacugcgaguuucugugggucuuggaacugaguuuaguucuauaguuacugaacaauuauaauguaaaaagacuaaaagcugguaguaaucgcugccaaucuuucaguuacauuuauuaagauggcacuauaaacuuaaaaguauuuuuuaauuauaaaaguaauuauuauaucuuacauuuugcuaaguugcccaguuuuucagauauaucaucuuagaaauauuuuguugacuaucagauuuacaauguguguuuuuauuaguuaacuaauacuuuggaaacauugaaguuauucuaaauucugugucugaaauucuacugucauuuggauaaauuggacugaauuuaguuauuaaaacaauuagcauauauauauauaagauauauauacacacauauauauagcuuacuuaguuugaucaguuuuauaauccaagucaaacugcauaacagauuacuuccucaguaauaaaccuguaaguccuuaguauauaaauaauuuaaacguaugguagaauacuggguuuuuuccuuacguuuucuugacuuccugaguuguacuuuucaguuucuucaauuauaaucauggauuagaacuuuguuauaacuaguuuucuuaagcaugauuauuugggguggaguuagaggaguuaagaagguagacaucucuaauaacuuuauuggcuauaacuuuuaagucuuuauuuuucacuuuugucuuacauguaauugacaauucuaauccaacuuugugauauauuuguagaauuugaugcuuuguccagacuuggaaucccagaugcuguaagcuacauaaagaaaagauauaagacuacacaacucuuguuuuugaaagcagcuuguguuggucaaggacuuguggaucaaguggaagcaucaguagaagaagccaucagcucuggaacauggguugauauugcaguauguuuuaucuuuuccucacuuuucuuuaaacagugacaacugauauuuuacuaauauuugaccauuuagaaauuaggauacauaaagguggucuuggcuuuggaggcaaauucuaaucauuguuauaacaaaaauaaucuuuaugcuuaaagucuuucgggugaccuucuacauguggacagucaacauccagaauucuauaaaucucaaaacaaacaagcaaacaauauaacacuccuguuaauccugauaaagaauugaugagacuucucacaucuuuuccacgcauucacagccguacuggcaucaggcauuguguagcauuuguuuauuccuuauccauuaaucucugcuaauguauuaacacaagcugccuuggcacggauaguguuuacuucaguguucaauguugaucugcccuucaguaugccaaaaagauaaguguagauaaagauaaauaaacgaggccaauccauuauuuucuagucgggcccagacccucuuuauaaagcagaaauucucuguuuuggauaugaaagucccaaagauuccagauuuaacuguuuuuuuauucaucuaacaaaacuaccuucugugugccaggcaccguucuauuaauacuuguuggggauaugguagccagacaagcuugcugucuuuaggagggacacuuucauuagggaaagauaguuaaggaaaacaguaagauaauuucagauaggagaaagaguuaugacaaaauacauuuugaagguuaucaggacauccugguggacuguuugugacuuugugagaaaaacgaacuaugugugccuuguagguuucaguguuguuuuaaacaauuggagaugucuguuaggcaugcaaguggggaagguaggcaauagaauauaugauuucagagcucagaguggugaugaaaccagaaauauaauuuggagguuaucggcauaaauaugguuccaaaagccacuggacuuaaugagaucaucuagagagagcauauauguauauagcaaaugguuucacuguauuauauugcauuuauacuuuauuuuuauuuuguuuguaauucuagccucugcuacccacuucuuuaucaguugaagaugcugccauauugcuucagcaggugaugagggcauucagcaaacaggccucaacuguagucuuuagcgacacuguuguagucagugaaaaauuuauaaaugacuguacagaacuguuccgugagcugaugcaccagaaagcugaaaagguauuccagauuuccuuuuaucugcuaaucuuaauaauauuuucaauuuagaaucaucugaugucuuuugaaaaaggggauaagugaaagugaacacuuuguaucauuuauuauuuuccuuuaauguaucauucguuuuuauuuugucucccagauuuauuuuuucucuuauucccaucaaaacaucugacuuaaaaguuggggaacugacuuuauaaauuaaaauaacguaaaggaaauuacacuuuucaguuaaguuuccugagguugguccaacuuuaaaaccucaaaaugcacaaaaaacaguaucuguagauauguacaaauauacaguguauuugucaaccaauacacaauauauuuacucaaucuagcagagccucaauaauuuuuccuauuuggcauacacagacaggguaaauuacugaagaaagaaauuuuguuacuauuuauuaguuccucagagcaacugcuaugaaaguauuuugaaauagagguccugccaggucuguguuaaugacucuguaguucauguuucuaguuggcagcaucaucuccuuauaaagccugcucucaaauagguaaaauaggcccauuuauuuuaaacuguuaauaaauucaugagggcuuauuaaauauguaaauaguuuauacuuagcuguucuccuucuaagcucuuuaauagucuaaaaaugagauaaacuucuguauuuagccugauaagcagcagagaagauuacaaaguauacauguuugaugucagcaacccugaauuuaaaacguguauuaucuguaugacuuuggacaaauagaccucuaguuuccucaucuuuaaagaaaggaucaugauaccuacuauggaaagaauaaauauaaauaagggauauauguaaaauguuuguuccauguuaacuagcaguuaguaaaugacucuuacuuuuauuugggauuuuuuacucaaguaaaaauuuaacaugguuaucacuuuucuucuuuccuugggcuucucccucuaaccacaaaaauaaauuuggaaaaaggugauucugucaugugaacugucaauauuuuaagcauuuuucuuuagaaaaacaaaaaggaaauaauauuacuuuuaucauaaauauauacuuuugucacuagagauuauaggaccuuaugccaucagaaagaaccaguauccgaacuuggaaauacuucaucguuguuaucauaaacuuuuucaaagcagaaauuaucaagaaugaauccagaggggggaaaaaaagauuauaugacuuaguaugcaacucacauaugguaauuugugugggguaggggauggaggguucauuaucuuuaauaaucucaaauauccagguggcauuggaauugggagucucaaaaagcgaaggagcauggggcaucaauuaagcugugguaaaaccagccaguaacagcuggagaggauugcaucugauugcagcuguguaaucaguugugaagugacaagauaggauuucucauuaguuaauaauggguacaaaaaaggucaagagcagcaagagaagagaccuauuuugggcaaggagaaacauuugccuuagagugacagcucugaaacaaagcucuauaguucuaagcaacaaaaccaaacaagaauaauuagugaguauauaaacaacuuuuaugcuuuuggaaaugcuauguguuuuuccuaccaaaaaaagcauguuuuauuuuaggaaaugaaaaauaauccugugcauuuaaucacugaagaagaucugaaacaaaucuccacuuuagaaagcguuaguacaaguaaaaaggauaaaaaagaugagcgaagaaggaaagcaacagguaauaaauuguuaacaaggaauauucaaaguuuuguauuuguugcagugaacuuugcauuuaucacauuuauuaugcccuuugaaaggcccuuuguuuuauugauuuaccuuuaaacagcuaauaucaaccaaauauuuugcuaauguguuaaguuuuauauaauaaaauggaaauauuggugauuauguuuucuguuuucuuuugugaaaacuuuauuuuaucaucaugcucaucucuuguuuuuccccauccucugucuauguuccagcccaguagcccuuuuuuguuuuguuuuguuuuguuuugauuccuaaacuugccagggucauauucaccucaaagcuuuuacaccaacuguuccuuuuaccuggaaugcccucucccagacuguaaguaacugguguauucuuuucauucagagcucgacuuuaaaugccacuuccuuagagaggccuccuaacccuucggaauaguagccacagucacucucugccaccucauuuugucaguuuauuugcaucacuuuaucaccaugauguguuuuauuguuugggaacuguguugaucucauuuauuguuguacucuugcuacauacccaaagcaccacuugauauauuuuagguguccuauaaacauacuaauuaaaugaaaaaauuucugaaggacauauuuuuacauuucuuuuucuaaucuaaagucacuagaaauuauucuagguaucacugauaugcuuguaauuugcaauggaaaaguaacauguauuuccauaguuuuuauaguaggaacagugcuguuagugcuuuaucggaacugaagaaauucaauauucaacauuuuucauuaauaaauacacuucuaauucuuugagauaguuuauuuccucuuccagaaucuuuuucuuaaaacuuuucaauggcauuaugaaauuucucuauucuuccaggaaaauuaauaaauuacuuaaaucacaguaauauucauagcuauggauauuuuaucauauauuugaagauauaguuauaaauuugccuuacucaauugaugacuuaugucaguauaacuagucuauuuaauauuuuauuucuuauuaaaaguuaagggucauuugguguuuuauuuucagugauaaugcuauuguauuauaauuguuuaauuacaguguguggaaucaugucaaucaugaauguucccccccauaggaaacuuauugucaaauauaaaaagcauguucacuuuagacuuauauuuuugaaaauagaauuuuuuuauuauaaaagaaagggaaaaauaauagaaguuuaaaucuaggaugugaugaaaucuaaggcaaaucuauuuagaauuuagaaaaagaucuuuaguaaucacuuuauuuuauuaaaaagacuaaucuuuuacuuauuuugaaguaauauaauauaguuguaauauguucaaugguuuaaacccguuaucaguauuccauuuuguagaguagauauuuuacaugucaauaucaaagagcagggaaaugcugaaguaguauuuuuuauuuuuauuuacaguguuugcauuuguuucauaauuuguuuuuuuaagucuauagucaauagguaauaauacuuuuauacuuaaccaauuaauauucauggucaacauuuaugaagcacguguuauguuucacgcauuucuguaaagaauauauacauuaaugacacaaugauccuugcucuucagaaguuuauaaucuguuugaguagcagaugagucaggauaucuccucuaaaaacagguaauaaucuuucaacaaagaaggcaaaauaagaauaauuaaauuugugaagucuuauaauagaagguuauugaugaggcugugguaacacagaugagcaaaggaggacacauuucuuuuggggaagguagaagaggaggugaaggaauggauuuuuguuaagaaaauauugagaguuacaggaaagaggugacguuagagaaggagaaagagaaugcauuuagagcagucaggcuaucuaagguagauugcucaaaagauuucauauuuuauuauuaauuuuuuauguauuggauuuacuaaacuuuuaauagggaacuccaaauuuaaaaagagucuaaaaguuucuuuauuuugccuuuauuuuuucugcuguaaaguuaaauacaacaauauagugucauuauuuuauaaaaaugaugauuuaguuagguaaugcuaacuaaugucauuuucccaccagagggcaguggaagcaugagaggaggaggugggggcaaugccagagaguacaaaauuaaaaaagucaagaagaaaggaagaaaagaugaugauagugaugaugaaucucaaucaucccacacugguagguagcuuuucuuuacuuuuccuugguguaugugugauauuuguaacauauuuucuuaagauguauauaauuagguauauaugcuaauacaggaaguccuuauuuugcaguguuucagugacacaaauuucaguuaccacacuuuaguuaaauguuaucaguccaguaacaacacuguuuaucuuaaauauuagauacaaagauacuucgguauauuaacugaguauaguauaaaguagcucuucaguccacaaaucaguacauaaauaacagaugcauaucaugaucugugacaaucacaccacuuauuguauaguuugucaaugauuggucacugcacauugguuauuccuuaugcacaaacaacaaagcauguagcuguauugccuaauugucucccagugauaaacgcuaugauauuuuacagaaauggauaaucaaaaagagaauuggccaacaaagauaaaagcguagcaaagaaaugaaaagugauaacacugaaaauaaaauuggaaucaagcauaaauggaguuauagagggaauggcugacugugggaauguugacacugccauugcucaagaaaaugaggaaagugguuaugacaaaaaggaugaaaacaucuuagaggauguaaaguggggaaaaacuucacaauucuuggagauauuccaagacauugaaaaggcaagggauaaaacauuggaagcugauucagaguuagaaagugguaugacaauuuauaaggcauaggaaagguacuugguccauacugcaaguuaauugauaauaagaagaaagcaagcacuguucagacuauuccugauaaguauuuuacacagaaauaaaacacuuucauucuccauguucuaauguguuaaaaauacagcauauuaaauuauaaacauuaguuuuauuuuucauuuuccuauacauuuauaaccaacaguaaaagcuuuuaauguuuaccaaaaauuuuuaaaggccacagaacaauuguaauuuuuccuauugauuauuaagaaagcuuugcaugguuucaccuuaccaugaucauuuuuauggucuuccacugccaugcaaaacaaguauuaggauauuuuugaaaaguagacuugcaaauuuaaauaggaaacauuaauuuuauguacauuuuacuuucauaguaacaccuaacugguugguugcuuauaucuaagagagagcauuaauuauaugcaucuuucuuuuccuagacuugcuagugcuuggccaagaaagucuacaagagacaucuuuuguuuuucuaauuaaaauuaugauauuuuuaauuuuucuguuuaaaaaagguaaacuuaaugaaaccaugauacugcccucuuccuuauccccagcaaaaugaaaauuaaaaaaaaaaacuuuaaaugauaauagauugagauuuauauuuuuccucuuucacagaauucauuacauacgggcuauagcuggaagauguagauaucaagugaugugccugcagcuauuaauguucuacuugcuauuuguaauagcacaguuguuuaagauuugucuuuaaaguauucugagauagguagaaauaacuacuguucuucauguauguaaaacaacguuaauuaaaggaaaaguaucuuuauaggaacuacuagcuuuauccuuauuucaaauaggauuaagacuauccauugugaauuuuaauuuuucacugguaaauggauuuuccuguugcccagguguacuaggcaugugggugaagaggcauuacaagaaaacacuucucuaauaucuguaaucuuaaauaaugguuaaaugaggcaugugauauuccuuuugugaauagauuauuauugaaaggagcuauaaaaguaguaaaaccauucuaccuuuaaaaauauaauuucaaugcuuuugaaaaaaaauuuauguuguaaucucugaaauagaggaugaaauuggguucucagcuaaaauauaggaucaacucaguaugaaagauuacuagaagaaaauauaauuuaauaacuuugaaaaugcauaaaggaaguaaacagggaaaucauagaucauuuaaugugaacauuaggaauggacagcagaucccagaagauaauaguacugucugucuacucuaaagcuagcaugucaacuccuuagauuuuuauuuauagugaaaauugauuuuugagccauuuuauuuuuauuuguaaaguuuuugcuuauagaaucaauaacuuaauuaagcuagaaauaaucacuuuuauaccuuuacaauuucuaauggaaauauuguuagcuuuuuuugucuacaacccaugcuuuccuaaguaaauggguaggcaugacauuugcacaguuagcuauuauuuucauuacaguagcugcauacaaacuuuccugacuauagacuuauuuuugugagagcaaaaauaaauuauagaauucugagauuuuuuuuuaaucuaugccuuuuccaaaagauacauuuuagcuuaaacaauuauuugaauugugauucacaugauuauaaagacuuuccaaagaucuuauuuagauuauaaggauuauuuaauuucuaauaaauuuauauuuuuauaaaggaggaaaaacugcccgguauuccuuguucaacaaagauaaauuauucuuuccuuaaaaauuuguuuugaaauacuuguuuugauuuccagcuauuuguaucauccagguuuaacaaaggggaaaacucuuuauuauuuucugauugacuuauagaaaauaaucaguuuuaaaugaaguuagaaaaugaucacauaagaaauuuuaccacuucaugauaaaaaucuucagaaaacuaggcaucaaaggaacauaccucaaaauaauaagagcuacuuaacgacaaacccacaacagcaucauacugaguggagaaaaauugauagagccauuaagaacuggaacaaggcaaaggaugucuacucucaccacuccuauucaacguaguacuagaaauccuagccagagcagucaggcaaaagaaagaaauaaaagcauccauauuggaaaagaggaagucagauuaucucuguucucugaugacacgaucauauaccuagaaagccauaaagacuccuccaaagacuccuggucuugauaaaugacuucaguaaaauaucaggauacaaaaugaguauacaaaaauuaguagcauuucuauacaucagugucuuucaagcugagaaccaaaucaagaacucagucuuauuuuuaauagcuacaaaaaaaaaaaaaacuaggaauacauuuuaccaaagaaauagaagaucucuacaaagguaacuacaaaacacugaugaaagaaaucguagaugacacaaacaaauagaaagacaccccaggcucauggauuagaagaaucaauauuguuaaaaugaccauacuccccagagcagucuacagauucagugcaaucuuuaucaaaaacaaacaucauuuuucacagaauuagaaaaauacacuccuaaaguugauauggaaccaaaagagagccugaauagccaaaguauccuaagcaaaaagaacaaauauggaggcaucauauugucugacuucaaauuauacuacaaggcuauaguaaccaaaacaacaugguacugcuagaaaaauggacacauagaucauuggaacagaauacacaacccagaaauaaagccacauaucuacaaccaacugaucuuggacagggucgacaaaaauaaacaauggggaaaggacacccuauucaauaaaugguucugggaagaacgaaacuguauccuaucucgucauacacaaaaaucaacuuuagguggaguaaauauuuagaauguaagacaugaaacuguaaaaauccuagaagaaaaccuaggaaaaaaucuucuggacauuggccuaggcaaagaauuuaugauaaaaaucccaaaagcaaaugcaccaaaaccaaaaauugacacauaggacuuaauuaaacuaaaaaguuucugcacagcaaaauaaauaauuacaacagaguaaauagccuucagaaugggagaaaauauaugcgaauuaugcuucugacaaaggacuaauaucuagagucuacgaagaacucaacaagaagaagccccauugaaaacugagcaaaggauaugaacagauacuucucaaaagaagaaauacaagcagccaacgaacacaugaauaaauguucaacaucacuaaucagagaaaugcaaacuaaaaccacaauauaucaucauacaccagucagaauggcuauuacuaaaaagucaaaaaacaacagauguuaguguugauguggggaaaagggaaugguuauacacaguuggagagaauguaaauuaguucaaccucuauggaaaacaguauggagauuucucaaagaacuaaaauuagaacuacuauuugacccagcaaucccacugcuggguuucuacccaaaggaaaugaaauuauuauauugaaaagacacauauacucuuauguucuuugaggcauuauucacgauagcaaagucauagaaccagccuaaguguccaccaaugauugacuggauuaagaaaaugugguguauaccauggaauacaauguagccauuaaaaacaauaaaaugauguccuuugcagcaacgugguuggaacuugaggccauuacucuaagugagcuaacucagaaacaaaacaaaauaccacauguucucacuuauaaaugggagcuaaacaaugggcacacauggaaaauaauagaagaacuccgaaagaagggaaguugggggggggcgguaugugggcagggcaaggguuaaaaaaauuaccuaauagguacaauguucacucuuugguuaauggguacaguaguagcccagucccugccaguaugucuuguauucauguaacaagcaugcauacgaagccccugaauauaaaauaaaauauuuuuuaaaaagagguuuuauuauauauccuaauuucaaaauuguuuuuacuaguuguugcuauuugacauuaacaauugaguaaugaaugaauuauugucuuacuaaauauaguaauggagcccuauuugccauuugguugcauguuuuuuauuuauuuauuuauuugccauugcucauguccgauauaggaaagaagaagccagagaucaguuuuauguuccaggaugagauugaagauuuuuuaagaaaacacauacaagaugccccugaggaguuuauuucggaacuugcugaguacuuaauaaagcaaguauaaaauguauuuuuucuguuuuaugguagaaauuaaauggguuauuaaauaagauuuuuuccaagaucauagaaagcaaauguauuagauauuuucauuucaaacuuggaauuuaaccuagccaccaaauuccagauuuuauuugccuacaguggcaguuuaauucaacaaauauuuguuaggugcuuuggguaaagcaguaugggaaauaaaaggcaggagcgagaaaguguccucacucacccaucuuacagucauaggucuugguuggggagaaaaagaccggcauuaaccacuggcuggucucuucuauagcacaaaaaauaacauucaaaaggaagaaaagauaauuuucuauuuuaauuuggcagaaaguaaacaguguuuaaggagaauauagaguaacaaauucacuucaaaaagaauaaauuuaggcacuccuaccuuaugaauggcuaaggguauuuuuauauaaaaaugaagaaaauuauguauaacuugaccauuaguaacuaacuaaccuggucaucccucaaguuaguuucacuguguacgcuuucauaaauacaauccaggagagcaguguaucuaacuuugauuuuagaaauauaacuucuguggugauaauuuuuuuaauauaaauauuuuuugugcauaaauguauuacagaauuauaguuuucacauguaaaaaaaugaaauaguuacuacuaaucauuuugcacugcuuuuuaggcauaaaaagguuuuuuuaaauguauuuuaauauuuuagaaauugagaauuuuaaguuguaauuccugaagaugaagaacagauuuauagucuacuagucuccaaauuaauuuuaaaaagcaauuuugaauuauggggguuuuguuauucuuggugucuuaauugcaguaacuuugaauacuuuaaaauagagaaaauuaaucuauuucugucuuaauuccuaggguuguggaacaaauuguuagugaacuugucuccaaauuaauuuuauuugcauaaaaaaauagagauuucuauucuuaagccuuauuuccauagaaacaaaauuccuuaucuauauaaauacucaguacauuuuaauaaacuaaauauauuugucuuaugcacagaccucuuaauaaaacuuaucucgaggugguacguucaguauucaugucuucaacaacuucugcuucugggacgggcagaaaacgcacaaucaaggacuugcaagaagaaguuucaaaccuguacaauaacauuagguuauuugaaaaagggaugaaguuuuuugcagguauacuuaaucuuuguuaaucuuguuuuuucauugauuuucauaauuuggggaauaaauuaguuuuaauaaagguccuuuauuuuccagaugacacacaggcugcucuuaccaaacacuugcugaagucaguguguacugauaucacuaaccucauuuucaacuucuuagcuucggauuuaaugauggcaguagacgauccugcagccauuacaagugaaguauguuaaugaucucccuaccacuauugauguguucuguuuugcaucuauacacauuuuauuuuaucuuauuuggaguaaagaggaaaauaaaauacagugaaagagguuugaggaaaaaaaucuaaaaguuuuuuauucaacuuuaguacuauauauacaguugcuagcaggauugguaguauaacuagucuguuaaaaguaaugaugcuuaauuacuuuagaauaaacaguuuuuucccuaauuauuaugucacauucccucuuccuaaugacuggcaaaucccauaacauucugacccauuuccauaacuuugaaguuauuuuccuuuaaggacaucucauuucaauauuuagacuaauuccaauuaauuuuuuaaaacucuaaucucaaacuaaauucaaaagcucaucuccucccuucuugcuauguaauguagagaauggcucccaguugccuagaggaagaaaggugccaucuaucccaagaugacaaccccuccuucuccuucucuuucuucucuguccuccucccaccuucucuaccuccucuuccuccuccucuuuccuguucuucuuccuucuuccucaccucucuagguccacuucgaguuggagauuuaggaaaaaugaggcaggaaaaagcgucuugaugugacugacuacaugucacugcuuugaucaaggucaaaccaaaucagucugauguuuguggucuuuggugauguaguuagucauugccucauaggcgauauaaguuguuucccuggaauguuguuuaguuucaugugacuucucacaguaaggaccaucccucaaacagaggaacaguuauuucuuccuccuuccccagcaaggugcuggcccccuucccuucuucugcuuaagaagcaaauccccaguugucuagacaguuucaugucuccugcccuuauaccaaucucugcuauggaaaauacagaauaucuuguuccaugcccuuuaagggccacagaaggauuggugugggauuggggcagagaggcuagacaggagcaacuagcccuuaaucuucccagacauuauacacuucagggccuggugucaagccauacuagcaagucugcuccaaaauuuuaugccagaagaaacuaaaagacucugaucaagaauaccauaaaacuucaguggacacuuacauguagagagaggugcugaaaagauuccucauaccauagagcauaacaagcauccagccaugaacaagagcucagccucccaucuuguaggcauccuugaucuuuaugaguggggcccuucacagcuggcacuggguagagaaaaacacccucuuccuacucuaauggaagaauuagccucuuaacccaaauauucuguuucucacaaggucaacgacucucucuagucuuucucuuacauugauggagcaggugggaggagcagggcuguaucuauccuguuuggcugauuggcuauugacucuaauaauguuuuugucucuaauuugagaucuaaaauucaagaauaugguaaauuccacucaggaacuuguuacaguauuuuuuucacuuuaucuuauauccauugcaugucaaaagcacaguacugaaugaauuuucauuuaccccuacagauaagaaagaaaauuuuaaguaaauuaucagaagaaaccaaaguagcucuuacaaaacuccauaacucucugaaugaaaagguaaguaaaguuuuauucuauuuacaugucagggcuagcaguuuguuacaaagaucuuugaguagauuuuuuuaucagaguaauuguaaauccaaucuaaaacuaguauuuugcacucagcugccucuuugaaaugagaagagaagaccaagcugcuggcauuuuaccauuguuaguucuauaucacaauuucuaacuuaaugagaaagugacccuuuuaaaaauuguauuugggauguaaaauuacaaaacaauuguuaaauggcuauacuuccuuaugcaguuauauauaaaaguaaauuaugguauucaaugccuuuucagagcauagaagacuuuauuucuugucuggauucugcagcagaagcuugugauauuauggugaaaaggggagacaaaaaaagggaaagguaacauuaaauuaaucuauauuuggaaauguucuuaaauguggagccuuucauaucugaaauuugaauuugacugcccggcucuuacacagagaauauguaccuaaugugucuaauauaucuaaauggcuguagaccuucaagaauauucaaagucuuaaaauaguuagauauuucucucugacccucuggaucaaguagcagaguuucuuuauccuauaguucaucaagcccaggaacuuuuuauuagcuuggggacuuuccuuacaggaaaccuuaccuaaucagugcaaauuuguuugaccuccagcaacucaaaacaaaaaacauacuuugaguauucccacucuauagcuuuuucuuuaauuuuguagcacacuaaucuauccaugccauuuagguuuuauguguguauaucccauauugaaaaguuaccuuaaauuuuuauggaauuagauaaacuagagaagcuaaaaauuaacagaaagggaugaauugaaauuggugagaacuucuuaaauuaugauaaugaauuugugugcuuuuuuuuuuuuuuagacagauacuguuccaacaucgacaagcacuggcugaacagcuaaaggucacagaagacccugcucuuauucugcaccucacaucaguccuguuguuucaguuuucaacccacagcaugcuccaugcaccuggaagaugugucccacagaucauugcuuuucuuaauaguaaaauuccagagguauuacauuuucaauacacuugaaacuuucaaagauuuacauucugaauauuuugaguggauugagaugaauuacugucagcacucagguauaaaauacauuaacaucaaagcccauuuccaauaaugugaacaguggauuaggagauuaauuuuuuaaaauuccacauagcucaagaaucuuucaagaauguucugaauuuggaaauuaagcuuucagaaaagauacaauaaugucaaaucucccauuucagcuucuuuagguuuaacuuauccaucaaggacccauucaaaagucuuguccuaucccuuuuagcuaaaaaaccccucagcuaaaagggaacuucccuaucccuuugacuguaucuuuggugauagaaccaggugauaaguugacuuuaccauaagucaacuuaugguaaagugauuugcauucauguuuuaucucuccuaaauuguacacuccuugagagcagaaacugcuagauuagacuugcuacuuacauggccaguuuuuuguaaagaugaggaccuucaauguguauuaguugaagaaauucuacuuuaucuguuccacaaaaagauaaauuguguugauuaacuuuucuuucccuuuucacaggaucagcaugcucuuuugguaaaguaucaagguuugguuguaaagcagcuagucagucaaaguaagaagacugggcagggagauuaucccuugaauaaugaauuagacaaagaacaagaagauguugccaguacuacucguaaagagcuucaagaacuuucuucauccauuaaagaccuuguucucaaaucuaggaaaucaucugugacggaagaguaaugaucuuaauuuacauuugucauauaguaagcauuuucccccaagguugaaggugaguggucacaaaaaaguagucacuauacaacuccccucucccugcaaaaaccaccucauacacacacaauucaguuaaaacaguaguauuguauuaaauguaaaucuuaaaaagaugugaauuuuuguaaauuggguucuucauggaaguuuuuuuccaccugauuuucacacaaauacuauaugaaauuuuucacauuauuuucacauaauuuuaaaaauuacauauuucagguuuguucucuuuccaaauguugaaugaaaaacaaauuuuccaauccauuuaucccuggggaaggauucauuuguugcgagugccaguauacuuaaauguauacuuuauauacauuuaagcagaaauuuaaaauguggucuuuuuuuuuuaaaagaaacacuucugugucagaaaugaaaauaaaucauguuuuuuauuuuuaaauagaaagcacuucaaaacuaaaauacagaaauuuacaaaaaagaaaaauuauuacuaagcccuugcucuuauuuuuggcagaauaaacauugauuuugguuggggcugcaaggaugccuuuacaggugcacaagaacgcuagaguggcccaugcauugcuguguucucuucuaaaacaagcuacuaacaagagagagaacacaugcaauuuauuaccaguaagcauaagucauauuuaacauuggaauaacuaagcauuuuauacaaagauuuuucuuugacccaguuugcauuuguacauuuuauuuuuuuaguucaacagcugcucugucacauaauacuuuguaaauacuagugugaaaaacagauaggaugccuuuuccagugguaggagcaucuguaagugcauuuaaaucauuagaagcuuuuuuccaaaacuagaaacccuuauuaaaaaauagacauuuuuuucuaaagauuauuaguuaaaaauaacuaaaagaguuccuuagaguaaucauuucaaccaaaugaauuucaagcaacaacuuacuuacuauuuaucaaaaagggauuuaauuauuuugaauauaauuauaaauuaaauuucaaauauuuaaaaauacuauuuuauauaauuccuuaugacauuuuaaacuuuauauuuuaaaauauuugaauacgaaaagaucagucuaccucuacuccauucuagacaaaguauuaauccuuagugaaaguaauuaauuaaauugccaacuuggcauuauuauuaaacuugauaggaacgcaacauuaaauuuaaaaauguuuucccguggguaauuuucuauuauauauuuucauaugggcaaagggaaaaaaugauaaauccucuguaaucacaaaccccaauuucguuuuguuuauucagcuucuaaaauauugaacacccagacuuuuaauucaaccuuuaagaaccuuaucauuuauguuucaguagauaucaaaguaauccauguuugugucaaaugaucauagaaaauaaauagaagagacagugaagcaaguaaaaagaaaagcauuguuuuaauuuguuugcauuaauuuuuuucauuugucaaaaugcuucuuuuguugccacaguaaagaacaguuuuuauuguuuuguaaguaaaauuacguagcugauuuuguauguaaagauuaauuuccauaauaaaaauuauuguauguuuacugugaucuuaaugggcaggguuaagaaaguuauuuaaaauaaaguuaccuauucuacuaaauuuuauaguacuuugaagcuucuauuaauuaacacaaagauuaauuggugcauauauuuuauauauauacauuuugaauucucauuuugaacauuauuaaaggauuuuauuuuucuuacacaaaaauaguuccagagcucucagugucuuuc

SEQ ID NO: 13908 - RNA, 625 nt, Homo sapiens
aaaaaacaaacagguugaaaaauggguuaaaguaggcagcuacagcaucugcuuuuagaucaacucaggaauucucucaaucaugaaaucuugcagagaaguuauuuuucuuucucaaaacccaggugaugacaauauuccuuacugcagaucuggcauuuuuucaucaucacugucuugugaaucaucaucugcuccaucuacuucugguaaaucuacauccucaucaccacccauguuauucaucaucucagagaaacgaucaaaauuagacaugucuucaucugaaucaucuucccagucuuuccaauuauugaagucaacacuaagccaauuaagcuuugcccuuucuuuuguuaaccuuggccaugacuguccagauucuccuuuucguaaacaacauaaaauugaucuguccguucuuuuaugcuuggaaucguuuguaucaauacagugaaaaagaucaauuucauuuaaaugcuuaaaauuaucacuuccuccgagacaacugaauguaaguuuggauuuuucaaaauuuacauuaacauccuuacugucuucaacacaaaauucaaugaagacauagugccuuugaucguaccacuuugcagaagcaggcugcauu

SEQ ID NO: 13909 - RNA, 31934 nt, Homo sapiens
cggggaggaggggcugucugggcucggggcgcggcggcagucagcucuauguucgcggucuuaaccucuccucuggccgaguccuugcaagaagugaauuacccgacccuggugaguagcugcaggagucagaccucuuggaggcggcggcgccagcagcggcggcaggcacgagguccaccgcgggcgccugcgcgcucgcccgccagccaaucugguggccgcuuuccuccgggcgcccuuugacccggcgccccucuggcaggcgcugguggcgcccagcggcgagccuguagcccccucgauuaaccuaggcugucacucuuaggccuguuuuagucugcguuaguuuuacugccuuuuacacugcuuuauccccaccucacuggccucgucgccgccuccucuuugaaacgguaccuccugucgccucggauuuuccuugucuccccgacaagguggaaauuucgggucggauggaagccuuuuucagcaccuucuccuugugcccccagacugccucugggccuugagccgaccgggagaguagaaggaucgaggccugcugggcucugggugcaacggaaagguagcugucgccucugggcaucgggaggagaccgcccgauggcgaggccgcuagagaugguuuuucaguucaccuguuaacguguuuggcacugucaucuuagacucuuagccuuugcuaagucgggaugcaacagugcuggauuaguguuuuuguuguuccuuuuuccaaagaagcaacuugaaguacaggcagguauaacuguuugguuuuguuguuguaagacccuacggauaaguguuaggagaaaauguggaagugcuauaaaacaacaacaagggggggauaauguugauuaagaacuugaaaauaagaaaaaugggacuggaauaggcuguucacguuaaaguauugaggcaguaguuugaaacaaaaauauaaaguaaaaccuagauauuggugauacuguaucacguuguuugcaaaucacuuucaugacaauacaucuauuucagguguaucacaccugaaaaaaacaugagugcugugaauuuguggauuuucaggcucaaugcagaaaaacaccccccaaaacaaaaaaucacaacaaugaaaacaccauuuccagagcuguugcuguuauucgugugacgaauagugaauguaugaucauaaaauagaauaagcugucuuuagaugaaguuugggcacaguuuauggaguagguaacaguuaaucauuguuuauuagguacauaauccuuaauugaaaacauaaccauauagcagcagcuuucaucuugugucacaaaaauaacugguguauccucuaaauuugauuugucuaauaccuuaaaggaaggcagaauagcauggacaagaacuugaguucuugagccagacucgaucugcuccuugcuaggugauuaaccuuagauugguuucuuggccauuugcuggcccagagauuuuugaaaaaguuaccaacugcucagcuucaucauuuguaaaaugagguuaaaaaaaauucugcggccuggcgcggugccucacgccuguaaucccagcacuuugggaggccgaaguggguggaucaugaggucaagagaucgagaccauccuggccaaccaacauggugaaacccugucucuacuaaaaauacaaaaauuagcugggcgucguagcgugcgccuguagucccagcuacucuggaggcugaggcaggagaaucgcuugaacccgggagguggagguuguagugagccaagauggcgccacugcacuucagcauggcaacagagugagacuccaucucaaaaacaaaacaaaacaaaacaaaaaacagaaacuaaaccucacugaauuucuguuaaccagaggguacaaguguuuacaauaaaacugaccugggcaaggauugauuuugaaacugauuuugaaaguuccagaugugucuucuaguauugaguuauauuuaucuccgguggcuucauacaaaauaaaauuagaagaaaacaauauauuuuuuaaaaaaagcaccagaagucugugugauuuaauuuaguuaauugaaagggaagucuuuuuggcuuuugugaguuacaugauaaaagcaaauaauuuuugaaguacuaauucauaccacccugcuucugaaucucuuggggucucuuagcuagcuggauauguccaauaauuuuuuauuagacaucacuaagcuucaagucagcauuucaaaggauuaaaagcacaaaacucaaaaaauagaagcuacagguucaaaagaaccuauuguguaugaguaauguaaacagucuuuugaggagaaaacagauuuucaguagccaauacuuugaguaggucccugccuuggaaagauauaucugcaauaaacuuguaauauuuucucuauggugacuuauaauacuuuucuuuuauugaagcuaaauuaguuccuccaccccuuuccugcaagaucagacauuuuaggcaucucaagggucauugugguuuuacagcguugaagaugauuuuuuuuauuaaauuggauuuuuaaaauuauuggaucuuuacgauucuuuauaauauguucaguauacaccguaaacuuaucaaguguguauacggucaguagucuauauauacacacacacacagauauacauauauauauauacacacacacugccugaauaccaaugaaacagcaaagagccagaaauuaacuuuuuuaaagcugaacacuuaaugaacacuaugugaaagauauguuaugcucuacuagaaugugaagauaaagacuccauuucugaaacuuaaggagcaaucuaguaggugauauaaagauaaaugcacagcaugauauaauacauaaggaaugacaauuuggccgggcacgguggcucacaccuguaaucccagcacuuugggaggcagaggcggguggaucacgaggucaggagaucgagaccauccuggcuaacacggugaaaccccaucucuacuaaaaauacaaaaaauuagccaggcgugguggcaggcaccuguagucccagcuacucgggaggcugaagcaggagaauggcaugaacccuggaggcggagcuugcagugagcggagauagugccacugcacuccagccugggcaacagagugagacgccgucucaaaaaaaaaaaaaaaaaagaaaugacaauuuaaaaaguaaauacuguuaacaauaaaauauaugaggaauaaguacuuuucacuguggaauuaggagagguaucaagaagaggcagcauuucaacuuugacuugaaggugacugguauuucaauaguuggucauauagagaauaggcauuuagaauaaaauguguuauauuuuaauugcuugucggacacccaucuuuaaucaucaucauaaacaauugcucauuuauuuagucuuauacuaagccacaugauuuugagaguuuuacaauauuaacuaauuucauccucacaaaaauccuaugagugaaguaauaacucauucuaugggugaggaaaggaacucagaaagaucaggucaguuuuguaggucagauaacuaaaaaauggcacagcuggaauuugagcucaagcauuugaacuacagagcucauauuuuaaaucucaaugcccaucuguguuuauuuagguugagaugacuuaauugagacauggagguugagccagagccagcagaucaucucuuaaaauugagcuugugugucaucuauaaugaugugauaaacacacauuuuaauugaaugaaugaaguaauguaaaaugagaagacagaggaucagcuuaagaaauuacauucauaggcaagagagagagaaaaaaaaacagcuuccauaaauggacauuuugugcuuuguauucaugaguguauccagaaaaugaaccuaagaaauuuuuuagaguuuccaauauuucuucacuuuucauuuauuuauaaauucauuaguauuuacuguuugauuaaaacauuacuguuucaaauugucuugcaugauucacagaauaguuuuaucaguaggcaaaacagauacccucuuuuuuaagaaaaggcuaagugauuuacccaggaucacacaacuaagugugacugauuugaauuuacaucuuaagauuuauuauauaucuugaucuuucaugaaucucgccauucagcugaagucaacguuucaaaaaugaaugccuuacuaauuuauaaaucuguuaguuauuucuccuuucucuguaacucuuccaacauucauuaccauuguuuuuuuccuuauagaauaccuauccaaauguuuuccuucugaaguauuauguucuacuuuuagaaaacagaguaagaaaauaucacuguugucucauccagacauaacuauuuuacauguuuaaguauauuuccuucuauguguaucuuuaauacagauaugauauuauauaucauaguaguugauauauuacauccaaaauauuauuuuugcuucaugucucaucaaaauuuucccuuucuucaaucaaagggaaauguuuguugugaugucaaugauuugaaaauuucaggacaacaaauuacaguggcaugccaaaaugguuguaucaucuuuuuuuuuuuuuuuuuuuuuuuuuuuugagacggagucuugcucugucgccgaggcuggagugcaguggcgcgaucucugcucacuacaagcucugccucccagguucacaccauucuccugccucagccucccgaguagcugggacuacaggugcccaccaccaugccuggcuaauuuuuuguauuuuuaguagagauggaguuucaccguguuaggcaggauggucuugaucuccugaccucgugaucugccugccucagccucccaaagugcugggauuacaggcgugagccaccacgcccagcccauccuuuuauaccuguuagugcaacaggacugccacagcucacauguagaaauuucacuucacagagucauguagugcaggguuugaaagacuuugugacuuagcccuuuccagaaauaagcagguauguuaacagcucacauucuucuauuuacugcugggauaaauagcacaaacaauuucuguuuacuuuuccugcauauucaccauaugguaauauuuuaccauauuugcuuaccauuauacacaaacacacauacccuuacuuauuauacguugcauuguauguaagccauacauuuuauauauaguguauguaugugguguacauauauguaugaauauguguguauuuauguauauguguguauccucucuuuaauauauugucucaugguuccucgugauuagaucuggauuaauuuuuaacaagaguaccacagcagugauucuguguuuuucucaguacggguucgcugaagacuaauggccauacuuauuuauccaaauuaacugauaaagucaauuuugaucacuaguuuaaauugguguuuugguagguuuuccacuguuauuauuuccccauuuguaauuaauuagauaucuucuggaggaacauuuugucaguauguauauaguuauuaaaacaaaaucuccagaccugucuaccuauuccuuuacuaaaaguucauuuacauagcuuuuuauuagagagggagggaacugaugugauggaaugcagggauggguaagaguuaggauaccagguaaagugucagaaaagauuuaguaauuaauauuguuucccaagaguuuuauaaauuuaaauacauuuaauuauguauauauaaucauacauauuuauaucuaaauauauaugacauguauccauauauaacauaagaugcacaauauguaaauacacauauaugugcauguauguguacauaugcacauacacacguuuauguauguaccugcaugccuugauauauuuacaguaugcauaucguauauacaguauacauauauacauauaugacguauauauguacacacaccauauuuacuuaaaguuugaaacagacaaaauacaguuaacuuuaguuagauaugcuugugugcggugggaaaacuauaaagaaagaagaggugaaaugguaaacacaaaauucaagcaguugcccuuaggcagggagaagggcaggacuggugauucagagggagcacgagaaguggaaaggagcuuuuaagcuggcagauuucuuuuugaauguuuacuuuauauguuuuaaacuagacaugucuuuuauacuauucuuuuauguuauucuuuauauuauucacuauucacaauuaaacaagauuaaccuuaaaaauaauucuuaugauuuuagcuguuaaagaaauauacuugguuaguuuaguguuucuuaaauacauguagaauaguguugugggaagucagggaccccgaacggagggacugacuggagcugcagcagaggaacauaaauugugaagauuucauggacauuuaucacuucccuaagaauacucuuauaauuucuuaugccugucuuacuuuaaucucuuaauccucuuaucuucguaaacugaggauguacgucaccucaggaccacuauaauuguguuaacuguacaaauugauuguaaaacguguguuugaacaauaugaaaucagugcaccuugaaaaagaacagaguaacagcgauuuuuaagacagcgauaaagucugacugccuguggggucgggcaaaaagagccauauuuuucuucuugcagagagccuauaaauggacgugcaaguaggagagguaucacuaaauucuuuuccuagcaaggaacauuaauauuaagacccuaggaaaagaauugcauuccucgggggaggucuauaagcggccgcucugggagugucuguccuaugcgguugagauaaggacugagauacgcccuggucuccuccaguaccccacccuggugaauuugaggucagacugguucucugcucucgaacccuguuuucuguuguuuaagauguuuaucaagacaguaggugcacagcugaacauagacccuuaccaguaguucuguuuugccuuuucuccuguuuccccagaagcaugugaucuuuguucuccuuuuugcccuuugaaguaugugaucuugugaguuacucccuguucuuggacccccuccccuuuugaaauucuuaauaaaauuugcugguuuuguggcucaggugggcaucaugguccuaccgauaugugaugucacccccgguggcccaacuguaaaauuccucucuuuguacucucucucuuauuucucagacugguugacauuuauggaaaauagaaagaaccuacguugaaauauuggggauggguucccccgauagaauagaagcagcaguuuguaggaaguuucacuugucuuucuuuucuauuggaguuaagucuuuuuuaacuuaauucucuauaauaacagcaccguaucauagaacucauuuuauaaagcagucaaugucagcauugugccaaauaccuuucuaauaagaaaucuguauauaaaaagacuugaauauuucauucauaugguguauauguaccuauauacuuauacucauauauauauauauauacacacacaacaauaaugucuuuucuuaaucagccaagaagcacugcauuaauauauguccauaaacauacuuacuaaaacaaaaacacauauaauacccuuucagaaguuauaaauuacuguuuauaaccucuguucaguaagauuuucagagucguaaguuaauuuuauuuuuggagacguuuucuugcacugucacccaggcuggagugcaguggcacaaucauggcucacugcagccuugaccuucugggcucaagcaauccaccugccucagccucaugaguagcuggggaacuacaggcacacaccaccaugccuagccaauuuuuuaaaaguuuguguagggauggggucuccccgugguuguccaggcuggucucaaacugcugaacucaagugaucuuccugccucagccuuccaaagugcugggauuacaggcaugagccaucaugcccagccuaaugaauuuuuugaaaaaauugggaauaucuuacuugugauuauucuuuuuuucucuacugucauuuaaaaaauuuugucugauucuauuucacuucaaaauguuauuuaaaauuuguaauuuuucccuuuuaugaaauuguuaguuaaaaauuuuuuagaaaaucuguuuaaugacuggguuuuucauacacuaguaaguauuuccuuuuuauuaacugugauuuguaaauuuuacacuuagauuuagaaaauuuuaguucaggccagguguguggugacucauaccuguaauccuagcaaugugggaggcugagacaggaggaucgcuugagcccaagaguucaagaccagccuggucaacauagugagaccuugucucuacaauaaauaaauaaaugauuuuuaaacagaauuuuaguucacauacauagaauguucccuuccuacauucagcauacauguaaucuguucaaguaaugaaaaacauauuuuaauuucuuaaauaaaauuuccuaaagguucgucugacuaaacguaauuggcauguacauggugauauauccaaaugaauauugccguuuauucuagccauagacccuuauuguacacauuuauauaugaugauauaauuaaugucuucacuuucuuaauuucaccaauaugugaugaaaucaguauuaauuauucaauguaaugaaauuuauggauuuuaguuuucguguugaauauauuggaaaauacuguugauaacacuuacuaauuaucuuuuuucaauaaauugcagcaaaacacuuacuauuuuggaguuuaaaguaugucaucauggcaaaguuucggagaaggacuugcaucauuuuggcacuuuuuauucuauuuauuuucucucugaugauggguuuaaaaaugcugagaccaaauacagcuacuuuuggagcuccuuuuggacuugaccuucuuccagaacuucaucaacgaacuauucauuuggggaaaaauuuugauuuccaaaagagugacagaaucaacagugaaacaaauaccaagaauuuaaaaaguguugaaaucacuaugaaaccuuccaaagccucugaacuuaacuuggaugaacuaccaccucugaacaauuaucuacauguauuuuauuacaguugguauggaaauccacaauuugaugguaaauauauacauuggaaucauccaguguuagagcauugggacccuagaauagccaagaauuauccacaagggagacacaacccuccagaugacauuggcuccagcuuuuauccugaauugggaaguuacaguucucgggauccuucugucauagaaacucacaugagacaaaugcgcucagcuucaauugguaauuauuguauauauauauauguguguuugugucuguauauaugcauauaaaugauuuuuuguguaacuuuacuaguuaauuuucucauuauuauuaauuauauuguuaagcucauaccuccaaauuaaacuguauguaugaucuuaaacauccaggcaaccacauuuuaacacugcccuuaguguauauuguuuaauuuuuacauuuuggagcauuucuggauauauuguugauuucuaauuuaauucacuuucucaauuuuauuaaauuaugauuuacauaaaauacaaugaauuucccacuuuaaguuuauagcucauugauguuacucaaaaguauauaccuguuugaauaccaccccaaucaagaaguaaaauauuucuauagcccaaaaagucucaucauaauuccuuuauucaggccuaccuucuccccuaccgcugaaaacuguauacauaucagcuggaucugauuucuaucagaucugauuucuaucacuggagaauaguugugaguguucuauuacuuuaugaaaauagagucauucagcauuuguauguguguaugucuuuugcucagcacaauauuuugaacugcacuuaacuauaucaauagcuuagucauuuuuauugaugagaagucuccuauuguuugauuuuggcaaauuugcuuuuauauucaccuguugauagguguuugggcuuuuucaaauuuuaggcauguagcauguaauuuaguccugcuuuucuguuucuuaaaguuauucugucagucuuaaugucuguuuauuucauuuauguuuaauguaauaaugauaugauuuuaaaucugccauuuuucuguuuauuuuccauuugucccacacgucuguuucuuuuuuuccuucuuuuucuuccuucucuuacauuacauaugcguauuauucuguuuuauauuuucuucuggcuuauguuauucauuuguuuuauuuauaacuguaccuuuuuacaauacgccccuuuaacuuaacugauucuuauuguuguucccaccgcuucucaccuuucucuucuccuuccuucuggcacuccaauuacauauauuuagauagagucauauugucccacaggugaauuacagaaaaaauauaacuuggugccugaaaauucuucaguuuguuaauauagucuuuguaaaaccuuccaguuucaguuucauuuaucuuuuuagugccccuaccaguagagcuagaacaagaaauuggguauucuuacauuuuuccagcucuacauaaagguauggauucaccauggagcugauauguauuuagagaaacacaagagucuuugaugaacaaaacaauguagaauucuaugaaucuauaucagauaugugcaagaugaguuguuuuccuuguauggacuaacuuuuuucaaguauuuauaaaauuuaacuuuauaguauaguuagagauuuaguuucuauguucuguauguauuaugacauaaaauagcuugggucaguuaagacagcauugacuucuguguggucaauauguaugugugugugucugucucuacuaauuugcuuuugggaggagaaucuuuucaaaugauauuuuuucuauuguuuacaaaaaauuugugucacauuuaagucuuuauucaagacugucuugauauggcuaaaaaaacuaugcuagauugacagaggaaaugguuguucuuuaaaguuuuaauuuucauuugcaauuugaauaguauacaaugaggguuuuuuccccuccauuauaaauauaacuaauauuaauacauauuuguaauacauaaacauauauaaauaauauaugugguaaauauaaauuuuaaauagaaauauauguguuacacuauuuuugguauaguuugugaucaggaagaaaaguuucaguaaacauuuuuaugccuauucauauuuauaaagaccuuuuucccuguauaauauuuuaguauuguaucauguauaugaacauuaauuauuucuaaacauugacaguaauacagucauuucaauuuuaaauguugacagcuucacuacggaugcaaauauuuuacuuuuugauggauuuucuccuagacaaaauuaaaaaauaaacuugauaauaaaagugacauaaucaauuuauaaauaaagaaauaauuucuuaaugaguuaaauauugaauuauacucauuguuaccaggcagaaaauaauuugacuguuggaauacugacucaaaacccuaauuuaauccauggagcuggcaugcugacucaggcauucuuuggauugaagaagauaguaaaugaaggcuguuuaaauuguuguaugguugacugugcuuugacuacauauuuaacauucauauuuuuccuuugauauaaauggccuucuuuuuaucuuaaguugaauugcugugugaaguaauuaugcuguuauaucgcagaguacaaguugguugauuuucugcuuuuacaauuaagugugguuggcauaaauccuaauggcucaacccuucauugaaaagaaugauaaaauuaaaaugaacuauuaauguuauguuuaaaauccaauuauuauauauaauguaucagauauauuacaauggcauaugguagauuuguauccuuuucaagucuuuuaaguaaaauauuacguaucauguauucuauccucuuguauugcuguauuacaacucuaaaaguaacagaugaaugccuucuuuuuuuuauacaguuuacuaaaacuuuaguagacuggucagaaaauagcccccauuuucugauguggacaucguaauucccacaaucugugaauauauuauuuuauuuggcaaaaggggaauuaggguugcaggugcaaaagauugcuaaucaucugaacuugagauggcauuauccuucauuauuuggguacagcuaaucuagucacauaaguccuuauaaauagaagaagagggaaaagagagucagagggaugcacgagagacucgacccccuguugcuaucuuugaagauggaacaagaaguucaugagccaaagaaugugguagccucuacaagcuugaauggcaaggaaagggauucuuuccuagagccuccagaaaggaaugucauccaguccaauaccuggccuugaucuuagcauauuaagacccaugucaacacuccugacaugcaaaacuguaagguaauaaauuuacguuguuuuaagcaacuaaauuugugauaguuuguuauggcaaaauagagaacugcuacauuuagcaaaacauaauguacucuaugacuuuaaaauuaucuucccauuguuucaguuuagcacuaaauauuuauugauuuuccaugacguuccaagcuugugcuagauucuagggacauaaaaaugagcaagucacauuucccaguuccuuuguuuucaucauuguugcuuuaaaaacacuggauggauuucaacauuagaauauuuccugaaaguaugacauauuuguuuuaguaagguuacaauucuuacuucugcaucuccugccuuuaaaaauuuauacauaaaaguagaagucacaaugagaugaauuagacacauaaaguuuaaauguaccuaauaacaucuaauaugaugucauaaaauuuccuuuuauaauaacuauuugcauuaaguuuaaagguuauauuuauaacuguagaguggugauauuccauaaagcuuucauauugcuauagaugcccaaccuuuggcuacaaaaaaaauuugaaaguauucauugcaaggagacagucuacuugcaaauaauauauacuuaauguguaauguaaggucuucaccacugauauucccuauguuucccucccauaguuugcuauugucguaauucugucacauaagaaaugguauuuuacuaucauugcuguaggccagagguuggcaagcauuuucuguaaaggacugccuaauauauauuuuugauuuugugagucccucacucucucucuuugcaaccacucagcucuauccuuauagugugaaaaugguuauaagcaauagauagacaaauauauagaugaauuggccuguaaaaggcaagauuuggccgaugggucauaguuugcugaucacucuuuucaauaaucaguuguuuuucacagugauuaaaaguaagaauguuuuuuacauuuauuccauuucuacuguuccccauccauauuuuaauguagauccaaguguaugucuaauaucauauucuuucucucuuaaaaauuucuuuuaucuuguuuuacuggucuccuugcaaugaauauuuucaaauuuuguuuguagccuuuauuuugaaagauguuucaucaccuauggaauucucaaugggcagguuuuaggggauuguuuucuuuuggaauuuugaaaauguauuccauuucuuuuuuucuucuuuuucuucagucuuucaugguuucugaugaguagucugccguaauuuaaaaaaaucuuuuuauauccucauuuucuuggauggauauguuuuguuguugcuguuguuguuuucuggcugcauuuaauuuuuuucuuuuuuucuuuuuucuauuuuguuuuuuagcagucuaaacaugguaugguuacuuguuacuccuguuauuuuuuguuauuuauccuucuugguguucucugaauuuuuaaucuguugcuuugugucuuuuauuaauuuugcuaaauucuuagugauuauuguuauuguuuuaugagauggagucccacccugucgcccaggcuggagugcaguggccugaucucagcucacugucacugcaaccucugccuccuggguucaagcaauucuccugccucacccucccaaguagcugggacuacagaugugcuccaccacgcguagcuaauuuuuguacuuuuaguagagacaagguuucaccauguuguccaguauggucucgaucuccugagcucguuauccaccugccugggccucccaaagugcuaggauuacaggcgucagccaccguguccagccugauuauuuuuucaaauaaaccuccuacuucuggguuuccaauuacauguguacuagaacuuugauauuuaucucgcaacuguuaaaugcauuguucuauuguuuuccccagucuuuuuucucauuaugguaauuuggauaagguaauuucuuuugacuugccuugaaguuuccugauuaucuccucagcucuguuaaugagccuauuaaaggcauuaauucaucuuuuuaaguagucuuucauuccuggcauuucuguuuuauuuguucuuauaguucccauaucucugcugaaauuugccagaucuuguguguuagcuacuuuguccauuagauccuuuaagauauucauuacaguaauuuuauauucucucucugaugauuccaacguaucucauuugugagucuguuucuauugauugcuuuguuucuugucagugaauuguuuuucuugcuuuuuuuucuguaccuuguaaaauuuuguuaaaaguaugucacccuggguaagauagugaaaauuguguuacgucuagaaaugagcuugccuuuuuuucucuuaaagcuuuaguuugaaagaauguuugagauguucaaaagaagcucuaaauuuccuaugaacacauaacaaguuuucuggggcucaagguauccaaauuuauccaucauuauacugucuucuuguuauuaaguguuauuuauaaucacuuuuuagguguuuuacucugcaugaugcauucucucauuugugcuuuuuaaaacaggccuuauccuacauuuuacagauguggaaacuuaaguaaaauaacuuaccuaaagauacucaucuaucaaauaacagaauaagaacucgauucucuaggccuaucugauuuuuauacccuauauucuuaacuguuauccuauuugaaugcaucacuuuacuaacaacaaaaaaaauugacuaucaauuauauugaagguccuguaauaaguggcauggaggggugacaugagcaacaugacaugaguuuuugcauuuaguuugcuaauauuucaagaauggacuucaaagagcauccuagaguuugcuaagcaauuaggaugacagaaauacagaguaauagauuuuacuuauaagugauacucaguuggcuuauuuuauagacacuucucugguuacuaucaaggauucacugccauuguaaauucccaacacuccucagaaguacgacaaucacuggcgugguucccaggcuaguauuuauucagugccacaguccagaagacacuguauaaugauuaauugggcuguggaucacaguauagggauagaauuagauaucuggaagucauaauugaugcaauaaagaagcugaaauauaacaacauuguaagggagaagaaagaacauuccuccaaagccauagaguauacuugcaaagaggauaaaagaggaagagaaauuacuagaccaagaaugggaugguuaauuuauuaggagaaucagaauaauauggcagcgcuauccaguagaauuuucugugaugaugaaaauauucucuaucugugcugccuaaaacaguagauacauagucauauguggcuauugaacacuugaaacguagcuaguugagugugcaagaaaacuuaauucuuuuaaauuuuaauuuauaugguagauauggguauuauuuuggagagcauaggacuagaauguaaucaagcuugaggaagagaguaaagaaaugguggaauggagaugauaguauaaagauggaaaagacuggcugggugugguggcucacgccuguaaucccagcacuuugggaggccgaggugggaggaucaggagaucaggagaucaagaccauccuggccaacauggugaaaccccaucucuacuaaaaauacaaaaauuagccaggugugguggugggugccuguaaucccagaggagggauucuaucuguaaucgauagaaugaggcaggagaaucacuugaaccugggaggcggagguugcagugagcugagauugugccacugcacuccagccuggcaacagagcaagauuccgucucaaaaaaaaaaagcaaaagcucauguguguguacauguguaugugcgugcuaggagagggguaugguugaagagggagggaaaaaugugagggaaaaaacagagaauguuguaguuaaaggaacgaauauuucuugaauacuguagucuaguaaguggaauuuuauguguguacuuaaaauauauccugaaagguaagaauaaucuguguuuugauggugaggccacagaagcaagaaguuaacuugcccuuaguucauguagcugauaaguggugagauauuugaauacauguucaaagcgcaugcauauucuacuauacugcccugccucucacaaaaagaaauagaagagugguagaugaauuaggaaaagggcaaaaguaaugauuuucugcauuuuuaaagguaagugcuuuuuaucuuuuuuaaacuaugaagguaauuuuuagaaguguguguaauggcgauaccugaaguuguugcauguugcuguugucuuguuucugccaauucuugugcaugguguuuuauucuuuguguucuuaauuaucuuugauuguauacuauuuauuguucuuuaugaaauacuuuuuguaaauaauuugaggcccaggaagaagaugccuuccuccagaaaggauuuucuuuugcuucugccuggugacuguuuagaauaccauuucugguuaccuuaaauuaggucuaaagcuagaggauuguacaagcauugugaaccugcaguuuaauucacugcuuuugagaguugguuuacuuguaccaauuuugcuuggggcaaacagaccuccuugcucacuuaucuuucugguuucacauuuucccuucaauuuggccaggacauuucuuacucucuucagcucuuuaagacauuuucuccccguguuuuauauaauaauaaugguuauuuucauggagagugcuugguuuacuauuagaccaacuguuauuuuagacuagucugcuauuauuagaaacaggaaucuuguuuuguuuuuacuuuuauggaagaauguuuugcuuauaauuuucaugugauucauagcauaaucuuucuguuguuuaauauuuuuucuuauuuuguuccuuucauuuucugcauaaaauaauuuuuucguaggucccauguugagaaaacuuuuuguugucauucuuauuuucauuggugauauucuucuuauaagcugggcuaguaaucuuacaagauuguaagugaucgcuuauaaaauguuggauugucuccagacacuuuucucaccagcauuucucucuaggauaugccuuccucuggcuagccaguuucccuaaagccucauauguuauagguuauuuuuucuauguuucguucuaguugccauucuuauuuucagaguggauaggggacauaaggauuauuuuuccauuaacuuugauuuuguuguccuagaugggacuuacuuauuuguacauggcggcuagcacaaaacuuaggucuuaaaauuuaguucuccagcaguuucuuaccuucaauuucuuaauuuccauaugcuucucuuuugguaccauuauuauuuauuucucugccuuaaagagucuguuuauuuaucuagaaauuugugcaaucuuucuaaugacuguccauuucuuuguauacguaaugaggcuuugaauuaauucaucuuaaauauuccgucuccaguuagugauuuucauguaauuuaugcuucuaacacauaauuuaucaguucaaaaauaaguaggcaggcacuacagagaggaacaguaauuauuuuacuauguuagaaucuucuguuaaaagguauugaucuacacaaaaacagcauauaaauguuuauagcaguuuuacucauaaugggcaaaaauuggaagcaaccaagauguccuucauuaggugaauguauaaaauaaauacaauggcauauuaugcagcaguaaaaagaaaugagcuaucaaguuaugaaaagguaugaaggaaccuaaaaauucaaguugcuaaaugaaugaagccaguucuaaaaagcuacauacuuuguaauuccaacuauaugaccuucuggaaaaggcaaaauuauaggcagcaaaaagcuuaguuauuggcaggggugagggggagagggaacggggaugaaucaguauagcacaggagguuuauagagcugguaaaacuaguuuuucagcuacucuaauggagagcauaugguauaauagauuugucaaaaccugucgaacuguacaacacaaagugucaacccugauguaaacuauggacuuuagugaauaaaaaucuuucaauauugggucaucaauuguagcaaaugaaagauguuaauuauaggagaaaccguguggaggguuggggcagguaggaggaagaguauaugagaacuccauauuuucuuugcuauuuuuauguaaaccuaaaacuuacucuaaaauguaaagucuguucacuuuuacaaaagcuuauuaaugccugauaaagaggucauaaauauugacaaagugaucaaauagccauauguauucugaaggaacuuaacaaaaccaccucguauaaauauguucuucuauuguuaacucuuugguacuuacugugccuuuuuaagaauaucugcauucauguucuugucuuuucccuuucuuuuuggucuuuucuauuagguguacuagcccucucuugguacccaccugauguaaaugaugaaaauggagaaccuacugauaacuugguacccacuauuuuggauaaagcucauaaauauaaccuaaagguauuuuauuuuauuuucaagcuauacauaaguuaauucuuuuggacaagaggagaguaauaacaauuuuugaaauaguaauuuuaauuaaaaaugauaaugacuuagaaucuuuuaaauacuauauuucauaaagaaaauuucuauaauaggaauuucaaucuuaucuaaauuauauuuuagagauucuuuacuauguuucuaauguuuuauuuuuuuauaguagaaagggauugaaagguucuuuugugaagauaauauaguagugaagauuuauaugucuaaauaucuuagaugucaaaaaucuaaaaacaaguauuaaccauguaacuuugcauauuuauaaaguaguuaaaaaauaaacuugcucaaauauuuuucaaaauccaauuuucauuuaaaccuuauuuaaugugcauacacauacacaccugaguaaauauagaauacagcagaaagaucaaguauauuugaugcagaaauuaauguguguugcaaaugagggaacacuucugacagucuuaagauuuuauuucuuuuagaaauuaaugaaucauggaaacaaauaggagugaugauuaaaaguauuuaaauagcacuacaaaagaaaauuuuauacugaauagcaaguaaauaagcacuguuuuuaauauccaaagauacauuuuaaaaauuggucauguauuagguagcaacauuaauucuaauaaauucauaaaaauuauaaccauagagucugcauucucugaccacauucaguaccauggaauguuaauaauuaaguccaaaccauuuagaaaguauaaaauuauuaaaauuuuaauaacauaauugagaauaacucugaaauuuaagugauauaaauagcacugagauuauugcauuaucaauaccaaugggaccuaaauaauaagacauaguagaagaaagaacuaugauagaugaagugugaaauuaauuaaauaguauacaaguccuucaaaaucaguagucuggauaaauuaaucuuuacuauuguccacuuuuggggaaaaaacaauaggcaagccauuggugagauuaaaaaagaaaagaaauugagaaaacauaucagcaaaaauugaaaagaaauauaccuauaguuucagaagagaguuuaagauuuuauaucagucuauuuaaaauuuauaugguaguuuuauaggaaaauacuaaaauuaauuuuuuuuggugcagaaagagguuuaaagaaucugaauugacuauccuagaaaaaaacguauaaaagauaauugaacaaaugucuuccccaaagugucagguuuaccucucaguuguauucagaauaguugauuuuuaugauaacugaaauacagugucaaguauacucacuaucuauugcugcauaacaaauuauuccaaaacuugguagcuuaaaacaauaaacauuuguuaccucacacaauuucuaagggucaagcaucuggaaguggcuuauuugggagugucugguucagggucucugaaggagguuacaggcaagcuauuggcuggugcuguagucaucugaggcuagaggauccacuaacagacuuucucaugugguggaugacagaccucaguucuuugcagcaggugaacuggagacucuguacuucuauauaugggccuccagcuucacuagagugaaagaucugagagagagucuaauauaggggcuacaggguuguuuuuguuuguuuuguuuuuugacauaaaucuuggcaaugacguguuaauacuucugucccauucuguuguuuuaucuacggauaaaacaaccauggcacaaugugggagggaacugcaaaguuaugaauaccaggagauggguaucggggggccaucuugaagaauggcaaccacagaaaacuuccaaauuuauuccacaauagcacaauuuuuauuuaaaacuaagaaaggauagaacaagaaagagacagacuaaucuuaccaaugaaaauagauucaaaauuccuagagggaauuuugagaagaaguguuuauuagcaaggauuuaagaaugguuccaaucauaugaaaucugaaucuaaauucaggucugcauucaauccuggcucaaccaccuuguagcuuuauaaaugacuugugucucagcuucuucaucucuaaaauagaaauagcaacaaaaccuuccuuacacacagaaugguuauaaagauuauauuagauaauauauguaaaacauagauugcugucuggcacagaguaagcacuaaguaaauaaaacuucauugauuauuuaaagaagguaaaacaugguuaucuuaagagauacugaaaauuuuaggaaauaaaaauucauuguuaaugaaguccuuaguaaccaaaguucuuuagcuugauaaagggugucucuuaguaucuuauuucaaacacuauaucugauggauauacuacaccuguagucccagcuacuacucaggaggcugaggcaugagaauugcuugaaccugggaggcagagauugcagugagcugagauuggugccacugcacuccagccugggcgacagagugagagucuaucucaaaaaaaaaaaaaaaagugauguagguucuuuuaacuagagaccacucugagauugcaaccacucuuaaaauuugcugaagcuuuuuauuugcucuguaacuucuugcaguuauauucuaauggaggacaaucugguuuguccaauacugguaauugagcccuguaagauauguuauggaccacuguugaaauauuucguuucaaauaaaaaugugaaacauuaguuuugucuuaauuuuccuuuugcagccuagagauugaguaguuauuggagaauagaaauggaacuguagggagugagaaagagcuaaauaggcaagcauuuuuuuauuucuguccauaaagcugccucuucuuucugauuuacuauccugaaacuguuaagacagcaucucucaaauuagcugucuagcaagagcugucaccugccaugucccuuggugccuuucagugaguucuuauuggcauuugaaaucugcaaauaggcaagccuccagguucuggugcccaggcugagguuggguaagugauugauuuaucuuccacaaaacaagcccaagagcugcuuuucuguccaggcccugccaaaauccuggaagauggaagcucaagaaacuggcuauuuuaguacuuucaggaaguuuugaaagagaaaaugaaaauguuaugauauaugaggauugguuggcuuuuucuccuguuuaaagugucuguguagagaaggagaguguggcaaagagcucgaccacuaauugccuauuuaauguugccagcauacuugaucucucugugcuagggauuuuauaucuaaugaucagaaaaacuuggaacacgauagacuaauguuuuccaaaauuuuuagaacaguuucuuggccucguguauggugaggaacuauguauagacaaagaauagaccuggaaucaugagacuggagcuuguucuaacugaguagcucuggaaucuuauauuaguuccuugaucuucuuggcuuauccccuucauuuguacaaugacaaugaaaccauaagauaguuuuauuggauuugucuaugauuucuguuguuguggaacagacauuuuuccuaacucaauaaaaugcaguaaauccuguuuuuuuaaagaauggaaaacuuucccuuuucuugcuaauauaaggaaauuuuaauauguuuaaugaaugacaguaccuuacuagaauuauucagugugcuaaggcaaucugauaggaaaagauuaaugauguuguagauugugugcugacaaauuggagccuccaaugcacauaacugaccacaucuaaaacuuuuaaguguaaaaugcguucauuaguaacaucucuuuuuucuugcuagucuucaaagcauggaaauacuaaauggauggagaauuuuuagggaaugaauccgucucacaguuaaacuuuuguuauaguucauucauuuugauuauauaauguuuuuacuaauauuagucauuaaauauuuuguaauuguaauuuugauuuguuaacuucaaccaagaguuauuuuaaguaagugccuuuuaaauuauaaacaaacaugcaagaaaaggaaaugauuggugcuuuaguuauuuuucauuaucuuuagcaaaugugacuagguuuuuuuuuggaaguguaaaugagugaaacuaaaauuuaaaucuugauuuuucaaagcgauuuaguuucuguucuuuuaaaguauacuugucugcauguuugcuagagcaaaggcuguugcacuuauaacugucauuuaguaggcugguuuugcagagaguguaaaaaucagggcuggauuccuuccucuauauccugcaccauuaagaacacagcaacggaacaauuuuuugaguaagacaugacagaaauauuugguagauuccgucauuguuuagcaaauaaucugguuuuccuuccccugcaugcaaagaguaaguauacuuccugcccuguuguuguuggguuuggccuuauggcuugcuuuggcugaugagaugugagaagagauaauguauacuaugugcuugcaugauuaugcucuuauucucuuuuauaagaaaagcaugccccuuucugccuaggacucagaaugacagacacguggagcugauuugaaccagccuggagcagaaccaucauaagccaguucauagauuuuauguucgaaaagcaaauguuugucuuuuagagccacugagauugugggguuguuacauggcauuaucuaaucaaaacuugacugaauuaaaucauucaucuaaguaaaagaaaauuaggcagauucagugauuuuuuuuuuuuuuuuuuuuuuuuuuuugcuuaggauuauaggggaaagaaccaacucagcccuggugaucuucuuucauuuuaauaaauuuaguauguuauuuuaaaguagcauauuuucuuucuacuuuaugcagaaaucacauuucuuauacuagguuuaucaacauccauuauuucuuugcauauggcucuagagucauuuuaucugcuuuucaggcuuaugcagauuucaaccaugugaaacaugaauauaaguauguccgugauucuuuuuuaaaugauuuucaccuacauuugaaacauguuauauuagucauggccucuccuuuuucuuuuuccuuguuaaaugaauauugugaauucauggcagaaacuuugggaaucuuaccuaaauccaguauaagugacagacuuaagaguuuaacuguuguuuguuuuugcaugcaaaucauuaguccauuuauuuaugcaugcauucauucauuuagcaccugcuacgugucagauacagucccagaugcugacaauauuaagaagaaggaugaaguauuaucucuuucccuaaaaugccuuguaaucuacuggaggucagacacaaagacaaguaaauuucaggaagagaaaaguaugagguauuauggcaccacauaggaguaggaagaccuaccucaauuuuguuguggcaggggauaggggagugugcaggggugaagguagagaauagaguuggagaaggagaaaguuaucagauuuucauucaaaaaaguucauuuuauuaaaauuuauuuauuaaaguuauuaaaaugcaggguagggaagagacaggaaaggucaaaauuaaaaacaugaaaugagggaauguuuauauucuuauucuuuaaagauaagaaagacauuucauuuuauguauagaauucuguuauuuuaaaauuuauuuuaacauugaucuaauugauuuuuccaaauggaauagagagauggagacuagaucacaucauuaauuaaaauugcaaaguaauggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaaaauugcaaaguaauuuuauuauaauuaagaaauuagaaauacaugagggaaaauuuuaaauauuuuauacuuaucaauacuauauuuacuuuaaauauauugaucugcgcuuuacaaaaauagcaugcuauuuguuguuugcagcuguaaaagcaaauucauuuugauauaggauauuucaaguuggauauugcuuaaauaugguguccuuuauguauaaaauggaaauuuagaaaacacagugauguaacugaaggaagaauuacccaaggaaacauuauguaauaguaugaaaauaccuauacacuaggcaauuugcuuucaacugaauuuaaaaagcaaauaccaaaguuauugagaaaucuagcugcccuagcaguuacuacccuggcaauacuaacaauaugcugcaaaaauuaauuugaccuuaguuuuuuaugacagaaacuuacuuuuauaauauuacuguaaucucauuuaaaguagaaaauuauauuuuuuuuaaauauuauuuaacuuuaaaauuaauuaugugaaaacaaguagcacugauuaauguaaaauacauuuugcuuuaauuggguaauugaaaacagaggaguuucauauugcaauagaagucucuaguuccauaaauacaucauagagccugaaaccuaaaauuaaaacaguaucaauacauuuauuagacugccauaaagauuuuuaguugauguugguaagucaguaaaacuaggaauaaaagugaaaauccucauucuuuguuuuaugaaucugaaauagauugucaucuaagagaaguaucuucuguauuuuuuaccuuacuaguuagaaguagcauacagaaugguuuuacuagccauaauuaguuugucuugauuuauguauagccaaccuuaaguuaaaaaauuuuagucugugcacaguauuuuaaaaauauuuguaauuacugcucucuauguuuacauauauauauauaauguauguaugugugcguauauauguauguagguguguguguguguguguguguguguguguguguaugggauauccaaaccauaaauaccuaggcaucaugaaaaauguccuuuauaacacuaguggauauuauuuuuaagcgauuucauuauaaauucuuuaauagaaguuaauguauauuauuuuguaaaaugcuguuuuaaugauauggaagaauuuauauguaaauaaauuugcuaaugacuucuauuuaaauuuaagcuuaauggucacaugccugaaaaaaauccagauuuuucuggaccauauuuuuuuggucuuuuuccuaaaagaaacauauaucugaauauagaguauuuccuauauauauuauaugggauacaaauauguaagaaacauuuuuauaaggaguaaacauaaaaagaagcauugcacagcaguuaagcauuugaacucggaauucagaucaucaauauuaccuccaacaaacugggugaccuggaacaacuuacugaaccuuucuuaagguucugucuaucuuugauuaccucacuaagaaaacagaaauaccuuagggaguugugaagauuaaccaagauaauaauauaaaauguuuagcauguuauuuagcaguaaauuuuauugguaaaaauucucugguaguuucuguguucaauaaauauucaucuuuaauuaaggugauuaaaucaguuacuuuauuaaauauauuaaguauacuucuaauuuuacauuauagauaauuuauccccuaacugauuuuauuguuuguuuuagguuacuuuucacauagaaccauauagcaaucgagaugaucaaaacauguacaaaaaugucaaguauauuauagacaagugaguuucuucaauauuuauaaauauuguuauauuauccagugauaauuauuguuuuaagaauaguacauuaaauuauauuugagauuugaaugauuuaugauuauuccauuuuuaauaaaauuaaauuguuauuguaaugaaugucaccaucauuucgaagaacauugcugaaguuucuuauaauucacuuucuuuuuggaagauugcuguuuuuacuguuuuacagguuuauaggcuauuuaugauuucuguaguuuugauauuuuaaaaugacauuauuuucuaaaccuucagaauauagcuuuaucuuuuuaaaaagaagguucagauuauuaaaagugaacuacuucuuuuaacacaguagacccagagcugauauuuucauuuauaucuagccugaucaaaaagaauuuauuaauacaguuuucauuuuuugaaagaauuuuacugauaauagucugugacagaugccauagucuuacaaagaaacuugucagcaacaguagaacauuuaucacugauagauaaaaaagcaguuuagguauuauguagaguauuauuuauaauguagagacauaggcuuuuuauggcauuagucaucauuuguaaaccucaauaugagaugguuaauacuuguuugguaaugcauccaguaucucauuuucuaauguguaaaauuaaaaaugcauuuuuaauuauuacacuuacacaacugauuccccuaagaaauggagcagugugcucaaacugcacugacuccuucauuuucaguaaacaguuuuugucuguggcaaauuaguugugaauauucauuucacuuuuauauaugcuuauuuucuagauauggaaaucauccggccuuuuacagguacaagacgaagacuggcaaugcucuuccuauguuuuaugucuaugauuccuauauuaccaagccugaaaaaugggccaaucuguuaaccaccucagggucucggaguauucgcaauucuccuuaugauggacuguuuauugcccuucugguagaagaaaaacauaaguaugauauucuucaaagugguuuugauggaauuuacacauauuuugccacaaauggcuuuacuuauggcucaucacaucagaauugggcuagccuaaaauuauuuugugauaaauacaacuuaauauuuaucccaagugugggcccaggauacauagauaccagcauccguccauggaacacgcaaaacacucggaaccgaaucaaugggaaguauuaugaaauuggucugagugccgcacuucagacacgccccagcuuaauuucuaucaccucuuuuaaugaguggcaugaaggaacucagauugaaaaagcuguucccaaaagaaccaguaauacaguguaccuagauuaccguccucauaaaccaggucuuuaccuagaacugacucgcaaguggucugaaaaauacaguaaggaaagagcaacuuaugcauuagaucgccagcugccuguuucuuaaugcauugauuaaaguuuaauaguuaucaaaaucaccuaauuuuuaaaaauagcuuucguuuugaguucuggaaagaaaacugucaaaaucaguauauacuauuaguuauauuuaaaaauauuuuuuuaaauucuuuacagauaauauuauacuuguuacccuucacaauaccacaugagaaaauaucugagacaaaauguauacaaauauauuccuuauggcauaauuuauugcauuucugacugaaaucaaaauucugauuugauggcaauugaauuuucauuuuacaauagauaaaugcuugugcuaccuaaagcacuuagcacacaguuaaauuauauuuacauccuagacccaaauaaauaggauuguguguauauuugggauaucuauugaagaaaaaaagaaaaccccuuaaagauaauguacaugcuucaugucaugucuuuaaaauaauuuaaucaacuuuauugucuuaguauuuagacucuggauaacucuacaauaaugaggaaauucuuaagaauaacaaaaucacuguaccuuccucucaauuuugcugugaaccugaaauggcuuuaaauuaauacucuuauuuuuuauuuaauuuaauuacauaaauuaaaccuuaccaugaccaaauuguguuaggacggccugcuaucuacagcacagugugucauuugcagauuugugguuaccuauaccacgcuagguguuuugacauguuuaguguuucugcuuuacagugcugaauuccauauuuuagaagcuaugaaaguccuuuuaugaaaaaguuacugauugcuucucaguuauuaggaaaacaguuguuucacaauuauuauguagauaugaugcccaaauaucauuuuuaguauaucuugucgaucuuuaaguuguuacuauuguguuauucaugucuuuaaaucagauaccaaauauuuuuuaggaaagaaaaauguuauuacugucauuagguugucuuuuaauacuuuaaguuauuuugacgaaaaguaauagagaaaauuuacuuagcauuuuagauucuagagacauggaaaugaaaauuauuuuaugucuagaguagguccugaaguuuggcuuuacauuaaguuuagcacuguaucagaaugaagaaacuaauauuuuacauaaaaacuaauacuuucaauuuuuuauauaguaauauccccauuuuguaaauguuagacuuuuaucauaccuguaaguuaaaauacuuguuaucaauaacuugucauguugugacaaauugaucacuuguguacgaaaaauaaaucuccuuaaaaacuaaauaaaaugcacuguauucuuacaguuaauguuuauaacuauaguaaaaaauuaauauauauccuauuacauaaauguuauuucuuagguguuccauuaagaagagcaauagaauaaugcuaaaaaauaaugccuauaaaucuucagaguauaaagacauccauucagaaacaaaaauuagcacuaaauuuuuuauaaaauagaccagaugacaaaauuuauuuuauuuuuaaacagugguuuugacacaaauuauguuauugaaaagcauuauuaauguuuaauuuauuuaaaauuuuggaauuugccauuucucagagaaugaucaggccuuaggaaauuaauacaguaguaguaaucauuuucuaggggaaaauaaaagaauaaaucacuauacugauauuuugauacaagcaagcacuuacaugguaaucacuauauagauccaaccuguggauuuucuucuuauguccauuuaacuagaauauauuauuuuagguauaauuuacaaaugucacaccuaauaaucuuuuauaauauaccauauuucauuaaaguuuuguuagagaaguaucuaccacagaggaguuuuugucauuguguacguuguguauuugaacccaccaugacagaaaguaaauuuuaggaaauaguuaugagauuaagggaaaaucuauaaaaacaagguuagcauauucucaacacagauaccaccacuuucuuuuucccauuauagacauggugaauccacacagcauacuucaucucugagcuuuguugugauuccucaacacauuacccuaaccagccagcaguaacagauuucagaguaagauaaagcagauucugucuucauugcaaaaaguuauucucaauggaagaauggcaucugaucucauaauuacuaguuuauauuaauauaguuuuuuucucccuuuuuaauaaaauaauuacagucaucccucagugucugugggggauugguuccaguuaccccuauagauaccaaaaucugcagaugcucaagucccugauauaaacuggcauaguaguugcauauaaucuaugcacauccuccuguauacauuaagucaucucuagauuauuuauaacacuuaauacaauguaaaugcuauguaguuguuauaccauacugguuagugaauaauuacaugaaaaaaaagagucuguacaucuucagaguuucagucggcaauuucuuggccauggauguagaaccuacagauaaggugagccaacugcauuaggaaauaacucuaauaauucuguuaauucuuagagaggaaaacuuucaaaaucuuccucagguauuuauuacaacugccuuuaccauuuuaguuguaacacaguuuaaauuguuaugauaacaaguaaauaagagcaaagaauguauuucuuaauucaaaacuauacguuugaauucaauaugguauaacuuaaagugguauaauacauacaaugcaugaaucauaauggauucuuuuauaaguuauuaauuuuuaugguuuaaucagucuaauuguuuugacuguuauagaaaccaaauauuuuacuguuucuuuuaaggacuaauauugucaaaaacugcuguuauuaacuucacuugaguuguuuaacuuccuucuguuuuaagauuguaauuaaaaauuacuauuuuguuauauggaaugguuaauuuuuaccuaauaaaaacauagaugaaauacauuguauuuuagaua

SEQ ID NO: 13910 - RNA, 779 nt, Homo sapiens
uucgcugguugucacacguccggaggccgagccgucgcguaccuaggauaccuggaagccgaagccacaccucccgcauggccccuccggccagccgggccccucagaugagagcugcacccaggccagcaccagucgcucagccaccagcagcggcaccgccaucuacaguuggcucuucugcugcugcgccccggcagccaggucugauggcccagauggcaaccacugcagcuggcguggcugugggcucugcuguggggcacauacugggucaugccauuacugggggcuucaguggaggaaguaaugcugagccugcgaggccugacaucacuuaccaggagccucagggaacccagccggcacagcagcagcagccuugcuucugugagaucaaacaguuucuggagugugccgagaaccagggugacaucaagcucugugaggguuucaaugaggugcugaaacagugccgacuugcaaacggauuggccuaaucaagaaguucaaccuggagagauggaaaaucagcucucauacuaauuaauuuaguauaaaaauagaauugguagugaggguauaaaguguaagcaucaguuaaacuucuccugucauuccuagcuuccuugcuucagaauugaaauggaagggaggguguuccuacucuguagaaucugggacugggcaaauguuuguguggccuccuuaaacuagcuguuaugauuuuauucuuugugaguuaauuagaauaaagucauuuucuuccaaaaaagaaa

SEQ ID NO: 13911 - RNA, 37295 nt, Homo sapiens
uguuauugacgccauauuggggccggcggcgggugggagaguucuacgagggaggggaagcgguuggacguguucgcuuggguuccugcugcggcagcuaccucgcaaucucucugcaucgaucgccgcucgcaagcuacugaccguacucgggcguauuaggagccgcguuccagccucacaccccacggugcuguuuucgacuucagaaaggaucuagucucagcacagaagcgccucaggcgcggcgcaaagcucgagcggacggcgggggcggccggagccucucucgggggagccgcgccugaggaggcggaagaaccccccugacgcgacuggcgugugcuucugcccgccaccgccccucccgcucucacccgggccgucccuggccacugccccugccgcggaggcagcggcggcagcggcucuccuuuccacagccggcgcuccgcgacccgcuuggcuccugagcccgucggguaggcucuccucgaguucccgcucuucaccccuucccucacccucuucuuucgucacccguccccgaccccacccgagcccggcgccucagcugcccccggccauggcgugcggagccacucugaaaaggacucuggauuucgacccgcuguugagcccggcguccccgaagcgcaggcgaugugcgccauugucggcgcccaccucggccgcugccuccccguugucggcggccgcggccaccgccgccuccuucuccgcugcggccgccucgccgcagaaguaucuccgaauggagccaucccccuucggcgacgucuccucccgccucaccacaggugggacccggccccgcggccgccgggguaguggagagaacugggaacagggguccuggggugugggaugcggccccuggggugggggugccggacugugugguucuuguucuuagcaaaguaguagggcagccacguuuuucacuagguccucguagcccgaggaccuaauaagacacaauagaaaugggcugaugucaaggggauaguguuuggagguggguaggggcuuugccuugcccguauuggguagaacagggacaucuuuuucuuugggccgaaugauuggaauuguuuccguagucgcuggagccccagcggaaaugaucagagaggacgauauuauucguaaauuuaggcgaaagggucacauuucaccccaaucuggaugugugcuugccguaaucgauugguugcagcuauuaacucugggacugggugguuugaggcgaggcuacagccccuccuucaguucagacacggcugauuuuaguauaguggggguggggggugggggauggaugucacuagggcgagaucuaggccugucauuaaucacccacaagaacgccacuuuggcugagucaagaccuguuucccuagcagggucaacaacaaagaaaaugcucuucccgaguacuguaauaugaucacacuauaagucuagaccuugagaaauguugaacuuuuaauaagcauauugcauugaaaauuggggcugaggaguugcuuuuauuuggaaauguuuuauuuuugcccaacaaaguaugcugggggaaaacaaccuagccuugagaauaaugaagaaaucaacccaagauuccaagggacuucagacuuuugcuuuucaucuugaaacauuuccugagagagacuggggaaugucuuuuggcugcuuuguagggcauguguaugcccaguuuuuucuguacuuugaaauccuugugugccccuggcacaauccuaggauaggcuuuuguggacuagaaguguaaauguuuccuuuguguguagcaugcaaagauuucugugugagccuuuaguaauaauaucacccuuuagacaaagccuuuccauagcuugauuuaaaugucucguuaucaguagcuuaaaaaaccgaaguauauaccucuguauuuggugacuuccauuugaaacugacuuuaguguuuuuuuuuuuuugucacauuuaaaaauauuuucuaaauccauggagugacccucgaauaugcaagcuaccauuuuugcuauuaaauauuuggucuaauuuaaggacauacuguuuuagaguuguagugaguuuuuacggaaauucuuagauaaauuuauuuaaugaccuuacuaaacuguguuuuaauuagauugaaaaggcauuuguugauuaauuguuaggcuuuacuuugggaaaaaaaaaaggaaacagccaaugucaagaaugagcuacuggugguugacauuuuuggaauuugucuuuuagugaaaugguaucauuggaaauugaaauggauucuguacuuaacuaauaaagccauuucaaaauaaggucauuaaggagcuaaccagcaauacauuucagucgagggagugaauuaauacagugcuagguuugggaauuaaaguacuauaucucaaugucaaaauaaucuugggcauguaugugaacaauuggggacuauaccauguuccuccccuuuaaagcacacuuauucagaauugugauccuuuguaaacgacuuuucauuggcauaucuguagcguugguuaauacaguuggcuccacauuaucucaaguuuaaauuaauuggacuguuguaguaaaacgacuggaauuauuggaauuguuuaagccagcugauugagauucacauucacuuuccaaaauacugcuauuuucuucaagguguuuuuuuuuugacaucuacuuuggaaguuugauuauauccugaaaccuaaaaucacauccuuauugauucugagucugcuaaaaguuauuuccaaacuaauuugaauauuaucgcaaaaaguuuacuugagaaaacaaguugaaauugaaauuuugacuugcuaaaauuacauuuuuuaaacgguaguuuugaaugacauucuaaauguaauuuaguuugacuuuguguuuauauggccaauuugggguaugguccuguauguuuuuuguaaugucauaaugggagcugcaguguugugcagguaucaaagagcuucccaguuuucauguuaguaaacuuggaaauaauuuucucaugcaccugauuuuuagcuuccuauuuuaacaccgauuauucuuaaacuuuaugggaguaaauacccaucugucauuaacuaaaaugaguaguuagguuuggaaguagacaguggcuuaccaaauugagauuggcaaacuugugggaacucuuuguuuuccuuucacaucugugaguucaaauauaauacaaauuaauguagaacuagaguacuaaagugacuuuuuuucagagcauguauacacuuuauuuuaucauuguucuccucuagauacuuucaguuucugauggcauagcugaagucauguuguggcuuuauuaguuucaggaacuuggaugucuguuuuaaaccuuagcuaucauuuuagucaucccaggaaguuugacuugacuauucuuauuuaaauauuuuucaaacuguugcaacuuaauacuaggaaaaaggaaggacuagcugagcugacggaaguuaagcuugcuuucuuaaccgcaaggcuuagagccuuuauuaugcuaauuggcauuaugaauuuuuuagggacuccuuaacacacagcuaucccaaaccuguuuuuuaggacaccuaaguguuacuaauucagaaaugcuguucagggucuagggaugguugacaaaguauagccauauuuuuguguagccugagagcuaagaauguucuuuacauuuuuuaaaugguuggaaaagaaucaaaagaauuauuuugugacacgugagaauuaugugaaauucaaauuucaguguccauaaauaaaauuuuauuggaacacagcugugcucauucuuuuuuuuuuuuuuuuaaguauuguucauugcaggugacgauggcagaguuuaauaguugucacacacaguauauugccccgaaaacuccauauuugcucucugguguuuacagaaaaaguuugcuuacccucauguggggugucagcagugagguuuauaauaccccuggguauggaaaaggaaaagugaucaguggaaguaaggggagggggagcagaagcauugaauaucguuggugaaaugaaugccucuaguagcugcaucaauacuuacccugguaaguuaguugaaaaccaaaguaugcuuuacuauugguuuuugaaacaucucauaauacuaccauuuagccaaaagauugucaugacauucccaagaaagaauuuuaauaaaaccaaaauauugcaacauuauaagagaccgucaaucaaauccagcacauuguuuucauuauguagugaaugaauggucugaagauacccuucugugaauguuaauguauuugugaguuuguuaggcacauuaauucacauuguuuauggcuugguaccauuaaucugccuuaggaauugaauucugugaagaguuaaguuccuuuguaagaacucauuguacuugcuggaaacuugccauuaaaaauggaaacugcagcuugugaauggggaaggguuuacaggaacauagauuguucaccagacauugaugcaugccugcaaacggagacaccagcuggcuucaaugaaauauaaaugguucuaggcgaacaaaugagacgucuguuggaggaggcagcaucucucuucagaugucauuuacauugagccagaaguauuuuuuaauauuuugugguuauuuagacagcuguuaaguugcuccuaguuucucacuggauuuggcaaauaaauguuuuuaauggucuuuguacuuugagucuuaaaccugauauucuauuuaggacuguguauguagcugcaguuacugcauauuucugugauuuaugcauuuaagaauccuguaaguuuauggccauuaaaaacugcaguuguauucauuacuaauauagagcuuuuuuuuuuuuuuuuucuugagacaaagucuuacucaggcuggagugcaguggcaugaucucaacucauugcaaccuccaucuccuggguucaagcgauucucgagccucagccucuggaguagcugggauuacaggcgugcgccaccacaccuggcugauuuuguuuuguauuuuuaguagagaugggguuucaccauguuggcauggcuggucuugaacuccugacuucaggugguccaacugccuuggccucacacagugcugggauuauaggugugagccugugccgccggcuuuuuuuuuguucguuuguuuugagacggagucucacucugucgccuaggcuagagugcaguggcgcaaucucagcucacugcaaccuccaccuccuaguuucaagagauucuccugccucagccuccugaguagccgggauuacaggcgcacaccaccacgcccggcuaauuuuuguauuuuuagaagagaugggguuucaccauguuggucagguuggucuugaacuccucaccucaugauccaccugccucagccucccaaagugcugggauuacaggcgugagccaccgcgccuggccucccuggcuuuuuuuuuuuuuuuuuuggauggagucucacucugucccccaggcuggagugcaguggcacaaucucggcucacugcaagcucugccucccggguucacgccauucuccugccucagccuaccaaguaguugggacuacaggugcccgccaccaugccuggcuaauauuuuguauuuuuaguagagaugggguuucaccguauuagccaggauggucucgaucuucuggccucaugaucugcccgucucagccucccaaagugcugggauuacagacgugagccacugcgcccagcucccggcuuuuuuauuaagguaggaaaauaaagccuaacuugagcacagcaacacauaggcuaaacauggcuagauuagagguuagccccucuuuagguguggaagguacuauucacuaugguugccacggagacauaaccugagauguaaaggagaauaauauaaauuucuucaguuuuuuaauggcuuuauuggaaaaagaauguaguacauacuaaucgggucuuuguuuuguuuuuguuuucugagacagucuugcucugucccaggcuggagugcagcagcacaaucucggcucacugcaaucugccuccugggcucaaaugaucccccugccucagccucucaaguaccuggagauacaggcaugugccaccaugcccagcuaauuuuuguauuuuuuuguagagaugggguuucaccauguugcccaggcugguuucaaacuccuggggcucaagcaaucugcccgcuucagccucccaaagugcugggauuacagauuugagccacugugcccggcagguuuuuucugcuaaguguuuugauagaucuagaaagacagugauagaaagcuuucguuuugaaagauugagaauaaaagcuucaguggaagugcccaguugugaguaucuuuccuauuugaaaagagauuuuucucuuuauaaaagaagaaugugaaguaauagcauggguuaaguuugggccucuugaauaguugguucaugaaacuagauaaugguauuaggagugggaguagguauuuucaaguaccuaucacugaauuaguuaaccagcaauuuguagucucuguaguccuuguguuaacccuaugccuagcacuguugauucaaagaacguucucuauauaugugaaacuacagggaauuucuugccuuugagagcaccgccugcuuuuaaaaagguaugagagaaaauauuuauuuaagccuauacaaaacuaucaggcaucuuaagucuugacauuucccaagguucuuagaguugcuaugguuggaaaaaaauguaauuucaguuuuacccuguaauucuguaccaaauuuucuuuuuagacuguucuaugacauugucauaauguguaacauuuuugacaaaaaaugugacuccaacgagucguaauaaauacugcaauuaguuuaagacuuugaauaauacuuuucugaggaacuuuaaguauauuucucucuucauuuuucuggauaaugaugagaacauggauuacaugaauuacaauauuuuaaguagccccauguauaagaauuuuucuauuaucagguauuugcucauuggaagaaacauuuuaaaggguuucacaggauuuuuagaagaaaauacuuuuuaauaagaaguugugauuuauuuccaaagaaauugaauuauuuguuauagcaaguuucucacaugagaugauauuguaucuauauuaagcagggaaucccugcagguaauuuaaaauucuaguggauguuaguuuuucagcuuugauauuuauuuugggccuauuaaucagaauuuuacaguauaauagauuuuguaauauuuuuggugaugaggauuuuacaguauaacaauuuuuguaauauuucuugugaugguaggcuuuguugggugguaaacuuucuagcacuaagaaagcagcucauaauaauauacuuuuaguuugucuugggguguagcuuuuuuucccuuuaguuuuuaucugucacaagugucacaggcagaucaucuugagauguacuaguggcuauugugauuuuauuaacauuguaaucuuuccauuaaauacaacuucuggauuugacuuuuuaggucuuuugauguaccuggauuucuuaacauuauuaaaacauuuaaauucuucuucuagaagucacuuguucgaacccuuaugaaccucauuugaguucuagauacugcacuggcuaggcaaagaagaguaagagucucucuugagagacugaugauagagcagccacuguugauacuuuauuagcuagcacuuuaugcuuuaucaguauaccuauuuucauuucuuauuaauauuuuuccacauuaguauucauuuccccuuugauagccuaaauauugaaauugguuuacugauuaaaucacuuuugaaacaguuuuuuuccuuaaaguguuaaggcuuguuuacuaaguuucugaaauugugucaguauaugauguguauucucacuuugguuagcauucauuuucauuucuguuaauguuaauucuuguaaaacucccucaaaaaaaucaaacuaguuggaaugguuugagagagggacuuggauuuuucuuuuguuuauuuuuguugaacugaugaguaaaugaagaguagaauguacagugaaguuugaagaaagccaauuuuucaaacauuacugucccccugaacugugccuuuuaauuaugauaggagauugucuuguuccuccuacuaaaauaugauuaucuagaagaacuuuucuaagugguauacuugauuuaaaguauagaagauuuuaguugcuaugauagagagggggacuugauguucacugugacaaucuuucauagcccaggguaaaauagugcauuaucagagccuggcauuguaauuaguuguacauguguggaaauacugaccuaucaacuuggaauaauucuucacuuuuuuuuuuuuuuuuuugagacagagucacagucugucgcccaggcuggagugcaguggcgcaaucucagcucacugcaaccucugccuccuggggucaagcgauucuccugccuuagccuccugaguaacugggauuacaggugcgcacugccacaccuggcuaauuguauuuuuaguagagacaggguuucaccauguuggucaggcugaucuugaacuccugaccucgugauccgcccgucugggccugccacagugcugggauuacaggcgugagccaccgcgcccggccauuucuuaacuuuuaaaacaccaauaaagcauucuggcuagauauaaauaccuguccuaagaugaggcauuuuagagucuugaagcaucccuuauauacauuucuggauguaacaugaagagguguuacaauuuuuuuuuauagcuagucauugcuguuucaggggucucauuagaugagaguuaugcuucauuuugguuauugccuuuuucuuuuuuugagauggagucucacucugucgcccagguuggagugcaguggcgcagucuccgcucacugcaaccucugccuucuggguucaagugauucuccugccucagccucccgaguagcugggaccacaggugcccaccaucauacccggcuacuuuuuuguauuuuuaguagagaugagguuucaccauguuagccaggauggucuugaucuccugaccucguugauccgaccaccacagccucccaaagugcugggauuacaggcgugagccacugcgcccgaccaguuauugccuucuugacaaucccauuuuuugaaguuucaguguaugaaaguauaaauuaugcauaguacugaugucuauucuaacuccuguuuucuaaaaauuaacuuuccucguugugauauuuauuuauuuuugagacaagagucuuacucugucacccaggcuggagugcaguggcacgaucucggcucacugcaaucugccuccuggguucaagcgauucuccugccuuagccuucugaguagcggggauuacaggcgugcgccgccacacccagcuaauuuuuguauuuuuaguagagacaggguuuugccauguuggccaagcuggucuugaacuccugaccucaggugaucugcccaccucugucucccaaagugcugggauuacaggcaugagccaccgcgcccagcccauugugauuuauuuuaacauuaaaugcuaauagaauuuugauuaaguguaguaauguacuacuggagaggguaguagauguuaagaacuugggcccugaggucaaaccuggcucugccauguucaagccgugugacauugcagaagacacugaagcagagccucauuuuucucaucucaggaaaugugcacaugaugauaguagcauaugccucuuaggguugugagaauuaagagcauuuacuggccaagugauggaaauggucucaagaaggcaaccucaaaugggacuuuuacucaccagcaaguuugccuuucagugacuaagccugccuucuacaaaagaguugccaucaaaucacaguuuuuucauuguuuuuaguaccagcacuacugacauuugagccuguccuguucuaguaucaucgaggauuaaacaauuauuaaagcacuguauauagugagggaaagauuccacuuuucuccaaaguaacuuuauccucuugauuauuccauuucuucucucaauuggaucuuugcuuuuggcuuuauauauucacaagccuuccaugagaaaguaaaagaacaaaacauacucauuuuccuccagcuaucuuccagauuuccuccacuucaaaaucaaauucagagagcuuucaaauagucuguuugcuuccauuucuucaguucuuaauuccugacaugccucaagcagcuccugucaggucaucagugacuuccaugacacucaaucaguccuccucuuauuugaccuuucuuucagcauucugccugcuggcacacuccuuucuuuuugaaauggccuuuuucuccuuugacuacaauuucccucuacucccuagcuguucuucucuuuaccugggcauuaaaccuugcaguucuuuaguucuagcuuuagcuccaugcuuaugucacuuaauagcucccuaagcagucacaugccugcuccugacuucaguuuccauuuacagaugucucuuuaauuuguaucuucaguugguucagacaguuccucuuuaguugcagccaugggaaauguggacuuuuuuuuuuuuuuuuuuuuuuuuuaagaugagguuuugcccuguuucccaggcuggagugcaguggugcgaucucggcucacugcaaccucugccuccuggguucaagcaauucuccugccucagccacccaaguagcugggauuacagauguguaucaccaugcccggcuaauuuuuguauuuuuaguagagacaguuucaccauguuggccaggcuggucuccaacuccuagccucaagugaucugcccaccuuggccuccagagugccgggauuauaggugugagccaccacgcccagccuaauuuggacuuuuuaucgucagaucuugguagccuucgcuccaccacuagaagucagaacuuuugugaaaucgauugacuuuuaaauguucacaacuaauuuacaaaauacaugggauaaauaagagauguauguagacuucuaaugagugucuuauggugugagagguggucuuuuuguuguuguuguugaaaccgucucacucuguugcccaggcuggagugcaguggugcagucuccgcucgcugcaaccuccaucuccuggauucaagugauucuccugcuucagcuucccuaguagcugggauuacaggugcccgccauuaugcccguuuaacuuuuguauuuuuaguagagauaggguuuuaccauguuggccagacuggucuugaacuccugaccucaagccaucugcccaccuuggccucccaaagugcugggauuacuggcaugagugaccgugccuggccugagagguggucuuaauuccucuuuuuaauaaguggucauguugguaaaguaaaugaauugcuucaucaucagucacauaaugacgaauaugaauuuccuuuuuuaaaguguauaaggagagaugaaauaaucauuguauauagguuaaugucauguaaugaguuuuccuaaguagguccaaucaaguuaaauuaauuugcagaauauuuuccuccuacaggagggguaugucugacuuagaauuacacuugaucuuagccaaaaggcugagaagcaaugaacugacaacugcaaaaaccauucaggugaggguggcaaaaugauuuuaaguuagcuuagguauuuuccuacuuguaauaaccuugcugcuaaugucuugcuuuccuuccucuccacuccuuaguauguccaauaguaaaccacuuuuuaaaaaauguucaauuaagaguugguuuuuuuuguuuuuuugguuuuuuuuuuuuugagauggaguuucgcuguuguugcccaggcuggaguucaauggcgucaucucagcucacugaaaccucugccucccaagcucaagcgauucucagccucccaaguagcugggauuacaggcuccugccaccaugcucagcuaauuuuuuuguaguuuuaguagagacaggguuucaccauguuggccaggcuggccuccaacuccugaccucaagugaccaacugccuuggccucccaaagugcuaggauuacaggcgugagccaccgcccguggccaagagaguuguuauuuuaagcaggggcuagaaacuuuaaauacgcauaguuccagauguguaaaugauuuaaaguaaacuaggagggaacuagugaauuccaguccugaccggcagcaucaccucauaaggaacguagaaucuuaagcuccacccuucagagucuacauuuuaacaagaucuggagguaaucugugugugcauuaaaauuguagaagcacuugagaacuuaggcccaaaagguaacagucacuuugaaucuucagcugaguuuugcuguguuaucugguuuucccaagaguagucagaagucugacuuuauguguaaaaccacccaguuuuuaaauggccacaaauuaacauguuuuuaaaaaaaucauguccauggggcugaguuuggccuguuagucaucaguuuugcaaauccugguuccagguaugcuuuuuuuguuugagaccgagucucacucuguugcccaggcuggagugcgguagcacugucucggcucacugcaaccucugccuccgagguuuaagcgauugggauuacaggcaugcaccaccuugccuggcuaauuuuuuuguauuuuuaguagagaugggguuuugccauguuggccaggcaggucucgaacucuugaccucaggugauccacccgccucggcuucccaaagugcugggaucauagacaugagccaccgcgccuggcccggguaugcuaauuuuuuggggggugccugaacaaguuguuauaggagauuguuuuguucuucagcuugaucgugguguacuggaguccucaaagagucugccuucucagucucugcaagcuggcuuagguucugcauuuauacuuauauaauauuuaacuguauaaaaggcauucauuuaucuucccugcaggaggaggaacaacuagaaucacuacaaggucaaauucuuucauuucacugguacuguauagcuagugcuacuuauuugaaguaaauuacucaauuuguuaaaacccugcagguaaauacacauuacauuggcccuguggcugugguuaauuggaauagaagcugaaccuucugccuuggaaccaaauguuucuguagcaugcacauguuggguuuuggauuuggggcaguucaauuuccccuucuucuccauuuauuguguguuuuuuuuauugagacggaguuucacucuuguugcccaggcuggagugcauuggcuuaaucucggcucgcugcaaccuccaccuccccccggguucaagugauucuccuaccucagccucccggauaacuaggauuacaggcacaugccagcaugcuuggcuaauuuuuuuuuguauuuuuaguagagaugggguuucuccauguuggucaggcugaucuuuaacucccuaccucaggucagccgccugccuuggccucccaaagugcugggauuacaggcgugagccacugugccuggcauuuuuuuuuuuuauuuuuuuaaagacacggucuugccaggcacgauggaucagccuguaaucccagcauuuugggagacugaggcgggaggaucaccugaggucaggaauuugagacgagccuggccaaccuggugaaacucugucucuacuaaaaauacaaaaauuagcugggcauaguggcgggcaccuguaaucccagcuacucuggaggcugaggcagaagaaucgcuugaacccaggagguggagguuacagugagcugagaucacaccauugcacuacagccugggcgacagagcgagacucuguccccccacaaaaacaagaaaaaaaacucaagguuucacucuugccuaggcuggagugcaguggcgcuauuguagcucacuguagccuggcacuccugggaucaaacuaucuuucuaccucauuuugccaauagcuggggacuaaagggcaagccaccgcaccuggcuaauuuuauuuuuuauguuugguggagauagaguuuucacuuuguugcucaggcucgucuccaacuccgggccucaagugauccuccugccucggccuugcaugagccacugcgugcagccaugcuuucuuuguuauuacucuauuuugauagcuuguaaguuauuugagaaaauacuuaaaaguaguuaagagcuacauaacaauagcaacaagguuaauguauccccuuaguguaauauaagcuggagguguaaaacuuacauuuaccugcagaguuauaacaaauugagucguuucuuucaaauaaguaaucauuggcuauauguaccagugaaauaauaguauuuuaaagugaauuuaaaaugguaucagcucauucuuuauaguccaauagcucuugguuggauaagaauauuguccuuaagauucaaucaaggagaacauaacuguuuuaguuucugcagagaugauccugggaaaauagccaauuaauaaagaugggucuccauagcaacuccaaguaguguguuuuuuuuuuuuuuuuugaaacggaauuuugcucuuguugcccaggcuggagugcaauggcuaauuuuguauuuuuaguagagacaggguuucuuggaguuggucaggcuggucucgaacucccaaccucaggugaucugcccaccuuagccacccaaagugcugggauuacaggugugagccaccacgcccugcccaaguuguguguuuuaauuuagaaaguagucaugacaguaucuaguauguaguucagaacuguacauugcucuguuauuuuggaacagugugucuuaguuuuaagucuuaaugacuauugcaaguuuucuuuacuuaauuauguacagguuuccauaucauuuguguuccugacuagaacuggcagacuuucaagauuuuuuuuuuuuuuuuuuuugagucuaagucuugcucugucgccuggcuggagugcaguggugcaaucucgguucacugcaaccuucaccucccguguucaagcaauucuccugcuucagucucccgaguagcugggauuacaggcgcccaccaccaugccuggcuaauuuuuguauuuuuaguagagacaggguuucgucauguuggccagccugaucucgaacuccugaccucaggugauccgccugccuuggccuuccaaagugcugggauuacaggcaugaacuaccgcgcccggccacaagauuucuuuuucaauuccauuguuugaauugucuuucuagguccacuuucauuuuguguuuuccaaagauauuccauggagaaauaaaugguauugaccuauaaaaugguacagaggggccccauacaccuaaacuuaaaacuguucgcgaaaccguaauguuugaucuaguaaugaugucuggaggaaaauaguaaagcuuugugggucuggagcagaaguuucuaguuucacaugucagauuuuuagaacuuaaauuuauggacccuagaaagauauuuugacaccccaccucccuuccuuugugguucuccuuaaacuuauuuuuaguugcuucuaauuccauguucuucccuuugcuuggucuuaucuugaugcuguuuaucuugcccccaucaauuccauuaugcuuuuuaucccauaacuacauucuccuguuuauauuguugaccuuauucaugguguccagcauuuccuaaguaaucaguggcaacuaaaaagaggccuuuucuuuccacauuuaccuuauuuauuuauuuuuuugagacagaguuuucauucuuguugcccaagcugcagugcaguggcaugaucucagcucacugcaaccucuuccucccggguucaagcaauucuccugccucugccucccaaguagcugggauuacaggggcccgccaccacacccagcucauuuuuauauuuuuaguagagaugggguuucacuguguuggccuggcuggucucaaacuccugaccucaagugauccuccugccucacccucccaaagugcugggauuaaaggggugagccacugcaucuggccuccuaauuuguuguuaaaaauauuccaaaggaauaggugcugaccuguugauacugccuaccugcuaaggagaauuuuauuagcaauuuuagugucauguacuagguuugagaaugaaaaugcugugaguuguagaacuugcuaauaaugacuuccauuuagcaguauuuuaugguaaaagaguaagguaguuuuuaggauuuagaaaaagaauauauagccauuugugugcuuuagcuuuucuugaagauaacucuagauauuuugcucuaaaugguugcugcaaauucagucuaugccucauaagccaaauaggaaggcauaugauuaaaacuggaauaugcaacugauaauacaagugaagcuuggacuucuuuuuucuuuaaugaacuguaaauuguguuggcaagacaaugucagauauuacauguaccuuggauaaaauauuaacuugcugguaugauaagagauggccagaucuaaguagcuuaagacuaaguaggcaaguacuugacugauauauggaaggccuuuaucuaccugguaugaaagcaacucagguuagccaaguaucuagaucgagcuuagcaauguaguuguagaauauugaaucugaggaaauuucuugaguuaucagcuucaagacuguuuauaucccugaacugaaauaaauugagcuugaggccauugcaguuagcuguuugcuacuugugcaguugagaucuuggccaaguuaaauuggacccuucacugcauaacauuguugaucacauguuaccaguauuagagcauuugagggcacaguguggcuuagaugacauaguugcaucauauuagauguaaaaagcaaugcaggcaauaguauuaaaaauucuucagcucuuuagcugacaauaucaaguguuggcaaggauguggaacagcuggagcuguaauacuuuuaugguaggaaugcaaaaugacaaaaucacucuggaaaaugguuuagcaauuuuauuuuguaagaacaaaauaaacccuucauuugccauaugauuaggcagcccauucccacuccuagguauuuauccaagagaaaugaaaacauguccaccaaagacugguacuugaauauucguaauagucccaaauuggaaacagccuaaauguccauuaacaggagaaaggcuagcuguguguguauauauacauacauaugauggaauacucaccaauaaaaaggaauuucugauucaugcaacauacaugaaucucaaaagcauuuugcugagugaaaguaguucagacauaaaagucuacacucuuuaugauucuauuuaugugaaauucuagagaaggcaaaacuauguaguaauagcagaugaguguugguggacuguaugggggaguggugauauugguagugaauuaacugcagagaagcccaagagaaguuuuuggagugauaaaaaguuauuuaucauaguuacguuaguuccaaaacuguauguauguacuugucagaacucaaauggauuguacauuuaaauuggugaauuuugucauuuguaaauuauaccuuaaaauuguuagugaugucccuaaguaucugaugguauggaguuuuacaaagauaaaauuuuuaaaaguuuuaccguuucuuaauucuggguuagcuuucauuugagauuaucaaaugaacaaauugagguuguuauuauacaagcauucuuuugguacauuuuaguugugcuuugguugacuugugaagcagaaguaagacuaaaucugagaacagcuauguggugauaaaagaacguauauaagucacacaaaagauaaauauuaaggucaaguuacuccaaacuaguaccucuuaacaucucugguuauaaauaaauuuuaugauguuuugaauggcacuuuugaucaggauaaugguagcuuuggacagaaagugaugaauaugagugaagcuuacucucucucagcaaaauagaauggcugggcacgguggcucacacuuauaauccuagcacuuugggagaccgaggaggguggaacaccugaggucaagaguucgagaccggccugaccaauguggugaaacccugucucuaccaaaaauacaauuuagcugggcaugguggcucgagccuauagucccagcuacuugggaggcugacgcaggagaauugcuugaaccugggagauggagguugcagugagcugagaucacgccacugcacuccagucugggugacagagcaagacuccaucucaaaaaagaaaagaaaagaaaaacccuuuagauuguuguuacugaaaagaggucuguuauuaaaaaaugaggauauuuguguuuauccugguugauacuggauguuacauuaguuuuauuggguaccucuggugaauauuaggaaacccauuuauaucaagguaugcuuaccauucaguagacaacuguuucaugccaacacugauaauuuaauaauuuaacgacugucacucgauuggaguaacuuuguuuucaaauuacaaaguaguucaaauaaauggaaaagaacugaaaaugagcauaacccguauuaaacaaauguuaacaaaugaaaaauguuaaauacagcuaaagcaccccgacauaaccauccugaaauuaaucauuauagaccuguuuauguacacaugaaugagugauuuuguacuuaaacugcacauucguguauguauaaacaggucuuuuuauacaacaaaauuuauguaaaugguaucuuuaacuggauaugucuugccacuuuuuuuucaguuuaaauaaugaaacaggcaguaucuaaaauguuuaaggaacuuauuuguccucccagagucucucaaaaauucuaaaaguucuucuccuagggaaauaaagugagaaaauaagugacaggauuuuguagauauggugguuaucuacgaaaaccaccaguauuaaauuuuaaaaagaauuauuguauguaaaucuuuagcuuucuuuuuugugugucauaaagacacggucccucuauguugcccaggcuggucucgaacucuuggccucuagugauccucccaccuugaccucccaaagugccaggguuacagguguugagccaccacacuugaccaauaucuaacaguucuuaaauuaaugcaucauuguagaauugaauguuaaggcuacacuccacucuaucagucuuuuuauugccaccuaaaaauuucauuuuuguuuaaucuugcuuuggauuuugguuaguaaacuucuagggauguaguuucacauugauaaccuguuaacuugggagcuauggaguauggagguguagugaggaagucuggaaggggaguggaaaccccuaggcagggauuuucuggaggggccagaugguaauuauuuugaguuagaaaucuuucugaaaugaaucauaguggccuaaaggaugugccagauauaauuuuacucauuugugugauugugguucaagauaauugcacugugguauagugguucuuauuuauugaggaccugucauguaccaaucacuuuacauggucucccccucacccuacccuccagccccaagauucagaaugcuguaguauucuuagguuuuauugagcuuaaaauaauuggccauggccauuuaauguaugaugacuuuuuaaguucccaucuacuuugucauuuuguugaccuauuaucacuucagacuguugugugcuugaauauacauaaucucccaagccccuucuuauuuaugggcuuggaaaaggcauaaaggcaguaaaggcaguuggaaaagccuguuaguguaauaguucuaugugaugaauaaaugagcuuuaaguuuggaacucuuaagaaucugaguaaaauagguguuuugguucacagacuccuugaccauuauuuugacugaaaaacuuuauuuuugcuagucagugcucagcaagaauauuguugaacagcugaauuccaguugguguguaugugcuaagugaauguccccauuuaugcugaaaugaguuccuaccaaaaugucaguuuucuggauauuauuugaaaggaguauuuuggguagauuggucuacuaaauaauguuggaaagccaaccucuuuuuuaaugugaaaguuuuuaucuugccaaauuuuaacuuuuuuauuuuagaacaaauucuguacaacauaaaacaagaguauaaacgaaugcagaagagaagacauuuagaaacgaguuuccaacagacagauccguguuguacuucugaugcacagccacaugcauuucuccucaguggaccagcuucaccagguaauaacauuucuugucauuuacaaaguuuauuauuuagagugggaaaagucuaauccaaguugucuuuagucauuuaagcuacuguaucuccucugaguuuuaaaaaaacauuuauacaaguaaugcaugacaucuuaaaaaauaauaugguacaaaauaaggaguuaccacuggauucccacuaaccagagacaaccaccugcauauaauauccccaaaguggacauccuguaaguacuaugauuuguagccuuuauuaaaaaaaauuaacaauaggccaggcacgguggcucaugccuguaaucccagcacuuggggaggccgagcgagguagacaggucacuugaggucaggaguuugagaccagccuggccaacauggcaaaacucugucucuacugaaaauagaaaaauuagcugggcgugguggcacgcgccuguagucccagccccucgggagccugaggcaugagaaucacuugaacccaggaggcggagguugcagugagcugagaucaugccacugcacuccagcuugggcgacagagugagacuuugucucaaaaaaaaaaauaauaacaauacuguaugcuccuuuguuagguauagauguaccuugucaugacugaacacuuaaugauagauaauucaacuuagaaguuuugcugguauaguauuuuaagaacuaucccuguauacauacccugccucacacacuugucuuauugggcuagauuucuaaagguggauuauuauuauuuuuugauccuguaucuguuuuuaccuacuuuuuguuggggggaauguuugcaaauaaccuuccuuuuuuuuaaaaaaaaaaaaaagggggggggcggggaauaagggcuacuugaagcaaagagaaaguugaagguuuugcugagagagagccaucaauaguggcucuuaucuuuaguaaaguucucaggaaaauagcuuuucuugugacaacaguugccuuuguucaacgcuuucucuccucccccuagcaagggaaggaaaaccuggcagaauaaaaaaauuugcggcugggcgcgguggcucaugccuguaaucccagcacuuugggaggccaaggcagguuuaucacgaggucaggauaucgagaacauccuggcuaacacagugaaaccccgucucuacuaaaauccaaaaaauuagcuaggcaugguggcaggcgccuguagucucagcuacugagguaggagaauggcaugaacccgggaggcagagcuugcagugagcagagaucgcgccauugcacuccaaccugggugacagaaugagacucaaaaaaaaaaaaaaaaaaaaaaucaaagaccauaacauagucaaauaaaauuagauuaggaaacaugaacuuguucaaaacuaaauacugccaugcccauugugggggccagguauuagugguugaaacauagaggugaggguugggcacuagacuguauuagcaggaaaccaagaucauuauuuccuuacucacuuuacuuagaagaucaguuaacuggcagucuuaaguaacaaagcugggaaugugaaaguaaauuaagauggcuuuggauaauuauggaauaaagcuggugggcuuuguuauugugguaugcacaguucuaauaagcauaguuaacuagcuccugccaugcagguuauaaggagcaaguuaagagaguaaguaauauuggugguaccagggcaaauucacagagcgagaugaagaaacaauugguaacgaauggugcacuugaauauguauaaaauacuuuuagcaguauuacaguagauguuauuacuacaaaauauuuucucuuuuauuaaaaauauccuaauagguauaaaaaugcugaaggaauauuugaaauugacagaugcugauguugcagcugcuuugggauucuuagugugaugacaguguaguucuaugguauagaguuuugagcauagcauuaucagcucaaugcuugagcuuauuuuuccaugcgaauuguuguuaacuuaaugggaauuaguggucaaugaguucaaaaaccuuuagaaucauuuaugcuucuccagcaaaguagauuucagaaugucuuguuuuguuuuguuuuguuuuugagacagggucucacuccguugcccaggcuggaguacaguggugagaucuuggcucacugcaaccuccaccucagccuagccuguagcuagaacuacaggcacgugccaccacucccagccaaucuuuguauuuuuauuagagacaugguuugccauguugcgcaggcuggccuuuagcucaaggguuccaccugcuucggccucccagaaaguacugggauuacagguaugagccaccacacaagcuagguuccagaauguuuuuuaaucuuuucuaaaaaggauucaugcuguaccuucuuuuuuuaaacauaaaaauuuauugugccaacaugaaauuucuuuuuuuuuuuuuuuuucugagaugaaguuucacucuuguugccuaggcuggagugcaacggcaugaucucggcucacugcaaccuccgccuccuguguucaagcgauucuccugccucagccuccuaaguagcugggauuacaggcaugugccaccacgccuggcuaauuuuguauuuuuaguagagacuaaguuucuccauguuggucaggcuggucuugaacuucugaccucaggugauccgccugccucggccucccaaagugcugguaauacaggcgugagccaccaugcccggcguauuuucuuuuucaauaaaggaaaaccccuuucuaaaggugugaaaugaugguagaauaauuaccaguucauuguguguaggcucuuaagauauuaaugguauggcuuugaagacuaagugucuuuuuacaggcauaaugauuuguuauucugggacuaaauaaaauuaaauuuagaccugagguguucuucauuccuaguguaggaaaguaauuuagucacuaaaauacuucaugguaugguauuuuccagaaaggagauaagauguuuuguaaugggacccaucauuguaauguuuaaguuuuaugucuuuuuuaaauuuaauuuuuaauuuuuuguuuuuauuuuuuugagauggaguuucacucucuuugcccaggcuggagugcaauggcgugaucucggcucacugaaaccuccgccucccggguucaagugauucuccugccucagccucccgaguagcugggauuacaggugcccgccaccaugccuggcuaauuuuuuuauguauuuuuaguagaggcaggguuucaccauguuggccaggcugguuucaaacuccugaccucaggugauccgcccaccucggccugauuacaggcggugagcaccacgcccaaccuuucuuaugucuuaaaguuuuuucuacucaccuuuagucuuuuuuaucuuaauuacaucuugccguguuuuuccagcgucaccagcugauggaauuauuauuuugguuguuuuaagacuugugaaaugcugugcuuaaaaucugauuuuaaaaugcuuuuauaucaagauugaagagauccaaauaaaaccucuucauuuagaaacugcuuuauaucauggcucuaaaccaggugcuauuuuuuguccucauuguacauagggacuucaucugcagcauccucaccauuaaaaaaagaacagcccuuauuuacucuacggcagguugggaugaucugugaacguuuguugaaagaacgugaagagaaaguucgagaagaauaugaagaaauauugaacacaaaacuugcagguaugagguguguuuauuagaguuucugaggaacucaguugugugaaaugcauuuuccacguguacuuuaauuucacuuucuauacacuggugcgguauauucucugagaaugagaaaauuucaguucaggaaagaaaauuaaccuucuuauagcucaugcccgccuugguaaccugaggaaaagaguauuggcuagccguguagaucagcaguaauauuaguagguacccuguacuaaaaacugauguuaguaguuuaccucaauuugguuguggauuuuuugacuuuauauuuuucauaacguuaccaucaauguagacauuuaaaauaucuaauuggcugucacuguguaagucauuggaguaucaaacuggaguccuguuuuaguuaucaaaaaauucaguaaaauuugauaauuuaaguaaauaaaauuuauuauguaugguaacauaaauagaauguuuagccacagauuuacuguuuauauagauauguaagcuuuuuuauuuuaaggaauuaauauagagguguuaauguagagaagauaauuugcuuagauauauaacaacuuuuucugugauacuugaucagguuuuagguaguguuuuguuguuagcuuuuguuauccuauucucauugcagucaguugccauucauagaccacauacaauaacuuucagaguagaaaggucuuuuuauugaaaguccuuuguuuuuaauuuuuuuuuuuuuuuuuccugagacggagucucacucugucacccaaggcuggagugcaguggcgcagucuuggcucacugcaagcucuacuuuccggguucacgccauucuccugccucagccuccuguguagcugggacuacaggcaccuaccaccaugcccggcuaauuuucuuguauuuuuaguagagacaggguuucaccguguuagccaggauggucucgaucuccugaccucgugaucugcccgccuuggccucucaaagugcugggauuacaggcguaagccaccaugcccggccaauuguuuuuuuuuuaagauggagucucacucugucgcccaggccggagugcaguggcacgaucuuggcucacugcaaccucugccucccgggcucaagcgauucuccugccuuaaccuccugaguagcugggacuacaggugugugccaccaugcccagcuauguuuguguguguguguguguguguguguguguguuuuuaguagagacgggguuucaccauguuagccaggauggcuuugaucuucugaccucaugaugugcccgccucggcgucccaaagugcugggauuacagcugugagccaccgcgcccggccucguuuuuuuuuuuuuuuuuuuuuuuuguugcccaggcuggagugcaguggcgcguucuuggcucacugcaagcuccaccuccuggguucacgccauucuccugccucagccucccgaguaguugggacuacaggcggccugccaccaugcccagcuaauuuuuuuguauuuuuaguagagaugggguuucaccguguuagccaggauggucucgaucuucugaccuugugauccgcccgccucggccucccagagugcuuggauuacaggcgugagccaccgcacccggucccagccuuuuuguuaggaaauaaauaaaucucaccuagccuuuaugucaggucaugugauuggacuaaaaccuagguuuccugacuaauaaguugcaugcuguuuuuauuugauacacuauuaguacuacugagguuauguaagugauuuugucaacuuagaauuguuuuacuguauauuuuguguuuucaguuuaucuggcucuaauaaggcauuuuacaaauguaauugacaaguaccuuuauuuauagaacaauaugaugcguuugugaaguuuacgcaugaucaaauaaugcgacgauauggagaacagccugcuagcuguaaguauuucaccuuugaaguuauaaacugaaaauaagacugucuuuuaaggagaagacauuauaauuauuuucauacucaaaaagagaauucaacaaaauuacugagaauguauggaggaaauaggcagcauaacuuugcaagucuuuugguuacuuaaauaccuaggggcaaaauugggaaucaagaucuaguauucguuuggauuuugaccuguauuuugcacuaauuuucuuuuucucacccuuuagauguuucaugaaucacguauccugcauuugugggcugccuuguuccuuguugaguuguugcaagaggucccaauuaugacaugcagcaaugccaauaccccuucugugaauacagguuauuucaagcuuucgucaguggcaaccacucuuaggcagcagcaacugguuuuggaaauuucccugaugucaguaccaccuggauguggaccuuugcuaccuguauuaauaccaguggccucauuuugcuguaucauuacaauuuggcuucuuauauuaauguuugaaaaggauuaaagcugguauucuagaacaugcccuucacugguuguguaaauaaaacuguagaaugacacuucagaugaaguuagugugauuuuaauugugcacuacaaccgagcuguaaccaguuacuaauuuuagaauguaaucccaggacaauauuaagcaaauagccugcagugcuuccugugaaauagugaaggaggagggcauuucuguauuccaggacuucuugggguuucagaauggguuuguaugauuuuuuuuuuuuuuguaguuuuauuuauucuaucagucuuuuuaacaaauguuuauugcugcauuuuuuuuuuuccaguguaucauuguuuuacugcccuuguaguacuggaauuuaguuggaagaauaaaacauuuacuucuauuuugcuuguuucuuaauguacagaugggguuaguauuugaauaaaguugguguuuuaaaacguaagcauuuuccaggaaucagugaaguuaauuuucuaagauuugagugcuguuucaaaacacugaguucugauucuaaaugccuucuucugcugggcgcgguggcucaugccuguaaucccagcacuuugggaggccgaggcgggaggaucacgaggucaggagaucgagacuauccuggcuaacacagugaaaccccaucucuacuaaaaaaaaaaaaauauauauauauauauauaaauuccuucuucuguaacuuacugccugauagaauguuacagguauuuuaauugcuauagaauuaccucagauaucaguaggauccaguuuuuucuuuuaagaacuugauaugcaaaagcaugauucagcaaauuugacucccuuuccauacaugguuucuagacauagcuuucuuauaaugaaguaagcaaaaacaugcuucagugaauucauuuguugaauucuaguagcauauuuccaaaauuuaagacaaucuuaaauacacauuuauaacugaccaaguuagaagaaaaaggaauuuuuuuuuuuuuuuuuuuuuuugagauagaguuuugcucuuguugcccaagcuggagugcaguggcacgaucucggcucacugcaaucucugccucccagguucaagcgauucuccugccucagccuccugaguugcuggcauuacaggaaugugccaccacacccggcuaauuuuuuguauuuuuaguagagacaggguuucaccauuuuggccaggcuggucucgaacuccugaccucaggugaucugcccaccucggccuuccaaaaugcuggcgugagccacugcgcccagccagaccucuuuuauuuuuagcuuugguaauuacauuucaccaauucucuguuuaaaacaagccuagaaagugguuucacaaggugcccaggcaauuuauaugccaauuagugguugagaaacauugguauagcacaggguagcaauaaggugcaugauucuaugcccuuccccccuacuuuuuuuuuuugagauggagucuugcucugucaccaggcuggagugcagugcugccaucucggcucacuguaaccuccgccucccggguucaagugauucuccugccucagccucccgaguagcugggacuaccggcaugcaccaccacgcccagcuaauuuuuguauuuuuaguagagacgggguuucaccauguuggccaggauggucucgaucucuugaccucaugaucugccugccucagccucccaaagugcugugauuacaggcgugagccacugcgccuggccaauucuacccccuuuuaauggucuagaacagagauucucaacuucagcacuacuggcaguuugggccagaucauucuuugucgugguggcuauugcugugcauuauaggauauuuagccacaucucuggccucuaccacuagaggccaguuaaacccccucccacaauugugauaaccaaaguguuugcagacauugccaaaugucccugagggacaaaacaguucccagcuaagaaccacugguuagcaggauagccuguagucccagcuacuugggaggcugaagcacgagaaucgcuugaacucaggaggcagagguugcagugagcugagaucaugccacugcacuccagucugggugacagagugagacucugucucaaaaaaaaaaaaaaaaaaaaaaaauuuuuuuuuuuugcuccacagccaaauuucugcauuaucacuuaugcaaaaguccuagcuuaugggcuacucugacuuuagauggguccgguaguugauuaguccaaauaaccaaccacacaugauuucaauagauuauuuuagcuaccuagggauucugaauuccccaaaucccugaaauugcuuguaauaaguaucuacagaauuguguuaauagucaucuuauucuuccaguaaaaggcaguacugauacaguacuguacuaugauguguuuaguaaaucuuuaacaagugcacauagguauaagcguuuguacuuuuggaaaaauaggcaaucugagaaaaauaaauauuggagguuuaaacuacuaaagcugucuuuggccuauggcaagcacuugacacgacccuaaagaaaaugguagaagguucucaggcucuaccuauccccagagacugcuuuagacaauuggugggaggggagaacuuuuggaaucuguuuaauaugcugccuaggugauuuaagcagcuaggguuggaaaugacuuguuuuugcccuguuuggguucucuuuacuccuuucaaacucuuacaguaauugguauuaaaugaauauucuacaaaagcacccgaauagucuaugucuacucauggauacauggcucccacaauucucuugcuccugcauuugccccagguaaggagcacgagaugcaaaccuaugucucaggcaaagauacagcuccagcaguccucuccucucucuacugcaucuauuuucuuucucuacuaaaucauuuccaaaagcauaauaagcauguuauuaaaaaaucuuuugauccuauaucccuugcuagugauuauuuuagugcuccccuuuauaaaagcaaaacucaguuuucuaaacuuccuccaguuuauuaccccuuccuuuuuuuucaccaacuuguuuuauuaggaaaagaaauucaaacagaaaaguugacuuucccacuuaaaauacuucccuaauuuaacaucgaguccuuauuucagauuuuuccaugugucucuuuuuuaaauagcuacccucaucccccaaacacgauucaauuaagauuccuacuuucuggaaauacuaggccuguugucuuguugaguuuuucuuuguacugucauuaauuuuaacuucugauaucccuuugaacuuucuguaaacugaaaggucuaaaguuuucgcaaguuucggguuaaacuuguugugcaagagugcaaggugaugcuauggucuccauauugcaucacaacaguuacggcuuuuccaggcuguuaaguuuggacacuugguuaggucaucugauaggugauuagaguucgucuccucucuguuacucuuaguaaaaggcagcaaagauuuccacauuguuaaaucuaaucagcagccagcauuugaccuugaagcacucuucaguuggcuugcaaaauacuacacuugcuuugacguuucuccuuuacuggcugcuccuucucugucuugcuguuggcccaaucuucauuucccugcauuuugcuaaaacauaggugugcccccgagcuugaccuugggcugcuugccuccucucuuaguacucaucuuggugaucucaucauaaggacaucagauuauauuaacgucuucaugugacaucuucaguuagguaucuaguagacaccucgaaauuuacgucuaaaacuuacuuuugccucugaaauuuuuccucucagucauccucaaucacuuaauggccacuccauucuuuguuucuaggcagaaauggucuugcacuccucacauccuucaucugaucuuaguuccaccuuaaaauauuaacaucucuacugcuauuacccuaauccaagacacuaucauagcuugcuuggauuauuucugugguuuccuaaccggucuuuguuuugccucauuuugucuccucucacccauccuauucuacucucauagcaaccagacugauccuuuaaaagucuaagucuuguuuagauggcuuccuaaguaaaaguaaaacuucacaaaggucuguggagcccuaaauuaccugcacucuaccccaccucauucaauuccuauugaauuccuccugcucacucuaccuuguccacauuggccacuuuugcuguuuuuccagcauaggauuuuuguuacugcuagugucugccuagcaugcucuucucccacaaaacuucauggaaaauuuuuucaccacuuuugacuuuuugcacaaacgucaucucaaugaagccugcucugaccacucuuuaaaauugcagccugacauccuggugcucugcccugcugcuuucuuuguuuuacuuccugugcuaaacgcagugaaggcaggguucuuugcucacuggcauacagugccuggcacauggcacaugcuugguacuuuuugaauguauuucacccuacuucgauucaggguuuucagaucaguauuucauuaaaugaaagauuuaguaaggcagaauacuuccuuuguaagauauuuugguagagguuuccugaauuacagaauggacacagaauugaacuggcauuucauaggcugucuugaggguuuugugcuccauuaaugauuaccacaaaggagcuucauguuuuaauuuuauagcucuuuuguguauucauugugaaaauagggcaguuuucgacugggcacggugguucaugccuguaaucccagcacuuugggaagccuagguggguggaucgcuugagcccaggaguucaagaccagccuggccaacauggcaaaaccccaucucuacuaaaaauacaaaaauuagcugggcgugguggcacacaccuguggucccagcuacuugggaggccgaggcaggagaauggcuugaacccaggaggcagagguugcagugagcccaaaucgugucacugcacucugggugacagagugaaauucugucucgaaaaagaaaauagggcaguugccauccugcuacuuucuuacauaaucuuuagugaggaaagucaaagugguucagggcaugacaugcguuuauguuggauaaauucaacuuagugcccagcagaggaaaaguaaggcauggcuacuuacucuacucagugaaucugugccuuauauaugaaucugcuggucugugugaggccaguuccucuguaccuuacaguguaaaaagcaucuugcuguaugaguguuguucaaaguaauaguuucuaaacacugacaauuuuaucuggugcucauaugcaucauuugaaacuacauuguacguagugaugguguccuuguauuggaagaccuucccuguugccaacuuccuuaccuuaaauagauggaaaaaucauuaaaaucaccuauucuuucccuagauuuguaccaaccauuguuuaaaaaaugaaacacaugguuggaggcaagacuagaagaagaaugacuagaauauugcgaaaaaauauugagcuaauugcuaugaagguaaaucauggaaucucagugacuuaacaugagaaauuuauucuuugaucauauucauuuggugggcuguguuccacacccucacucaaagacccuuagaaugacagaggcucugucuuuaauacauggauuccaaggugucaaggcuucuauuuguccaguugcuuucuaugguaguagugguacuuguguuugcauauaauaaauuccuuaacaaacauucaagcugacaguccuguguacauauguacagguguuuacauucuguugaauaagaaauccuggcaccuuuuaaaugaagaugaaaagauaccuaaucuaacuuaacuaccuacgcuggucauugucuuucccaaagcucugcagggcuaggugcuuucugcucugacuugcaguugauuauuuaugguaccuugggguuuccccuuccuuuuagccuuggcaacauuuugacauuuuuugagauauauuucaucuagcuuuuguuuuguuuuguuuuugagacggaguuucacucuuucugcccaggcuggagugcaaugguguaaucucagcucacuacaaccuccaccuucuggguuuaagcgauucuccugccucagccuuccauguagcugggauuacaggcgugugccaccacgcccagcuaauuuuguauuuuuauuuuauuuuuuugauacagagucucgcucugucgccuaggcuggaaugcaaugguacaaucuuggcucacugcaaccuccgccucccagguucaagugauucuccugccucagccuccccaguagcugggauuacaggcgcccaccaacacgcccagcuaauuuuuguauuuuuaguagagaugggguuuuaccagguuggccaggcuggucucaaacuccugaccucacgugauccacccgccucagcuucccaaagugcugggauuacaggcgcgagcugcuguacccagcucaucuagcauuuuuaugugcuuaaagcagggagugagguggggagggugagcagcuacccauuaaugucaucucagcccaccacgcugccagaggucuaagguguucuuuauucuaagcucauauuaauaccuccuuuuacauuccugaaugaaggagguuugauuaugcaggcugaauaucccaaauccuaaaucuuaagugcuccaaaaucugaaacuuuuugcguacugacaugcucaaaggaaaugcucacuggagcauuuuggguuuuggaugcugaacugaacuuguuaaguauaaugcaaauauuucaaaaucuaaaauccaaaacacuucuguuuccaagcauuuuggauaauggauacucauaaaacucuucaaagccugugagcacacacacgggcacacacacauaauccugcaaugacauaguucuaagguuugcaaaccaaguuuuuucuggacauggacuuuccccccauaucugcaugguaauuuuguauguuagugaguagccuuaaagucccauaauucucuugggaguagagcauuaaauaaugaacuuuagcuaucuuuguuucauuaugucuugcugaguuucugccauagaagagaucgagaugucauuucaucugggccuuacuuugcucaucugaguuguauuuguuugggaugugauuuguagaggccuuacuggcuccaugacaggucaucccgaaguagaauauuuacugccuaaauaaagccaaacaguuugggacuuuuuuuuuugacacggagucucacucugucacccaggcuggagugcaguggccgaucucaguucacugcaaccuccgccucccggguucgagcaauuccccugccucaggcucccgaguagcugggacuacaggcaugugccaccacaccuggcuaauuuuuuguauuucuuaggagagaugggguuucaccuuguuggccaggauggucucgaucuccugcccuugugauccacccgccuuggccucucaaagugcugggauuacaggugugagccaccacgccuggccuuuuuuuuuuuucuuuaaaguuguaagacuacaggaaauggagaggcagagacaguuuuggaaccuauguagucaccaggagaaacaaccuguaagauauucauguuacuuacugccuacuacacuaaagugaggaaugccaaugcagggaauugggagaggaggaaugaggauugcuaaagcaacugcaaauaauuuauacuccuggauaacggaauuuauuacauuuacauacucuaaguucaagaaugauuuacucacaauuuaguaaugacuuuggaaaguacaguaaaaugugugagcaguuuuaguuacauuauuauuuguuggagucuaaaguacuccacagguguuuugauacaugccuguuugggguuagcaauguacuuuucugguuaaacaucaauggggguuacacauuuaucuucucaacaaaacaggcuccucuaauauauguaaauaugacuggucaccuuuuucucuuaagcuaaaugugauaguucuggcuuugcuuauuugcuuucuagcagccuccccauguuagucuugccacauggucagucuucuguuugguagguuuuauaaauccuaaaaguucuaguucagaaacagcucuaauaaaccgagcacuggaggcuuuaauuaaggaaacuggccgugcuguauuuuugacaaaaagggauuaaaaucucaauguuaaaauacuaguugguaaaaugaaguagauaguucagauauaaacuccuaaauuaaacuauaacuguuacuggaaaacauuaauuagaauccacuaucaauaaaacauaaauggaaaaguacuuaaugcuuccuaaaucuaauguucuacauaguauggaaauugcuccccgcccccacuucuaaacguacauuagaaaaauagagaauucagaccaggucaguggcucacaccuguaaucccagcacuuugggaggccgaggcaggcagaucaccuaaggucaggaguucaagaccagccuggccaacauggugaaaucccaucuccccuaaaaauacaaaaauuagccaggcaugguggcaggcgccuguaaucccagcuauuugggaagcugaggcaggagaaucgcuugaacccgggagguggagguugcggugagccgagaucgugccacugcacuccagcuugggcaacaauagcaaaacucugucucaaaaaaaaaaaaaaaaaaaagaauuaggccgggugagguggcucacaccuauaauccuagcacuuugggaggccaaggcgggcggaucacaaggucaggaguucgagaccagccuggccaacauggugaaaccccgucucuacuaaaaauacaaaaauuagcugggcuugguggcaggcaccuguaaucccagcuacuugggaggcugaggcaggagaauugcuugaacccaggaggcggacguugcagucagccaagaucgcacuacugcacuccagcuugggcgauagacgagacuccgucucaaaaacaaacaaacaaacaaaaaaaacaaaaaccaaaaaaagagaauucaauaauggcaguuucauuuuugguaaauuuuaaaauauaaucuugauauaaauuugauaccaaaaguuuuagguuuggucucauuuuggauuaaauucaaaauaaagauucagaaauuucaguuauucuagcaccauaugguuaauauuaacaaguaauacgguuguuuggaguacgccuuuauaaauaucuaguguagaccuggagaaauuauaaacuuauauuuuauguguaguuggacauuguagaaaugguuuuaaaaggauacuggauaauuucauucauuucuucugagguugcagaauuugcauccauuuuuucagcagcugucacaacuguugcaaaagccuuuugaauagacaagacagaagaaaauaaaaaugucuacaguugccaaacaucuuuuacuauacuucuuuuaauggcuguugauagcuggcacauauucuucauuauaucaaauuuaagauugucaaaacuacacugaugaucacuuuaaaccacuuauauauuaaaagauaaaguaaugguuccugaauaaucuuguuucagagaacuaagaguaugcagagaaaagaaacgaagcuagucaaagguaaaagaacaagaaagcccuguuuccucuacuaaucuuacuccaggaaaauaucuauuuuucuuggaagcagccaauuauggauauuuuuuaauggugacaagacaucuguaaggccuuuaauagaguuaagaucuuuguaauacuauucugaagacagaaagaauaguuguuuauuuuaaagaauaacaacaguuguuuauugccuugccaaguauuccuuauacuuccugauugcuaaaucuguuguguaguuacuucaauuuuuuuucuuuuaagcaagaagagaaaugcuaguuaauaauauacuuuauuuugugaaauaacagaacugaccuaaauuguuuaguuuuugcuuaaugcuaacuauuggguuagaucacauacuuauuuugaccuagcaugaacacagaauuggcuugguuaaggaauucaggaucagagggcaggggauugggaguggggacuguugaacuaccacuuccuaaggaacuuuuaaaguuugaaaugauuuaugcuuuccaaauaaaa

SEQ ID NO: 13912 - RNA, 37295 nt, Homo sapiens
uuuuauuuggaaagcauaaaucauuucaaacuuuaaaaguuccuuaggaagugguaguucaacaguccccacucccaauccccugcccucugauccugaauuccuuaaccaagccaauucuguguucaugcuaggucaaaauaaguaugugaucuaacccaauaguuagcauuaagcaaaaacuaaacaauuuaggucaguucuguuauuucacaaaauaaaguauauuauuaacuagcauuucucuucuugcuuaaaagaaaaaaaauugaaguaacuacacaacagauuuagcaaucaggaaguauaaggaauacuuggcaaggcaauaaacaacuguuguuauucuuuaaaauaaacaacuauucuuucugucuucagaauaguauuacaaagaucuuaacucuauuaaaggccuuacagaugucuugucaccauuaaaaaauauccauaauuggcugcuuccaagaaaaauagauauuuuccuggaguaagauuaguagaggaaacagggcuuucuuguucuuuuaccuuugacuagcuucguuucuuuucucugcauacucuuaguucucugaaacaagauuauucaggaaccauuacuuuaucuuuuaauauauaagugguuuaaagugaucaucaguguaguuuugacaaucuuaaauuugauauaaugaagaauaugugccagcuaucaacagccauuaaaagaaguauaguaaaagauguuuggcaacuguagacauuuuuauuuucuucugucuugucuauucaaaaggcuuuugcaacaguugugacagcugcugaaaaaauggaugcaaauucugcaaccucagaagaaaugaaugaaauuauccaguauccuuuuaaaaccauuucuacaauguccaacuacacauaaaauauaaguuuauaauuucuccaggucuacacuagauauuuauaaaggcguacuccaaacaaccguauuacuuguuaauauuaaccauauggugcuagaauaacugaaauuucugaaucuuuauuuugaauuuaauccaaaaugagaccaaaccuaaaacuuuugguaucaaauuuauaucaagauuauauuuuaaaauuuaccaaaaaugaaacugccauuauugaauucucuuuuuuugguuuuuguuuuuuuuguuuguuuguuuguuuuugagacggagucucgucuaucgcccaagcuggagugcaguagugcgaucuuggcugacugcaacguccgccuccuggguucaagcaauucuccugccucagccucccaaguagcugggauuacaggugccugccaccaagcccagcuaauuuuuguauuuuuaguagagacgggguuucaccauguuggccaggcuggucucgaacuccugaccuugugauccgcccgccuuggccucccaaagugcuaggauuauaggugugagccaccucacccggccuaauucuuuuuuuuuuuuuuuuuuuugagacagaguuuugcuauuguugcccaagcuggagugcaguggcacgaucucggcucaccgcaaccuccaccucccggguucaagcgauucuccugccucagcuucccaaauagcugggauuacaggcgccugccaccaugccuggcuaauuuuuguauuuuuaggggagaugggauuucaccauguuggccaggcuggucuugaacuccugaccuuaggugaucugccugccucggccucccaaagugcugggauuacaggugugagccacugaccuggucugaauucucuauuuuucuaauguacguuuagaagugggggcggggagcaauuuccauacuauguagaacauuagauuuaggaagcauuaaguacuuuuccauuuauguuuuauugauaguggauucuaauuaauguuuuccaguaacaguuauaguuuaauuuaggaguuuauaucugaacuaucuacuucauuuuaccaacuaguauuuuaacauugagauuuuaaucccuuuuugucaaaaauacagcacggccaguuuccuuaauuaaagccuccagugcucgguuuauuagagcuguuucugaacuagaacuuuuaggauuuauaaaaccuaccaaacagaagacugaccauguggcaagacuaacauggggaggcugcuagaaagcaaauaagcaaagccagaacuaucacauuuagcuuaagagaaaaaggugaccagucauauuuacauauauuagaggagccuguuuuguugagaagauaaauguguaacccccauugauguuuaaccagaaaaguacauugcuaaccccaaacaggcauguaucaaaacaccuguggaguacuuuagacuccaacaaauaauaauguaacuaaaacugcucacacauuuuacuguacuuuccaaagucauuacuaaauugugaguaaaucauucuugaacuuagaguauguaaauguaauaaauuccguuauccaggaguauaaauuauuugcaguugcuuuagcaauccucauuccuccucucccaauucccugcauuggcauuccucacuuuaguguaguaggcaguaaguaacaugaauaucuuacagguuguuucuccuggugacuacauagguuccaaaacugucucugccucuccauuuccuguagucuuacaacuuuaaagaaaaaaaaaaaaggccaggcgugguggcucacaccuguaaucccagcacuuugagaggccaaggcggguggaucacaagggcaggagaucgagaccauccuggccaacaaggugaaaccccaucucuccuaagaaauacaaaaaauuagccaggugugguggcacaugccuguagucccagcuacucgggagccugaggcaggggaauugcucgaacccgggaggcggagguugcagugaacugagaucggccacugcacuccagccugggugacagagugagacuccgugucaaaaaaaaaagucccaaacuguuuggcuuuauuuaggcaguaaauauucuacuucgggaugaccugucauggagccaguaaggccucuacaaaucacaucccaaacaaauacaacucagaugagcaaaguaaggcccagaugaaaugacaucucgaucucuucuauggcagaaacucagcaagacauaaugaaacaaagauagcuaaaguucauuauuuaaugcucuacucccaagagaauuaugggacuuuaaggcuacucacuaacauacaaaauuaccaugcagauauggggggaaaguccauguccagaaaaaacuugguuugcaaaccuuagaacuaugucauugcaggauuaugugugugugcccgugugugugcucacaggcuuugaagaguuuuaugaguauccauuauccaaaaugcuuggaaacagaaguguuuuggauuuuagauuuugaaauauuugcauuauacuuaacaaguucaguucagcauccaaaacccaaaaugcuccagugagcauuuccuuugagcaugucaguacgcaaaaaguuucagauuuuggagcacuuaagauuuaggauuugggauauucagccugcauaaucaaaccuccuucauucaggaauguaaaaggagguauuaauaugagcuuagaauaaagaacaccuuagaccucuggcagcguggugggcugagaugacauuaauggguagcugcucacccuccccaccucacucccugcuuuaagcacauaaaaaugcuagaugagcuggguacagcagcucgcgccuguaaucccagcacuuugggaagcugaggcggguggaucacgugaggucaggaguuugagaccagccuggccaaccugguaaaaccccaucucuacuaaaaauacaaaaauuagcugggcguguuggugggcgccuguaaucccagcuacuggggaggcugaggcaggagaaucacuugaaccugggaggcggagguugcagugagccaagauuguaccauugcauuccagccuaggcgacagagcgagacucuguaucaaaaaaauaaaauaaaaauacaaaauuagcugggcgugguggcacacgccuguaaucccagcuacauggaaggcugaggcaggagaaucgcuuaaacccagaagguggagguuguagugagcugagauuacaccauugcacuccagccugggcagaaagagugaaacuccgucucaaaaacaaaacaaaacaaaagcuagaugaaauauaucucaaaaaaugucaaaauguugccaaggcuaaaaggaaggggaaaccccaagguaccauaaauaaucaacugcaagucagagcagaaagcaccuagcccugcagagcuuugggaaagacaaugaccagcguagguaguuaaguuagauuagguaucuuuucaucuucauuuaaaaggugccaggauuucuuauucaacagaauguaaacaccuguacauauguacacaggacugucagcuugaauguuuguuaaggaauuuauuauaugcaaacacaaguaccacuacuaccauagaaagcaacuggacaaauagaagccuugacaccuuggaauccauguauuaaagacagagccucugucauucuaagggucuuugagugaggguguggaacacagcccaccaaaugaauaugaucaaagaauaaauuucucauguuaagucacugagauuccaugauuuaccuucauagcaauuagcucaauauuuuuucgcaauauucuagucauucuucuucuagucuugccuccaaccauguguuucauuuuuuaaacaaugguugguacaaaucuagggaaagaauaggugauuuuaaugauuuuuccaucuauuuaagguaaggaaguuggcaacagggaaggucuuccaauacaaggacaccaucacuacguacaauguaguuucaaaugaugcauaugagcaccagauaaaauugucaguguuuagaaacuauuacuuugaacaacacucauacagcaagaugcuuuuuacacuguaagguacagaggaacuggccucacacagaccagcagauucauauauaaggcacagauucacugaguagaguaaguagccaugccuuacuuuuccucugcugggcacuaaguugaauuuauccaacauaaacgcaugucaugcccugaaccacuuugacuuuccucacuaaagauuauguaagaaaguagcaggauggcaacugcccuauuuucuuuuucgagacagaauuucacucugucacccagagugcagugacacgauuugggcucacugcaaccucugccuccuggguucaagccauucuccugccucggccucccaaguagcugggaccacaggugugugccaccacgcccagcuaauuuuuguauuuuuaguagagaugggguuuugccauguuggccaggcuggucuugaacuccugggcucaagcgauccacccaccuaggcuucccaaagugcugggauuacaggcaugaaccaccgugcccagucgaaaacugcccuauuuucacaaugaauacacaaaagagcuauaaaauuaaaacaugaagcuccuuugugguaaucauuaauggagcacaaaacccucaagacagccuaugaaaugccaguucaauucuguguccauucuguaauucaggaaaccucuaccaaaauaucuuacaaaggaaguauucugccuuacuaaaucuuucauuuaaugaaauacugaucugaaaacccugaaucgaaguagggugaaauacauucaaaaaguaccaagcaugugccaugugccaggcacuguaugccagugagcaaagaacccugccuucacugcguuuagcacaggaaguaaaacaaagaaagcagcagggcagagcaccaggaugucaggcugcaauuuuaaagaguggucagagcaggcuucauugagaugacguuugugcaaaaagucaaaaguggugaaaaaauuuuccaugaaguuuugugggagaagagcaugcuaggcagacacuagcaguaacaaaaauccuaugcuggaaaaacagcaaaaguggccaauguggacaagguagagugagcaggaggaauucaauaggaauugaaugaggugggguagagugcagguaauuuagggcuccacagaccuuugugaaguuuuacuuuuacuuaggaagccaucuaaacaagacuuagacuuuuaaaggaucagucugguugcuaugagaguagaauaggaugggugagaggagacaaaaugaggcaaaacaaagaccgguuaggaaaccacagaaauaauccaagcaagcuaugauagugucuuggauuaggguaauagcaguagagauguuaauauuuuaagguggaacuaagaucagaugaaggaugugaggagugcaagaccauuucugccuagaaacaaagaauggaguggccauuaagugauugaggaugacugagaggaaaaauuucagaggcaaaaguaaguuuuagacguaaauuucgaggugucuacuagauaccuaacugaagaugucacaugaagacguuaauauaaucugauguccuuaugaugagaucaccaagaugaguacuaagagaggaggcaagcagcccaaggucaagcucgggggcacaccuauguuuuagcaaaaugcagggaaaugaagauugggccaacagcaagacagagaaggagcagccaguaaaggagaaacgucaaagcaaguguaguauuuugcaagccaacugaagagugcuucaaggucaaaugcuggcugcugauuagauuuaacaauguggaaaucuuugcugccuuuuacuaagaguaacagagaggagacgaacucuaaucaccuaucagaugaccuaaccaaguguccaaacuuaacagccuggaaaagccguaacuguugugaugcaauauggagaccauagcaucaccuugcacucuugcacaacaaguuuaacccgaaacuugcgaaaacuuuagaccuuucaguuuacagaaaguucaaagggauaucagaaguuaaaauuaaugacaguacaaagaaaaacucaacaagacaacaggccuaguauuuccagaaaguaggaaucuuaauugaaucguguuugggggaugaggguagcuauuuaaaaaagagacacauggaaaaaucugaaauaaggacucgauguuaaauuagggaaguauuuuaagugggaaagucaacuuuucuguuugaauuucuuuuccuaauaaaacaaguuggugaaaaaaaaggaagggguaauaaacuggaggaaguuuagaaaacugaguuuugcuuuuauaaaggggagcacuaaaauaaucacuagcaagggauauaggaucaaaagauuuuuuaauaacaugcuuauuaugcuuuuggaaaugauuuaguagagaaagaaaauagaugcaguagagagaggagaggacugcuggagcuguaucuuugccugagacauagguuugcaucucgugcuccuuaccuggggcaaaugcaggagcaagagaauugugggagccauguauccaugaguagacauagacuauucgggugcuuuuguagaauauucauuuaauaccaauuacuguaagaguuugaaaggaguaaagagaacccaaacagggcaaaaacaagucauuuccaacccuagcugcuuaaaucaccuaggcagcauauuaaacagauuccaaaaguucuccccucccaccaauugucuaaagcagucucuggggauagguagagccugagaaccuucuaccauuuucuuuagggucgugucaagugcuugccauaggccaaagacagcuuuaguaguuuaaaccuccaauauuuauuuuucucagauugccuauuuuuccaaaaguacaaacgcuuauaccuaugugcacuuguuaaagauuuacuaaacacaucauaguacaguacuguaucaguacugccuuuuacuggaagaauaagaugacuauuaacacaauucuguagauacuuauuacaagcaauuucagggauuuggggaauucagaaucccuagguagcuaaaauaaucuauugaaaucaugugugguugguuauuuggacuaaucaacuaccggacccaucuaaagucagaguagcccauaagcuaggacuuuugcauaagugauaaugcagaaauuuggcuguggagcaaaaaaaaaaaauuuuuuuuuuuuuuuuuuuuuuuugagacagagucucacucugucacccagacuggagugcaguggcaugaucucagcucacugcaaccucugccuccugaguucaagcgauucucgugcuucagccucccaaguagcugggacuacaggcuauccugcuaaccagugguucuuagcugggaacuguuuugucccucagggacauuuggcaaugucugcaaacacuuugguuaucacaauugugggaggggguuuaacuggccucuagugguagaggccagagauguggcuaaauauccuauaaugcacagcaauagccaccacgacaaagaaugaucuggcccaaacugccaguagugcugaaguugagaaucucuguucuagaccauuaaaaggggguagaauuggccaggcgcaguggcucacgccuguaaucacagcacuuugggaggcugaggcaggcagaucaugaggucaagagaucgagaccauccuggccaacauggugaaaccccgucucuacuaaaaauacaaaaauuagcugggcgugguggugcaugccgguagucccagcuacucgggaggcugaggcaggagaaucacuugaacccgggaggcggagguuacagugagccgagauggcagcacugcacuccagccuggugacagagcaagacuccaucucaaaaaaaaaaaguaggggggaagggcauagaaucaugcaccuuauugcuacccugugcuauaccaauguuucucaaccacuaauuggcauauaaauugccugggcaccuugugaaaccacuuucuaggcuuguuuuaaacagagaauuggugaaauguaauuaccaaagcuaaaaauaaaagaggucuggcugggcgcaguggcucacgccagcauuuuggaaggccgaggugggcagaucaccugaggucaggaguucgagaccagccuggccaaaauggugaaacccugucucuacuaaaaauacaaaaaauuagccgggugugguggcacauuccuguaaugccagcaacucaggaggcugaggcaggagaaucgcuugaaccugggaggcagagauugcagugagccgagaucgugccacugcacuccagcuugggcaacaagagcaaaacucuaucucaaaaaaaaaaaaaaaaaaaaaaauuccuuuuucuucuaacuuggucaguuauaaauguguauuuaagauugucuuaaauuuuggaaauaugcuacuagaauucaacaaaugaauucacugaagcauguuuuugcuuacuucauuauaagaaagcuaugucuagaaaccauguauggaaagggagucaaauuugcugaaucaugcuuuugcauaucaaguucuuaaaagaaaaaacuggauccuacugauaucugagguaauucuauagcaauuaaaauaccuguaacauucuaucaggcaguaaguuacagaagaaggaauuuauauauauauauauauauuuuuuuuuuuuuaguagagaugggguuucacuguguuagccaggauagucucgaucuccugaccucgugauccucccgccucggccucccaaagugcugggauuacaggcaugagccaccgcgcccagcagaagaaggcauuuagaaucagaacucaguguuuugaaacagcacucaaaucuuagaaaauuaacuucacugauuccuggaaaaugcuuacguuuuaaaacaccaacuuuauucaaauacuaaccccaucuguacauuaagaaacaagcaaaauagaaguaaauguuuuauucuuccaacuaaauuccaguacuacaagggcaguaaaacaaugauacacuggaaaaaaaaaaaugcagcaauaaacauuuguuaaaaagacugauagaauaaauaaaacuacaaaaaaaaaaaaaaucauacaaacccauucugaaaccccaagaaguccuggaauacagaaaugcccuccuccuucacuauuucacaggaagcacugcaggcuauuugcuuaauauuguccugggauuacauucuaaaauuaguaacugguuacagcucgguuguagugcacaauuaaaaucacacuaacuucaucugaagugucauucuacaguuuuauuuacacaaccagugaagggcauguucuagaauaccagcuuuaauccuuuucaaacauuaauauaagaagccaaauuguaaugauacagcaaaaugaggccacugguauuaauacagguagcaaagguccacauccaggugguacugacaucagggaaauuuccaaaaccaguugcugcugccuaagagugguugccacugacgaaagcuugaaauaaccuguauucacagaagggguauuggcauugcugcaugucauaauugggaccucuugcaacaacucaacaaggaacaaggcagcccacaaaugcaggauacgugauucaugaaacaucuaaagggugagaaaaagaaaauuagugcaaaauacaggucaaaauccaaacgaauacuagaucuugauucccaauuuugccccuagguauuuaaguaaccaaaagacuugcaaaguuaugcugccuauuuccuccauacauucucaguaauuuuguugaauucucuuuuugaguaugaaaauaauuauaaugucuucuccuuaaaagacagucuuauuuucaguuuauaacuucaaaggugaaauacuuacagcuagcaggcuguucuccauaucgucgcauuauuugaucaugcguaaacuucacaaacgcaucauauuguucuauaaauaaagguacuugucaauuacauuuguaaaaugccuuauuagagccagauaaacugaaaacacaaaauauacaguaaaacaauucuaaguugacaaaaucacuuacauaaccucaguaguacuaauaguguaucaaauaaaaacagcaugcaacuuauuagucaggaaaccuagguuuuaguccaaucacaugaccugacauaaaggcuaggugagauuuauuuauuuccuaacaaaaaggcugggaccgggugcgguggcucacgccuguaauccaagcacucugggaggccgaggcgggcggaucacaaggucagaagaucgagaccauccuggcuaacacggugaaaccccaucucuacuaaaaauacaaaaaaauuagcugggcaugguggcaggccgccuguagucccaacuacucgggaggcugaggcaggagaauggcgugaacccaggagguggagcuugcagugagccaagaacgcgccacugcacuccagccugggcaacaaaaaaaaaaaaaaaaaaaaaaaacgaggccgggcgcgguggcucacagcuguaaucccagcacuuugggacgccgaggcgggcacaucaugaggucagaagaucaaagccauccuggcuaacauggugaaaccccgucucuacuaaaaacacacacacacacacacacacacacacacaaacauagcugggcaugguggcacacaccuguagucccagcuacucaggagguuaaggcaggagaaucgcuugagcccgggaggcagagguugcagugagccaagaucgugccacugcacuccggccugggcgacagagugagacuccaucuuaaaaaaaaaacaauuggccgggcaugguggcuuacgccuguaaucccagcacuuugagaggccaaggcgggcagaucacgaggucaggagaucgagaccauccuggcuaacacggugaaacccugucucuacuaaaaauacaagaaaauuagccgggcauggugguaggugccuguagucccagcuacacaggaggcugaggcaggagaauggcgugaacccggaaaguagagcuugcagugagccaagacugcgccacugcacuccagccuugggugacagagugagacuccgucucaggaaaaaaaaaaaaaaaaauuaaaaacaaaggacuuucaauaaaaagaccuuucuacucugaaaguuauuguauguggucuaugaauggcaacugacugcaaugagaauaggauaacaaaagcuaacaacaaaacacuaccuaaaaccugaucaaguaucacagaaaaaguuguuauauaucuaagcaaauuaucuucucuacauuaacaccucuauauuaauuccuuaaaauaaaaaagcuuacauaucuauauaaacaguaaaucuguggcuaaacauucuauuuauguuaccauacauaauaaauuuuauuuacuuaaauuaucaaauuuuacugaauuuuuugauaacuaaaacaggacuccaguuugauacuccaaugacuuacacagugacagccaauuagauauuuuaaaugucuacauugaugguaacguuaugaaaaauauaaagucaaaaaauccacaaccaaauugagguaaacuacuaacaucaguuuuuaguacaggguaccuacuaauauuacugcugaucuacacggcuagccaauacucuuuuccucagguuaccaaggcgggcaugagcuauaagaagguuaauuuucuuuccugaacugaaauuuucucauucucagagaauauaccgcaccaguguauagaaagugaaauuaaaguacacguggaaaaugcauuucacacaacugaguuccucagaaacucuaauaaacacaccucauaccugcaaguuuuguguucaauauuucuucauauucuucucgaacuuucucuucacguucuuucaacaaacguucacagaucaucccaaccugccguagaguaaauaagggcuguucuuuuuuuaauggugaggaugcugcagaugaagucccuauguacaaugaggacaaaaaauagcaccugguuuagagccaugauauaaagcaguuucuaaaugaagagguuuuauuuggaucucuucaaucuugauauaaaagcauuuuaaaaucagauuuuaagcacagcauuucacaagucuuaaaacaaccaaaauaauaauuccaucagcuggugacgcuggaaaaacacggcaagauguaauuaagauaaaaaagacuaaaggugaguagaaaaaacuuuaagacauaagaaagguugggcguggugcucaccgccuguaaucaggccgaggugggcggaucaccugaggucaggaguuugaaaccagccuggccaacauggugaaacccugccucuacuaaaaauacauaaaaaaauuagccaggcaugguggcgggcaccuguaaucccagcuacucgggaggcugaggcaggagaaucacuugaacccgggaggcggagguuucagugagccgagaucacgccauugcacuccagccugggcaaagagagugaaacuccaucucaaaaaaauaaaaacaaaaaauuaaaaauuaaauuuaaaaaagacauaaaacuuaaacauuacaaugaugggucccauuacaaaacaucuuaucuccuuucuggaaaauaccauaccaugaaguauuuuagugacuaaauuacuuuccuacacuaggaaugaagaacaccucaggucuaaauuuaauuuuauuuagucccagaauaacaaaucauuaugccuguaaaaagacacuuagucuucaaagccauaccauuaauaucuuaagagccuacacacaaugaacugguaauuauucuaccaucauuucacaccuuuagaaagggguuuuccuuuauugaaaaagaaaauacgccgggcaugguggcucacgccuguauuaccagcacuuugggaggccgaggcaggcggaucaccugaggucagaaguucaagaccagccugaccaacauggagaaacuuagucucuacuaaaaauacaaaauuagccaggcgugguggcacaugccuguaaucccagcuacuuaggaggcugaggcaggagaaucgcuugaacacaggaggcggagguugcagugagccgagaucaugccguugcacuccagccuaggcaacaagagugaaacuucaucucagaaaaaaaaaaaaaaaaagaaauuucauguuggcacaauaaauuuuuauguuuaaaaaaagaagguacagcaugaauccuuuuuagaaaagauuaaaaaacauucuggaaccuagcuugugugguggcucauaccuguaaucccaguacuuucugggaggccgaagcagguggaacccuugagcuaaaggccagccugcgcaacauggcaaaccaugucucuaauaaaaauacaaagauuggcugggagugguggcacgugccuguaguucuagcuacaggcuaggcugagguggagguugcagugagccaagaucucaccacuguacuccagccugggcaacggagugagacccugucucaaaaacaaaacaaaacaaaacaagacauucugaaaucuacuuugcuggagaagcauaaaugauucuaaagguuuuugaacucauugaccacuaauucccauuaaguuaacaacaauucgcauggaaaaauaagcucaagcauugagcugauaaugcuaugcucaaaacucuauaccauagaacuacacugucaucacacuaagaaucccaaagcagcugcaacaucagcaucugucaauuucaaauauuccuucagcauuuuuauaccuauuaggauauuuuuaauaaaagagaaaauauuuuguaguaauaacaucuacuguaauacugcuaaaaguauuuuauacauauucaagugcaccauucguuaccaauuguuucuucaucucgcucugugaauuugcccugguaccaccaauauuacuuacucucuuaacuugcuccuuauaaccugcauggcaggagcuaguuaacuaugcuuauuagaacugugcauaccacaauaacaaagcccaccagcuuuauuccauaauuauccaaagccaucuuaauuuacuuucacauucccagcuuuguuacuuaagacugccaguuaacugaucuucuaaguaaagugaguaaggaaauaaugaucuugguuuccugcuaauacagucuagugcccaacccucaccucuauguuucaaccacuaauaccuggcccccacaaugggcauggcaguauuuaguuuugaacaaguucauguuuccuaaucuaauuuuauuugacuauguuauggucuuugauuuuuuuuuuuuuuuuuuuuuugagucucauucugucacccagguuggagugcaauggcgcgaucucugcucacugcaagcucugccucccggguucaugccauucuccuaccucaguagcugagacuacaggcgccugccaccaugccuagcuaauuuuuuggauuuuaguagagacgggguuucacuguguuagccaggauguucucgauauccugaccucgugauaaaccugccuuggccucccaaagugcugggauuacaggcaugagccaccgcgcccagccgcaaauuuuuuuauucugccagguuuuccuucccuugcuagggggaggagagaaagcguugaacaaaggcaacuguugucacaagaaaagcuauuuuccugagaacuuuacuaaagauaagagccacuauugauggcucucucucagcaaaaccuucaacuuucucuuugcuucaaguagcccuuauuccccgcccccccccuuuuuuuuuuuuuuaaaaaaaaggaagguuauuugcaaacauuccccccaacaaaaaguagguaaaaacagauacaggaucaaaaaauaauaauaauccaccuuuagaaaucuagcccaauaagacaagugugugaggcaggguauguauacagggauaguucuuaaaauacuauaccagcaaaacuucuaaguugaauuaucuaucauuaaguguucagucaugacaagguacaucuauaccuaacaaaggagcauacaguauuguuauuauuuuuuuuuuugagacaaagucucacucugucgcccaagcuggagugcaguggcaugaucucagcucacugcaaccuccgccuccuggguucaagugauucucaugccucaggcucccgaggggcugggacuacaggcgcgugccaccacgcccagcuaauuuuucuauuuucaguagagacagaguuuugccauguuggccaggcuggucucaaacuccugaccucaagugaccugucuaccucgcucggccuccccaagugcugggauuacaggcaugagccaccgugccuggccuauuguuaauuuuuuuuaauaaaggcuacaaaucauaguacuuacaggauguccacuuuggggauauuauaugcaggugguugucucugguuagugggaauccagugguaacuccuuauuuuguaccauauuauuuuuuaagaugucaugcauuacuuguauaaauguuuuuuuaaaacucagaggagauacaguagcuuaaaugacuaaagacaacuuggauuagacuuuucccacucuaaauaauaaacuuuguaaaugacaagaaauguuauuaccuggugaagcugguccacugaggagaaaugcauguggcugugcaucagaaguacaacacggaucugucuguuggaaacucguuucuaaaugucuucucuucugcauucguuuauacucuuguuuuauguuguacagaauuuguucuaaaauaaaaaaguuaaaauuuggcaagauaaaaacuuucacauuaaaaaagagguuggcuuuccaacauuauuuaguagaccaaucuacccaaaauacuccuuucaaauaauauccagaaaacugacauuuugguaggaacucauuucagcauaaauggggacauucacuuagcacauacacaccaacuggaauucagcuguucaacaauauucuugcugagcacugacuagcaaaaauaaaguuuuucagucaaaauaauggucaaggagucugugaaccaaaacaccuauuuuacucagauucuuaagaguuccaaacuuaaagcucauuuauucaucacauagaacuauuacacuaacaggcuuuuccaacugccuuuacugccuuuaugccuuuuccaagcccauaaauaagaaggggcuugggagauuauguauauucaagcacacaacagucugaagugauaauaggucaacaaaaugacaaaguagaugggaacuuaaaaagucaucauacauuaaauggccauggccaauuauuuuaagcucaauaaaaccuaagaauacuacagcauucugaaucuuggggcuggaggguagggugagggggagaccauguaaagugauugguacaugacagguccucaauaaauaagaaccacuauaccacagugcaauuaucuugaaccacaaucacacaaaugaguaaaauuauaucuggcacauccuuuaggccacuaugauucauuucagaaagauuucuaacucaaaauaauuaccaucuggccccuccagaaaaucccugccuagggguuuccacuccccuuccagacuuccucacuacaccuccauacuccauagcucccaaguuaacagguuaucaaugugaaacuacaucccuagaaguuuacuaaccaaaauccaaagcaagauuaaacaaaaaugaaauuuuuagguggcaauaaaaagacugauagaguggaguguagccuuaacauucaauucuacaaugaugcauuaauuuaagaacuguuagauauuggucaagugugguggcucaacaccuguaacccuggcacuuugggaggucaaggugggaggaucacuagaggccaagaguucgagaccagccugggcaacauagagggaccgugucuuuaugacacacaaaaaagaaagcuaaagauuuacauacaauaauucuuuuuaaaauuuaauacuggugguuuucguagauaaccaccauaucuacaaaauccugucacuuauuuucucacuuuauuucccuaggagaagaacuuuuagaauuuuugagagacucugggaggacaaauaaguuccuuaaacauuuuagauacugccuguuucauuauuuaaacugaaaaaaaaguggcaagacauauccaguuaaagauaccauuuacauaaauuuuguuguauaaaaagaccuguuuauacauacacgaaugugcaguuuaaguacaaaaucacucauucauguguacauaaacaggucuauaaugauuaauuucaggaugguuaugucggggugcuuuagcuguauuuaacauuuuucauuuguuaacauuuguuuaauacggguuaugcucauuuucaguucuuuuccauuuauuugaacuacuuuguaauuugaaaacaaaguuacuccaaucgagugacagucguuaaauuauuaaauuaucaguguuggcaugaaacaguugucuacugaaugguaagcauaccuugauauaaauggguuuccuaauauucaccagagguacccaauaaaacuaauguaacauccaguaucaaccaggauaaacacaaauauccucauuuuuuaauaacagaccucuuuucaguaacaacaaucuaaaggguuuuucuuuucuuuucuuuuuugagauggagucuugcucugucacccagacuggagugcaguggcgugaucucagcucacugcaaccuccaucucccagguucaagcaauucuccugcgucagccucccaaguagcugggacuauaggcucgagccaccaugcccagcuaaauuguauuuuugguagagacaggguuucaccacauuggucaggccggucucgaacucuugaccucagguguuccacccuccucggucucccaaagugcuaggauuauaagugugagccaccgugcccagccauucuauuuugcugagagagaguaagcuucacucauauucaucacuuucuguccaaagcuaccauuauccugaucaaaagugccauucaaaacaucauaaaauuuauuuauaaccagagauguuaagagguacuaguuuggaguaacuugaccuuaauauuuaucuuuugugugacuuauauacguucuuuuaucaccacauagcuguucucagauuuagucuuacuucugcuucacaagucaaccaaagcacaacuaaaauguaccaaaagaaugcuuguauaauaacaaccucaauuuguucauuugauaaucucaaaugaaagcuaacccagaauuaagaaacgguaaaacuuuuaaaaauuuuaucuuuguaaaacuccauaccaucagauacuuagggacaucacuaacaauuuuaagguauaauuuacaaaugacaaaauucaccaauuuaaauguacaauccauuugaguucugacaaguacauacauacaguuuuggaacuaacguaacuaugauaaauaacuuuuuaucacuccaaaaacuucucuugggcuucucugcaguuaauucacuaccaauaucaccacucccccauacaguccaccaacacucaucugcuauuacuacauaguuuugccuucucuagaauuucacauaaauagaaucauaaagaguguagacuuuuaugucugaacuacuuucacucagcaaaaugcuuuugagauucauguauguugcaugaaucagaaauuccuuuuuauuggugaguauuccaucauauguauguauauauacacacacagcuagccuuucuccuguuaauggacauuuaggcuguuuccaauuugggacuauuacgaauauucaaguaccagucuuugguggacauguuuucauuucucuuggauaaauaccuaggagugggaaugggcugccuaaucauauggcaaaugaaggguuuauuuuguucuuacaaaauaaaauugcuaaaccauuuuccagagugauuuugucauuuugcauuccuaccauaaaaguauuacagcuccagcuguuccacauccuugccaacacuugauauugucagcuaaagagcugaagaauuuuuaauacuauugccugcauugcuuuuuacaucuaauaugaugcaacuaugucaucuaagccacacugugcccucaaaugcucuaauacugguaacaugugaucaacaauguuaugcagugaaggguccaauuuaacuuggccaagaucucaacugcacaaguagcaaacagcuaacugcaauggccucaagcucaauuuauuucaguucagggauauaaacagucuugaagcugauaacucaagaaauuuccucagauucaauauucuacaacuacauugcuaagcucgaucuagauacuuggcuaaccugaguugcuuucauaccagguagauaaaggccuuccauauaucagucaaguacuugccuacuuagucuuaagcuacuuagaucuggccaucucuuaucauaccagcaaguuaauauuuuauccaagguacauguaauaucugacauugucuugccaacacaauuuacaguucauuaaagaaaaaagaaguccaagcuucacuuguauuaucaguugcauauuccaguuuuaaucauaugccuuccuauuuggcuuaugaggcauagacugaauuugcagcaaccauuuagagcaaaauaucuagaguuaucuucaagaaaagcuaaagcacacaaauggcuauauauucuuuuucuaaauccuaaaaacuaccuuacucuuuuaccauaaaauacugcuaaauggaagucauuauuagcaaguucuacaacucacagcauuuucauucucaaaccuaguacaugacacuaaaauugcuaauaaaauucuccuuagcagguaggcaguaucaacaggucagcaccuauuccuuuggaauauuuuuaacaacaaauuaggaggccagaugcaguggcucaccccuuuaaucccagcacuuugggagggugaggcaggaggaucacuugaggucaggaguuugagaccagccaggccaacacagugaaaccccaucucuacuaaaaauauaaaaaugagcugggugugguggcgggccccuguaaucccagcuacuugggaggcagaggcaggagaauugcuugaacccgggaggaagagguugcagugagcugagaucaugccacugcacugcagcuugggcaacaagaaugaaaacucugucucaaaaaaauaaauaaauaagguaaauguggaaagaaaaggccucuuuuuaguugccacugauuacuuaggaaaugcuggacaccaugaauaaggucaacaauauaaacaggagaauguaguuaugggauaaaaagcauaauggaauugaugggggcaagauaaacagcaucaagauaagaccaagcaaagggaagaacauggaauuagaagcaacuaaaaauaaguuuaaggagaaccacaaaggaagggagguggggugucaaaauaucuuucuaggguccauaaauuuaaguucuaaaaaucugacaugugaaacuagaaacuucugcuccagacccacaaagcuuuacuauuuuccuccagacaucauuacuagaucaaacauuacgguuucgcgaacaguuuuaaguuuagguguauggggccccucuguaccauuuuauaggucaauaccauuuauuucuccauggaauaucuuuggaaaacacaaaaugaaaguggaccuagaaagacaauucaaacaauggaauugaaaaagaaaucuuguggccgggcgcgguaguucaugccuguaaucccagcacuuuggaaggccaaggcaggcggaucaccugaggucaggaguucgagaucaggcuggccaacaugacgaaacccugucucuacuaaaaauacaaaaauuagccaggcaugguggugggcgccuguaaucccagcuacucgggagacugaagcaggagaauugcuugaacacgggaggugaagguugcagugaaccgagauugcaccacugcacuccagccaggcgacagagcaagacuuagacucaaaaaaaaaaaaaaaaaaaaucuugaaagucugccaguucuagucaggaacacaaaugauauggaaaccuguacauaauuaaguaaagaaaacuugcaauagucauuaagacuuaaaacuaagacacacuguuccaaaauaacagagcaauguacaguucugaacuacauacuagauacugucaugacuacuuucuaaauuaaaacacacaacuugggcagggcgugguggcucacaccuguaaucccagcacuuuggguggcuaaggugggcagaucaccugagguugggaguucgagaccagccugaccaacuccaagaaacccugucucuacuaaaaauacaaaauuagccauugcacuccagccugggcaacaagagcaaaauuccguuucaaaaaaaaaaaaaaaaacacacuacuuggaguugcuauggagacccaucuuuauuaauuggcuauuuucccaggaucaucucugcagaaacuaaaacaguuauguucuccuugauugaaucuuaaggacaauauucuuauccaaccaagagcuauuggacuauaaagaaugagcugauaccauuuuaaauucacuuuaaaauacuauuauuucacugguacauauagccaaugauuacuuauuugaaagaaacgacucaauuuguuauaacucugcagguaaauguaaguuuuacaccuccagcuuauauuacacuaaggggauacauuaaccuuguugcuauuguuauguagcucuuaacuacuuuuaaguauuuucucaaauaacuuacaagcuaucaaaauagaguaauaacaaagaaagcauggcugcacgcaguggcucaugcaaggccgaggcaggaggaucacuugaggcccggaguuggagacgagccugagcaacaaagugaaaacucuaucuccaccaaacauaaaaaauaaaauuagccaggugcgguggcuugcccuuuaguccccagcuauuggcaaaaugagguagaaagauaguuugaucccaggagugccaggcuacagugagcuacaauagcgccacugcacuccagccuaggcaagagugaaaccuugaguuuuuuuucuuguuuuuguggggggacagagucucgcucugucgcccaggcuguagugcaauggugugaucucagcucacuguaaccuccaccuccuggguucaagcgauucuucugccucagccuccagaguagcugggauuacaggugcccgccacuaugcccagcuaauuuuuguauuuuuaguagagacagaguuucaccagguuggccaggcucgucucaaauuccugaccucaggugauccucccgccucagucucccaaaaugcugggauuacaggcugauccaucgugccuggcaagaccgugucuuuaaaaaaauaaaaaaaaaaaaugccaggcacaguggcucacgccuguaaucccagcacuuugggaggccaaggcaggcggcugaccugagguagggaguuaaagaucagccugaccaacauggagaaaccccaucucuacuaaaaauacaaaaaaaaauuagccaagcaugcuggcaugugccuguaauccuaguuauccgggaggcugagguaggagaaucacuugaacccggggggagguggagguugcagcgagccgagauuaagccaaugcacuccagccugggcaacaagagugaaacuccgucucaauaaaaaaaacacacaauaaauggagaagaaggggaaauugaacugccccaaauccaaaacccaacaugugcaugcuacagaaacauuugguuccaaggcagaagguucagcuucuauuccaauuaaccacagccacagggccaauguaauguguauuuaccugcaggguuuuaacaaauugaguaauuuacuucaaauaaguagcacuagcuauacaguaccagugaaaugaaagaauuugaccuuguagugauucuaguuguuccuccuccugcagggaagauaaaugaaugccuuuuauacaguuaaauauuauauaaguauaaaugcagaaccuaagccagcuugcagagacugagaaggcagacucuuugaggacuccaguacaccacgaucaagcugaagaacaaaacaaucuccuauaacaacuuguucaggcaccccccaaaaaauuagcauacccgggccaggcgcgguggcucaugucuaugaucccagcacuuugggaagccgaggcggguggaucaccugaggucaagaguucgagaccugccuggccaacauggcaaaaccccaucucuacuaaaaauacaaaaaaauuagccaggcaagguggugcaugccuguaaucccaaucgcuuaaaccucggaggcagagguugcagugagccgagacagugcuaccgcacuccagccugggcaacagagugagacucggucucaaacaaaaaaagcauaccuggaaccaggauuugcaaaacugaugacuaacaggccaaacucagccccauggacaugauuuuuuuaaaaacauguuaauuuguggccauuuaaaaacugggugguuuuacacauaaagucagacuucugacuacucuugggaaaaccagauaacacagcaaaacucagcugaagauucaaagugacuguuaccuuuugggccuaaguucucaagugcuucuacaauuuuaaugcacacacagauuaccuccagaucuuguuaaaauguagacucugaaggguggagcuuaagauucuacguuccuuaugaggugaugcugccggucaggacuggaauucacuaguucccuccuaguuuacuuuaaaucauuuacacaucuggaacuaugcguauuuaaaguuucuagccccugcuuaaaauaacaacucucuuggccacgggcgguggcucacgccuguaauccuagcacuuugggaggccaaggcaguuggucacuugaggucaggaguuggaggccagccuggccaacauggugaaacccugucucuacuaaaacuacaaaaaaauuagcugagcaugguggcaggagccuguaaucccagcuacuugggaggcugagaaucgcuugagcuugggaggcagagguuucagugagcugagaugacgccauugaacuccagccugggcaacaacagcgaaacuccaucucaaaaaaaaaaaaaccaaaaaaacaaaaaaaaccaacucuuaauugaacauuuuuuaaaaagugguuuacuauuggacauacuaaggaguggagaggaaggaaagcaagacauuagcagcaagguuauuacaaguaggaaaauaccuaagcuaacuuaaaaucauuuugccacccucaccugaaugguuuuugcaguugucaguucauugcuucucagccuuuuggcuaagaucaaguguaauucuaagucagacauaccccuccuguaggaggaaaauauucugcaaauuaauuuaacuugauuggaccuacuuaggaaaacucauuacaugacauuaaccuauauacaaugauuauuucaucucuccuuauacacuuuaaaaaaggaaauucauauucgucauuaugugacugaugaugaagcaauucauuuacuuuaccaacaugaccacuuauuaaaaagaggaauuaagaccaccucucaggccaggcacggucacucaugccaguaaucccagcacuuugggaggccaaggugggcagauggcuugaggucaggaguucaagaccagucuggccaacaugguaaaacccuaucucuacuaaaaauacaaaaguuaaacgggcauaauggcgggcaccuguaaucccagcuacuagggaagcugaagcaggagaaucacuugaauccaggagauggagguugcagcgagcggagacugcaccacugcacuccagccugggcaacagagugagacgguuucaacaacaacaacaaaaagaccaccucucacaccauaagacacucauuagaagucuacauacaucucuuauuuaucccauguauuuuguaaauuaguugugaacauuuaaaagucaaucgauuucacaaaaguucugacuucuagugguggagcgaaggcuaccaagaucugacgauaaaaaguccaaauuaggcugggcgugguggcucacaccuauaaucccggcacucuggaggccaaggugggcagaucacuugaggcuaggaguuggagaccagccuggccaacauggugaaacugucucuacuaaaaauacaaaaauuagccgggcauggugauacacaucuguaaucccagcuacuuggguggcugaggcaggagaauugcuugaacccaggaggcagagguugcagugagccgagaucgcaccacugcacuccagccugggaaacagggcaaaaccucaucuuaaaaaaaaaaaaaaaaaaaaaaaaaguccacauuucccauggcugcaacuaaagaggaacugucugaaccaacugaagauacaaauuaaagagacaucuguaaauggaaacugaagucaggagcaggcaugugacugcuuagggagcuauuaagugacauaagcauggagcuaaagcuagaacuaaagaacugcaagguuuaaugcccagguaaagagaagaacagcuagggaguagagggaaauuguagucaaaggagaaaaaggccauuucaaaaagaaaggagugugccagcaggcagaaugcugaaagaaaggucaaauaagaggaggacugauugagugucauggaagucacugaugaccugacaggagcugcuugaggcaugucaggaauuaagaacugaagaaauggaagcaaacagacuauuugaaagcucucugaauuugauuuugaaguggaggaaaucuggaagauagcuggaggaaaaugaguauguuuuguucuuuuacuuucucauggaaggcuugugaauauauaaagccaaaagcaaagauccaauugagagaagaaauggaauaaucaagaggauaaaguuacuuuggagaaaaguggaaucuuucccucacuauauacagugcuuuaauaauuguuuaauccucgaugauacuagaacaggacaggcucaaaugucaguagugcugguacuaaaaacaaugaaaaaacugugauuugauggcaacucuuuuguagaaggcaggcuuagucacugaaaggcaaacuugcuggugaguaaaagucccauuugagguugccuucuugagaccauuuccaucacuuggccaguaaaugcucuuaauucucacaacccuaagaggcauaugcuacuaucaucaugugcacauuuccugagaugagaaaaaugaggcucugcuucagugucuucugcaaugucacacggcuugaacauggcagagccagguuugaccucagggcccaaguucuuaacaucuacuacccucuccaguaguacauuacuacacuuaaucaaaauucuauuagcauuuaauguuaaaauaaaucacaaugggcugggcgcgguggcucaugccuguaaucccagcacuuugggagacagaggugggcagaucaccugaggucaggaguucaagaccagcuuggccaacauggcaaaacccugucucuacuaaaaauacaaaaauuagcuggguguggcggcgcacgccuguaauccccgcuacucagaaggcuaaggcaggagaaucgcuugaacccaggaggcagauugcagugagccgagaucgugccacugcacuccagccugggugacagaguaagacucuugucucaaaaauaaauaaauaucacaacgaggaaaguuaauuuuuagaaaacaggaguuagaauagacaucaguacuaugcauaauuuauacuuucauacacugaaacuucaaaaaaugggauugucaagaaggcaauaacuggucgggcgcaguggcucacgccuguaaucccagcacuuugggaggcugugguggucggaucaacgaggucaggagaucaagaccauccuggcuaacauggugaaaccucaucucuacuaaaaauacaaaaaaguagccggguaugauggugggcaccuguggucccagcuacucgggaggcugaggcaggagaaucacuugaacccagaaggcagagguugcagugagcggagacugcgccacugcacuccaaccugggcgacagagugagacuccaucucaaaaaaagaaaaaggcaauaaccaaaaugaagcauaacucucaucuaaugagaccccugaaacagcaaugacuagcuauaaaaaaaaauuguaacaccucuucauguuacauccagaaauguauauaagggaugcuucaagacucuaaaaugccucaucuuaggacagguauuuauaucuagccagaaugcuuuauugguguuuuaaaaguuaagaaauggccgggcgcgguggcucacgccuguaaucccagcacuguggcaggcccagacgggcggaucacgaggucaggaguucaagaucagccugaccaacauggugaaacccugucucuacuaaaaauacaauuagccagguguggcagugcgcaccuguaaucccaguuacucaggaggcuaaggcaggagaaucgcuugaccccaggaggcagagguugcagugagcugagauugcgccacugcacuccagccugggcgacagacugugacucugucucaaaaaaaaaaaaaaaaaagugaagaauuauuccaaguugauaggucaguauuuccacacauguacaacuaauuacaaugccaggcucugauaaugcacuauuuuacccugggcuaugaaagauugucacagugaacaucaagucccccucucuaucauagcaacuaaaaucuucuauacuuuaaaucaaguauaccacuuagaaaaguucuucuagauaaucauauuuuaguaggaggaacaagacaaucuccuaucauaauuaaaaggcacaguucagggggacaguaauguuugaaaaauuggcuuucuucaaacuucacuguacauucuacucuucauuuacucaucaguucaacaaaaauaaacaaaagaaaaauccaagucccucucucaaaccauuccaacuaguuugauuuuuuugagggaguuuuacaagaauuaacauuaacagaaaugaaaaugaaugcuaaccaaagugagaauacacaucauauacugacacaauuucagaaacuuaguaaacaagccuuaacacuuuaaggaaaaaaacuguuucaaaagugauuuaaucaguaaaccaauuucaauauuuaggcuaucaaaggggaaaugaauacuaauguggaaaaauauuaauaagaaaugaaaauagguauacugauaaagcauaaagugcuagcuaauaaaguaucaacaguggcugcucuaucaucagucucucaagagagacucuuacucuucuuugccuagccagugcaguaucuagaacucaaaugagguucauaaggguucgaacaagugacuucuagaagaagaauuuaaauguuuuaauaauguuaagaaauccagguacaucaaaagaccuaaaaagucaaauccagaaguuguauuuaauggaaagauuacaauguuaauaaaaucacaauagccacuaguacaucucaagaugaucugccugugacacuugugacagauaaaaacuaaagggaaaaaaagcuacaccccaagacaaacuaaaaguauauuauuaugagcugcuuucuuagugcuagaaaguuuaccacccaacaaagccuaccaucacaagaaauauuacaaaaauuguuauacuguaaaauccucaucaccaaaaauauuacaaaaucuauuauacuguaaaauucugauuaauaggcccaaaauaaauaucaaagcugaaaaacuaacauccacuagaauuuuaaauuaccugcagggauucccugcuuaauauagauacaauaucaucucaugugagaaacuugcuauaacaaauaauucaauuucuuuggaaauaaaucacaacuucuuauuaaaaaguauuuucuucuaaaaauccugugaaacccuuuaaaauguuucuuccaaugagcaaauaccugauaauagaaaaauucuuauacauggggcuacuuaaaauauuguaauucauguaauccauguucucaucauuauccagaaaaaugaagagagaaauauacuuaaaguuccucagaaaaguauuauucaaagucuuaaacuaauugcaguauuuauuacgacucguuggagucacauuuuuugucaaaaauguuacacauuaugacaaugucauagaacagucuaaaaagaaaauuugguacagaauuacaggguaaaacugaaauuacauuuuuuuccaaccauagcaacucuaagaaccuugggaaaugucaagacuuaagaugccugauaguuuuguauaggcuuaaauaaauauuuucucucauaccuuuuuaaaagcaggcggugcucucaaaggcaagaaauucccuguaguuucacauauauagagaacguucuuugaaucaacagugcuaggcauaggguuaacacaaggacuacagagacuacaaauugcugguuaacuaauucagugauagguacuugaaaauaccuacucccacuccuaauaccauuaucuaguuucaugaaccaacuauucaagaggcccaaacuuaacccaugcuauuacuucacauucuucuuuuauaaagagaaaaaucucuuuucaaauaggaaagauacucacaacugggcacuuccacugaagcuuuuauucucaaucuuucaaaacgaaagcuuucuaucacugucuuucuagaucuaucaaaacacuuagcagaaaaaaccugccgggcacaguggcucaaaucuguaaucccagcacuuugggaggcugaagcgggcagauugcuugagccccaggaguuugaaaccagccugggcaacauggugaaaccccaucucuacaaaaaaauacaaaaauuagcugggcaugguggcacaugccuguaucuccagguacuugagaggcugaggcagggggaucauuugagcccaggaggcagauugcagugagccgagauugugcugcugcacuccagccugggacagagcaagacugucucagaaaacaaaaacaaaacaaagacccgauuaguauguacuacauucuuuuuccaauaaagccauuaaaaaacugaagaaauuuauauuauucuccuuuacaucucagguuaugucuccguggcaaccauagugaauaguaccuuccacaccuaaagaggggcuaaccucuaaucuagccauguuuagccuauguguugcugugcucaaguuaggcuuuauuuuccuaccuuaauaaaaaagccgggagcugggcgcaguggcucacgucuguaaucccagcacuuugggaggcugagacgggcagaucaugaggccagaagaucgagaccauccuggcuaauacggugaaaccccaucucuacuaaaaauacaaaauauuagccaggcaugguggcgggcaccuguagucccaacuacuugguaggcugaggcaggagaauggcgugaacccgggaggcagagcuugcagugagccgagauugugccacugcacuccagccugggggacagagugagacuccauccaaaaaaaaaaaaaaaaaagccagggaggccaggcgcgguggcucacgccuguaaucccagcacuuugggaggcugaggcagguggaucaugaggugaggaguucaagaccaaccugaccaacauggugaaaccccaucucuucuaaaaauacaaaaauuagccgggcgugguggugugcgccuguaaucccggcuacucaggaggcugaggcaggagaaucucuugaaacuaggagguggagguugcagugagcugagauugcgccacugcacucuagccuaggcgacagagugagacuccgucucaaaacaaacgaacaaaaaaaaagccggcggcacaggcucacaccuauaaucccagcacugugugaggccaaggcaguuggaccaccugaagucaggaguucaagaccagccaugccaacauggugaaaccccaucucuacuaaaaauacaaaacaaaaucagccaggugugguggcgcacgccuguaaucccagcuacuccagaggcugaggcucgagaaucgcuugaacccaggagauggagguugcaaugaguugagaucaugccacugcacuccagccugaguaagacuuugucucaagaaaaaaaaaaaaaaaaagcucuauauuaguaaugaauacaacugcaguuuuuaauggccauaaacuuacaggauucuuaaaugcauaaaucacagaaauaugcaguaacugcagcuacauacacaguccuaaauagaauaucagguuuaagacucaaaguacaaagaccauuaaaaacauuuauuugccaaauccagugagaaacuaggagcaacuuaacagcugucuaaauaaccacaaaauauuaaaaaauacuucuggcucaauguaaaugacaucugaagagagaugcugccuccuccaacagacgucucauuuguucgccuagaaccauuuauauuucauugaagccagcuggugucuccguuugcaggcaugcaucaaugucuggugaacaaucuauguuccuguaaacccuuccccauucacaagcugcaguuuccauuuuuaauggcaaguuuccagcaaguacaaugaguucuuacaaaggaacuuaacucuucacagaauucaauuccuaaggcagauuaaugguaccaagccauaaacaaugugaauuaaugugccuaacaaacucacaaauacauuaacauucacagaaggguaucuucagaccauucauucacuacauaaugaaaacaaugugcuggauuugauugacggucucuuauaauguugcaauauuuugguuuuauuaaaauucuuucuugggaaugucaugacaaucuuuuggcuaaaugguaguauuaugagauguuucaaaaaccaauaguaaagcauacuuugguuuucaacuaacuuaccaggguaaguauugaugcagcuacuagaggcauucauuucaccaacgauauucaaugcuucugcucccccuccccuuacuuccacugaucacuuuuccuuuuccauacccagggguauuauaaaccucacugcugacaccccacaugaggguaagcaaacuuuuucuguaaacaccagagagcaaauauggaguuuucggggcaauauacugugugugacaacuauuaaacucugccaucgucaccugcaaugaacaauacuuaaaaaaaaaaaaaaaagaaugagcacagcuguguuccaauaaaauuuuauuuauggacacugaaauuugaauuucacauaauucucacgugucacaaaauaauucuuuugauucuuuuccaaccauuuaaaaaauguaaagaacauucuuagcucucaggcuacacaaaaauauggcuauacuuugucaaccaucccuagacccugaacagcauuucugaauuaguaacacuuagguguccuaaaaaacagguuugggauagcuguguguuaaggagucccuaaaaaauucauaaugccaauuagcauaauaaaggcucuaagccuugcgguuaagaaagcaagcuuaacuuccgucagcucagcuaguccuuccuuuuuccuaguauuaaguugcaacaguuugaaaaauauuuaaauaagaauagucaagucaaacuuccugggaugacuaaaaugauagcuaagguuuaaaacagacauccaaguuccugaaacuaauaaagccacaacaugacuucagcuaugccaucagaaacugaaaguaucuagaggagaacaaugauaaaauaaaguguauacaugcucugaaaaaaagucacuuuaguacucuaguucuacauuaauuuguauuauauuugaacucacagaugugaaaggaaaacaaagaguucccacaaguuugccaaucucaauuugguaagccacugucuacuuccaaaccuaacuacucauuuuaguuaaugacagauggguauuuacucccauaaaguuuaagaauaaucgguguuaaaauaggaagcuaaaaaucaggugcaugagaaaauuauuuccaaguuuacuaacaugaaaacugggaagcucuuugauaccugcacaacacugcagcucccauuaugacauuacaaaaaacauacaggaccauaccccaaauuggccauauaaacacaaagucaaacuaaauuacauuuagaaugucauucaaaacuaccguuuaaaaaauguaauuuuagcaagucaaaauuucaauuucaacuuguuuucucaaguaaacuuuuugcgauaauauucaaauuaguuuggaaauaacuuuuagcagacucagaaucaauaaggaugugauuuuagguuucaggauauaaucaaacuuccaaaguagaugucaaaaaaaaaacaccuugaagaaaauagcaguauuuuggaaagugaaugugaaucucaaucagcuggcuuaaacaauuccaauaauuccagucguuuuacuacaacaguccaauuaauuuaaacuugagauaauguggagccaacuguauuaaccaacgcuacagauaugccaaugaaaagucguuuacaaaggaucacaauucugaauaagugugcuuuaaaggggaggaacaugguauaguccccaauuguucacauacaugcccaagauuauuuugacauugagauauaguacuuuaauucccaaaccuagcacuguauuaauucacucccucgacugaaauguauugcugguuagcuccuuaaugaccuuauuuugaaauggcuuuauuaguuaaguacagaauccauuucaauuuccaaugauaccauuucacuaaaagacaaauuccaaaaaugucaaccaccaguagcucauucuugacauuggcuguuuccuuuuuuuuuucccaaaguaaagccuaacaauuaaucaacaaaugccuuuucaaucuaauuaaaacacaguuuaguaaggucauuaaauaaauuuaucuaagaauuuccguaaaaacucacuacaacucuaaaacaguauguccuuaaauuagaccaaauauuuaauagcaaaaaugguagcuugcauauucgagggucacuccauggauuuagaaaauauuuuuaaaugugacaaaaaaaaaaaaacacuaaagucaguuucaaauggaagucaccaaauacagagguauauacuucgguuuuuuaagcuacugauaacgagacauuuaaaucaagcuauggaaaggcuuugucuaaagggugauauuauuacuaaaggcucacacagaaaucuuugcaugcuacacacaaaggaaacauuuacacuucuaguccacaaaagccuauccuaggauugugccaggggcacacaaggauuucaaaguacagaaaaaacugggcauacacaugcccuacaaagcagccaaaagacauuccccagucucucucaggaaauguuucaagaugaaaagcaaaagucugaagucccuuggaaucuuggguugauuucuucauuauucucaaggcuagguuguuuucccccagcauacuuuguugggcaaaaauaaaacauuuccaaauaaaagcaacuccucagccccaauuuucaaugcaauaugcuuauuaaaaguucaacauuucucaaggucuagacuuauagugugaucauauuacaguacucgggaagagcauuuucuuuguuguugacccugcuagggaaacaggucuugacucagccaaaguggcguucuugugggugauuaaugacaggccuagaucucgcccuagugacauccaucccccaccccccacccccacuauacuaaaaucagccgugucugaacugaaggaggggcuguagccucgccucaaaccacccagucccagaguuaauagcugcaaccaaucgauuacggcaagcacacauccagauuggggugaaaugugacccuuucgccuaaauuuacgaauaauaucguccucucugaucauuuccgcuggggcuccagcgacuacggaaacaauuccaaucauucggcccaaagaaaaagaugucccuguucuacccaauacgggcaaggcaaagccccuacccaccuccaaacacuauccccuugacaucagcccauuucuauugugucuuauuagguccucgggcuacgaggaccuagugaaaaacguggcugcccuacuacuuugcuaagaacaagaaccacacaguccggcacccccaccccaggggccgcaucccacaccccaggaccccuguucccaguucucuccacuaccccggcggccgcggggccgggucccaccuguggugaggcgggaggagacgucgccgaagggggauggcuccauucggagauacuucugcggcgaggcggccgcagcggagaaggaggcggcgguggccgcggccgccgacaacggggaggcagcggccgaggugggcgccgacaauggcgcacaucgccugcgcuucggggacgccgggcucaacagcgggucgaaauccagaguccuuuucagaguggcuccgcacgccauggccgggggcagcugaggcgccgggcucggguggggucggggacgggugacgaaagaagagggugagggaaggggugaagagcgggaacucgaggagagccuacccgacgggcucaggagccaagcgggucgcggagcgccggcuguggaaaggagagccgcugccgccgcugccuccgcggcaggggcaguggccagggacggcccgggugagagcgggaggggcgguggcgggcagaagcacacgccagucgcgucagggggguucuuccgccuccucaggcgcggcucccccgagagaggcuccggccgcccccgccguccgcucgagcuuugcgccgcgccugaggcgcuucugugcugagacuagauccuuucugaagucgaaaacagcaccguggggugugaggcuggaacgcggcuccuaauacgcccgaguacggucaguagcuugcgagcggcgaucgaugcagagagauugcgagguagcugccgcagcaggaacccaagcgaacacguccaaccgcuuccccucccucguagaacucucccacccgccgccggccccaauauggcgucaauaaca

SEQ ID NO: 13913 - RNA, 26779 nt, Homo sapiens
ggaugguuagaaaaauaucuagcuuguucuuuucccuacaaccuaccucugaccaguccacgagguugaugagccugcuacacucuaggugcaguuuguaugcuaugcagaugucuggggcgauauucggaaugcagccuucuucgcuuuucagugcuucauucuaacaauuaacaguaaacuaagaugacuaacuuuuauaaauuauuaggaauaaaaucagacauuaaugaagcccccaaccuaaacugaguaaaccaguaaauggaaucuugguuucccuuauuuagugagugagucuauucaauaguuagcuaguucuuguuuagguuuaugucuuggucauaaccccucuaguucuuagucacuagaagaauauucccaggauuagaagauaagcauauuuuucauuucaauccauaaauuacuaauuucucagaccugaaugcacuuaauguaaaaaguuuauggaaaucuuuaggaauacuuaauaaaaugguacuuccaacacuuauaauuagcugaauucuaacaauuacuauacuguauuaguaaauacuaauaccacuuaccagggguauaaauuucuuuuaaagaaaagacuacguugucaacacugcagaccuuaagcccuauagaaaccaucaguguuucuucaaccuauuugaaauccauggcuuuuacugagaaacacaaagucuuacauacacacccugcucugauauuauaauaucagggguauauuauaauauaucccacccaaagacaacugaaaucauaccaguucucuucugugacccaccagccaagaagaagacagauuuuguaaguuuuaauuuaugguuuauauauuaaaauuaacugauuuuuugguuaaguaugaaauuauucagugguuuucaccaucacugaaaaccauugacuuauaucguccuacucaauauucuuguaauacucugcauguuugugugccguuuugcaaugagaagccaguacacuggaaugcucuucauaggucuuacggaguuguuucuuaaguauuuauuguggcaagauuucuggguauuuaacuuaccacucuuucauguauauacagcuuauugaauguuuaaagugaucauuuugcccggucauaagaaagcuaguuucuaaaauugugagcugucuugaacuauuguuuaaagagcuuccaggaguugauaacugugucuggacuuuagcaagggcagcugaagugugcugccccaggaguuuuaguggcagacugcugguuauccucuacacucagcucugcagaugcucucagaauagaccuuucuuuguuuuaaaauccaagaugaagucccaaaguauuucucuuucccacuagaaacaaccauuucggucuuucaguaauuuauuaggccauauuguuuaaucccugucugcuguuauguuuacaggaaacauuucuuuuauuuucacaagagugguaacauuauacucucaagucuuugugccuaugaucugacuuuagcaugugaagggcaaagauuacacauggucaaaaacuggcagcaacaguugacuacuaauugcuaucuuuaugggguuagaaauuuuuuucuacagucuaaagaauuuuuaaaaauauaugagacgugcaacccugaauugccgacucucugcucauuaaaacauaacugcaaauuuaguauauuuuuaugacaaugacgcccagagucugagcuaaacuaucagaaaacuaaauguucaucuuaccuugagauaauaguaaggauuguugagugcaguauggagggcaauucgcggagcagcauuuaaaugcucacgaagggcaugggcagcacugaaguacaccaccucauggagaggcugugucucaggaggcagaagguauucucugaaacagccagucaggcauccauguuuagauaagcacagguuuauuuucuuuauauauaauauauauauuuuuuccuuuaagcucuguuggacuucaauuuucacuauaacauuuuugucaauccucucucuguagaggacugaaccauuuacuaaaagcaaaauuaacaaccaaaaacaaacgaaugaaacaaacccaaauaucagcucuaauacaguuucacucagaacugcaucucuuccauauaauaguuuuuaaaacuaccucuagacucuuuauaagaagcuguauauuucaguucugaguuaaaccuuuaggaacaaauguauauauacuacauuucugcuuagaaaucuuuaagauagcauuucuuaaaguaaaugagaaaacagauaucuacauuuucuagcacagcaaacauuuaaccuuuggcaauauuaaacacaggccuggaauuaagaguucaggaaauucuucuuggaucacagaaaauuuuuaguugauaucuuucauggaaaugacaccucaaaaguugugggguuuuuuuguuuuguuuugguuuuuuuugagacggaguuucacucuugucacccagacuggagugcaguggugcaaucucggcucacugcaaccucugccucccagguucaagugagucuccugacucagcccucagccuccugagaggcugggauuacaggugcccaccaacacgcccggcuaauuuuuguauuuuuaauagagaugagguuucaccauguuggccaggcuggucuugaacucuugaccucaggugauccaucagccuuggccucccaaagugcugggauuacaggugugagccaccgcacccggcccaaaaguuuuuuauauauuggaauuacuuauuacguuagaaggcagaaaagacuaaaucuuaguuucagaguauugaaaaacaaaucauuaauaaaauuucacuuauaaaaaaucugccauaauuugggauuuuuuucaccuaugagcuagaugauaaaacaauuuuaauaaauucggaacuaaaaaauauggcauuaaaaauuugcuuugcauguauaaugagcccaucagguggucugugccaugacagugauacuauacuggaugccuggaggguggcaaauuggaggggagaagcuuuggcacacauaacccauagacagaguaaugucacuaacuggauuaaaguauauaguuaacucacaugacuucauaaagaagauuucuggggcuuaguccaguccugagccuaaaguauuuuggccacaugacagcuugugucagcuccuuuuccuaccaguacaagcagagcaaagcagcuaccucagcccagucacuggggacauuauuccccuucuuccaaguauccuuucucuucuucuggagaggauaccacucccuagaaauccccuacacuugcuuugucccgauguggccaggagcucugaagaagagaggaaguggaaaggguauucaacauggacaucacucuucaccauccuccuuuucucccccaucucaagagcuaaugaccccuugcucauucuaauucuaggugcugcuccuucuccagagucaacuggaacaaaacuuacuugcaaagaguguaugauuuugacuugauccucacuaagaaacaauauucuauaccucagauacuguuaacaucuuaauuacucaagguuaaguuaacuuagcuguagcuucaggaaauaguuucugugauggcuggcuaccaauuuguaauuucugaccauaaacucuuccuacacuaaccucaggcaguuauuucccaaucauuauacauggcugucauuaaaagaucuuguugcagucccugcuauguaauaaggauuggauaucuaacaaggcaaucagauagagucaacuucagaaacucaaacuaucgccucacauuuuaacauuuuuacaugugauauauagaaauucaggcauuucccaaggcaaaagaccucucuagauauccucaaagaaccaucagagcaaaaauaaaauaucugccuuaauuuuguuuccacuggcuacauuaguugaacaacaacaguaacaaaauacauuauacauuagaauuuuuaucugacugcagacuuggagauugacauagaaauauacuucugugacuuauuuaugugagaagaaguaagcaaugagucuggcacuaaagcacugcauuaugcucauuuuggauucagaccagacaaaugauaggccuucccugaaagaggugguucugaaggaacuggaggaauuaguaucaacaagggcuacaaaguugaagcuugcuauuggcaaaaacaguaacuuagaaaguggcaauuuauucucaucucucaagaucuggcaacuuauucuugccugccaguauuuuugccaagagcugcucaugguauacugugaacucugccuccugaagucuccugcuuauauuugucuuuaaaggacauccuuucuccauaacuccaagcucugcccagacaucugugguguggcuguugagggcaguguagagaaauggagagggccuuuuggcagaugucaggagaaugagacugugugaccuugcaugagucacagccccucucuggccuuuagcugccacagggcugacucuucaggucucuuuuagcuuuaacaugcuacaauucuaaucucuucccuccugggacaaucuugguaaagacacuaaauccuaguauggaagauuuugugauuuuacaacaaaacacauuuaauuauacugagcauuauuucaacaacugcucagaaagguaaaaagucagacauauuaggugaaggaucaugacagggaaacggcugaugugauuucagagccuacaauuuggaauuuguaagaacucuggaaccugacauuuggccuaaaauuggcaaaucacauugcaaaauuauuuuuagugacuaccauguucacugccugguaaaagggaagagucaagaguuuggggcuagacucuacaagaacaggaaagcccaguagggcaagguuaacucuguggguucuauguaauuuuugaccaguauuuggccaauauugcaguucaucacuuuuuuuuuuuuucucgagauggagucuugcucuguugccuaggcuggagugcaguggugcgaucucagcucacugcaaccucugccucccggguucaagccauucuccucccucagccucccaaguagcuaggauuacaggugugcgccaccaugcccagcuauuuuucguauuuuuaguagagucgggguuucaccaugauggucagguuggucucaaacuccuguccucaagugaucugcccaccuuggccucccaagaugcugggauuacaggcgugagccaaugcgcccggccuugguugaucguuuuggaccuuuucauggcauuagcaauuucuccccaaugacuaggaacaaugacucuguccccacauuauucuggaaaacuaagcuuuucacuuucagaaaagacauguaauuugucagaaaagcacucuuucucuuuaauaauugugcugcuauuuucucaguacuuuauucagugccuagccugcuguuggguuuaaacugccauuaaaaauuacaauaaacagggccgggcgcgguggcucacgccuguaaucccagcacuuugggaagccgagguggguggaucaugaggucaggaguucaggaccagccugaccaacauggugaaaccccgucucuacuaaaaauacaaaaauuagccaggccuguuggcacaugccuguaaucccagcuacucgggaggcugaggcaggaaaaucccuugaacccgggaggcggagguugcagucagccaagaucacaccacugcacuccagccugggcgacagagugagacuccgucucaaaaaaaaaaaaaaaaaaaaaaauuacaauaaacaaugauaacagguucucccccccccgccccacuuuuuagguauuaaaucguuuucuuuugcacacuucucauuuuuuucuguagcaugcccaacuuccaccaaacuuaggugggugauuuuacacggcuacauaaagcugacuuuugggaaauccaugaaucagaaugaucuggguuuccuaaaaaggaaacaucuuaaaauacaggcuggauugguagacuucuaaauuuacccagcacaugucucaacauaaauuuagugcugauaaugaggugcacuggcauuguuuagaauuaaauguucuuucuucaggauaaaauagagcagcauggcuagucugcucuacuuucugggcuuggcucagauccagcauuuacuccuagcaaagauaaaguguaauacaaauacuuuauuauuagaaagagaaacauucacuuucuaucucaucucuccccaccugaccuaaugaaguagaucaaauuuaagccuauauucuuaacugagauuaaaagaaugaacuaagucauuugauuagacaucuugauaaugauggaaaaagaauaaaaauuacaauucuuuuuuuuuuuuuugagacggagucuugcaccguugcccaggcuggagugcaguggcacgaucuuggcucacugcaagcuccgccuccuggguucaugccauucuccugccucagccucccgaguagcugggacuacaggugcccaccaccacacccagcuaauuuuuuguacuuucaguagagacaggguuucaccuuguuagccaggauggucucgaucuccugaccucgugauccaccagccuuggccucccaaagugcugggauuacaggcgugagccaccacgccuggccuaaaaauuacaacucuaagcuagauggagagaccugaaaagcauaaagccuaaccuaggagaaaaauguucuggauuggcuauagacagcuaugacaccaguguuauuuggaaaaacagcaugauuuuuagcucuuaagagcuaaauuuagacuuaccucacuagacagucaaugaaguucacaacauuuucucugaguacuucaaauuugguuugcuucuuacuucuucuuaacuccuucauuuccaauaaggacuauagauaaaagaacauagcuuuucuggugauccucagacagaaaaccccucagagggagcucuguugguaaguucuauagaagcaccugaugcccuuuccauaagacaggauguacagagaaagaucaaaauggguuuuguuuauucuuuuuauuuuuaaggucuggcaagaaucucgccucaaagguguuuugcuuuauaauauacaagcaaauuuuuagggaaagaagaaaagggcaguucacuuuacuacuaaauuacauggcagagugcucacuauucaguccauuaagucauuuaagaaaaggacuuaacaggauaaagaaaaaaaucuugccuuuuugccauacuaacagaauagauuccauguguuuuauuuuacuuagauugaaauuuuacucuacauuuaucauaauuugguaucacaguacaaagaagguucuucauuucgacaaucaagauccuaaaguuagaacuaucugaaaaagaauauauuggauauacuguggcucaauuucugcucuauacuugaauaugcauuuuaaaaaaucaaggaaaguaacuaaaacuaauuaguuaggcucuuuuaaaucucucaguuugaucaaacagaaaaauacaucagauaaauaaucagauuugugcagccauguucccauuuucucuuauugcuagcugauucucuuucucuugcugagcccacaggaaugguuuccaccuauguuagcuaguagguuccagaauguguauauguagaguaaugauggcaaugggacuaacaggauguucaacuuagaagugaguuaaaagucugcuuuguuccugguugugguuuaaaaaugaaaacaaaaacauccaggcagaguuaaucuagagcacaaacugaaaaaagggagugucacaggaugcagcuggaagggaagagagugaccugaccuucugaagaugauagaggucugucuucugaagccccuuuggcugugacccagaagcaucuucuuccucuuugguuucugcuuuuaauacaaaaccaguagacaucaaugaggguaaauccaagucaagggaacaaacauuucuacuacuccaaaguaaaaguuucaccuauauauauuuuuuuaauguggcaagggaucaagauuccaucugauaaaugauuucuuacagaagcugaaggccaauaauauauaacuugugcuguagugaugucuucaaaaaaucagcuacugaauuuuaaaaguguaaccacaaugaaaacaaaacaaaauacaaccuaacaaaacucccucaaaccaacagcaaaaagucucaaaaaaaaaaauuuuuuuuuuucagauggagucuugcucuguugcccaggcuggagugcaguggcgccaucuuggcucacugcaaccuccuccucccaguucaagugcuucuccugccucagccuccggaguagcugggauuacaggugccggccaccaugccuggcuaauuuuuguauuuuuaguagagaagggguuucgccacguuggccaggcuggucucgaacugcugaccucaggugauccacccgcuuuggccucccaaagugcugggauuacaggcacgagccaccaugcccagccagucucaaauauuuuugauguuauacauagcuuuuuaaaaaaauaauaaaaacuuaaaacuguuuuccuuugauuaugucaagauuguaaacaacaaaauuugaguaugaggaggguaguguguaaaaguuuugaaauaauccacuaaaacauaaagugcaucaugguucuuuagcaaagggaaagaaaaccauaacugcuuaaauguacagcugugcuccuucuagagagcauaaugcucucauauucuucuucaagugcagguuggguuuugugaaccccacacacaugguuuguuuggccuaaaacuaugacaggaggaugcagcuggagaauaugcauuggcuuaaagaauaaacugcuuuuuagcuacagcuaauuucugguucaaaaaagacauaacuaaagguuaaaaugucuacuagauucuuugucccaugucauuaacauguaguuugcuacauguuaauaaaccuaauaugccuuugaaauauaucuaauaugggcugaaugaagugccucauuccuauaaucccagcacuuugggaggccauggugugaggaucacuugagacaaggaguucgagaccaggcugggaaacauagugagacacugucucuauuuaaaaaaaaaaaaaauaauaauaauaauuaggcugaugagggggcuuaugccuauaaucucaacacuuugggaggcugaggcaggcagauugcuugaacccaagaguucgagaccagccugagcaacauggaaaaaccccaucccuacaaaaauacaaaaaaauuagccaaguguggugggacgugccuguagucccagcuacuugggaggcuaagaugggaggaucacuugagccugggagguauaggcugcagugagccuaucaugcuacugcacuccagccuggacaacagugggagacucugucuccaaaaaaaaaaaaaaaaauucagcuggauguuguggcccuuuucuguaguccuagcuacucaggagguggaggcaggaggauuacuugagcccaggaggucugagggaacugugagcuaugacugcacaacugcacuuaagccuggacaacacagcaagauccugucucaaaaaaaaucugauaugacacucuguccuacuuaacucuucccaacuguaauuuuaaacccaaacuguaauauguaauaaauguuaaggaacacagauagcauauagccaaauauuucuacucauccaacguggggaguuuuaguuucaguuuauuauuaauaaugagucacuuuugaaaaucaggaaauaacagacauuucuucaagacagugguugugcuuuaauuuguaaaauucuuuauucuuuaggcuacuaaucaucuuaaucuucgaccuucccauuucaaaagcugcauuccuuuauuuagcucuagcauaucacagaauuuguuuacuagcucauauuauaugaacucuaauuaaaaauguaucuagauuaccucguuaauggugcccagcaaaaaaagaagaaaaaauuauaugugcaguuuauuuuuacagcaaucuccauaagucccauuuuguaaaagacugaaauuuacacaguauuuaccuucuauuuuucuaagccuuuuacccuauuuauguacuuaagguuggccccuugcugauccagugaucacuauuagggcguauuuauaucgugaauuagcgacagaaaaacaaugaacuagugguuaagagagaugggcucuggucugagugcuaccacuagcuagcugugugaucucaaacaagcugccgucuucuccuagacuuuaguuucugguuauauagcugaacucaaugaucuuaaugauaccaacauccagcccuuaaaaguuuuuguguucugaagagugguugaguucaugcugcaguggcaagagcaaugcccacacauaaccugaaagaaaaucccuuagugccugcugaugacuuccucacucuggcugcucaggccacucuagucaggcaaacauucucuuucaucuuccaugacugagcacucaucaggugccucacauuguagcuauggagagauaugggaagauuuuugcaaaagcaguuuccuaaagccaaaagauuuuuaagacaaagaagcacuugccaaacauaaaaaaggauuaaaacagacauuuuaaauaagauauuuucaacaugucauguccaauucuaugugauuauauaugaaaaaacuaccuguucccccaaaacuccauuaaaaaauugcccuaaauuugggaaaaguaaaacguacacaccaauauauuuuauuguuguuauuguucuacuaaaagaauaccauacuuuggugcuagaaacagagcaagagaagagcccaugaaaagcuaguauuuagggaacagaacauggcuaccuauauacaaucagacacccuaagcauucaggauauauaaaugaucauguggaggucaagcaaaagagagaaacuguaacccuccaacagugaagagugccaggcugcuucaguuaauuuaggacugaaagauuccagcuuuuguaaauccgauuaaaguaagccucaugcagauuuugguaaucaacauaccaaugagccucacugcugugaaagcaguucauagcuauuaauuuuucaagcuuacagaugauuuaugcagugcuuuggaaaucuauaaagaacuugaugaaaugcuuaagaaaaaaccucuaaaaagaguucuuaauuaugacacccugcuacucuuuccaaucuuuuugauuucuuuuuguugacuuuuuaaagacaaaucccccaaacugucgaucuggagaaagauuuucuuuuucugcccauuugaugcucuccauuguuuaaaccaaaucuagaagagaaacauuuggccuauuugugauuguuaaaaugugauacuaugaggcuuggcauacugacugaucaugaacuacuuuaucucuuuaucucuaagcacaucagaaggugggguuuuccaugccauuuuaguuaaaugacugucauggccaauagaauuggaaggauauuacacucuuaccaucgaggcucugaaacugggccaggaacuccucuauucucuuagcugugcugccaaggugguuuucacaauaagacuuaaaaaccuugaaacauuucucaaguauggucaucaguucauccuuugccaacauccuagaacagagucagugacaggaaauguaauauaacuagaaaauuaacacuuaaaaaacauuuuauuuaauauacauauuaaauguuuccgcucagaagauaaaagaaauucuucauuaguagcuaccaacauuuuuuggagagauuuuccuccauauaugugacauucagaagaauucuugaaggguucucaugauaaaguuuagcuuagaaaauuuacaaaggucuggauucauaguguggcucuaacaugauguuuguaauaaagaauaagguuauuauacaucucugauccuugguucguugucuguaaaauggaaauaauaacuugcuuauuucacagguuagauggagacuuaaaaauuaaaugagaagaagcaguggaagacucuagcacagugcuuaccacacaguaggcauuuaaugauaguuuuccuuucuuuugaucuaaacguacauaugaaauaagaaaugucuacagaagauaugacgugcuaaauguaaacuuguuugaaagaaccaaaauaguacacucauuucucuaauuaucaccauuuaaacuaugcuuuacaucuccuaugggcuuuauaaacaucagucaguaaacccacugaacuuuaaaugaaguaggcagaucuaauuguuauuuauagcacaggcagagugguugaguagcucauucacagcuauagaagaaaucuuuguuagaaauggagagaaaauacagauauucuaaaguuaggaucuuguucuuggaguuuacaggauuucuccacuaagaucauacucaguaauggcaucaaaaggaaucagaccaauauuaggaauuuuuaagcaguggcauuacacaaauauucaaauuauucucagcaaaugcaucuaagucauuaaaacuaugaugauuaaaaguucuaauauuuccaggcacgguggcucacaccuguaaucccagcacuuugggaggccgaggcggguggaccacgaggucaggagaucaagaccauccuggcuaccacggugaaaccucgucucuacuaaaauuauaaaaaauuagccggguguaguggugggcgccuguagucccagcuacucgggaggcugaggcaggagaaucgcuggaaccggggagucggagguugcagcgagcugagaucacgacacugcacuccagccugggcaacagagugagacucagucucaaaaaaaaaaaaaaaguucuaauauuaaccaugaaguaacagacaaauccagaaugugggcauuuuguaauacaacuaauucacuuauauuugacaucuuucauaauaaaaaaaugaggagaaauacuaauauugcuaacuugggagaaagaaacaaagcuaaguagacuaugauuacugagaaauugaacugguuacuugaacuaaaauuuaaaccccaacaacaacaacaaaaaguagacaaccacuaaauauggcaauuguuaaggguagaccaaauaguaaauuuccacaggguuuuuuuaaaaguauaaaacuuuaucuuccucuuucuacaauaauuaucuaagauauaaucuuuaucugugaaaggcagcuaacuggucaaggaaaaauaagccaagacauuucauacuugauuacaguugagauuuaaaauuuguggcuuucuauugcccagauagaguuaugagaagaaaguuaacucaaagucagauacacuugaacaaucuguuaaaccugaccuuuaggccuauucaaauagacaagauuagcauuucugguguccaaggaaucaccggcacugacuugcuuggaggggaaagacgggugagguucugcuggcagaagaucuaacccaaguuagcagcaugugaaggauuagcuucccaggauaggggcagcaacagcucuuguccacuuugagcuccaaauaacugaauaucaaggaaggccaaaccuagccuauuauccaggagaccaaaaaagagggcauuauuucauauaacuuuggaagcaaacuucauuagucauaacucuuaaugugucacuuggagaagguacucagauguaaacugccagggauucaaauaguuauuaguccucuuauucuuuuuuuguuuuuucuuugagacgcaguuuugcucuuguugcucaggcuagggugcaauggcgugaucucggcucaccgcaaccucugccucccagguccaagcgauucuccugccucaaccucccgaguagcugugauuacaggcaugcaccaccaugcccggcuaauuuuguauuuuuaguagaggcaggguuucaccauauuggucaggcuagucucgaacuccugaccucaggugauccgcccaccucggcuucccaaagugcugggauuauaggcgugagccacugcacccagucuaguccucuuauucuuagccaaagauuauguuuugcucccagagcagaaagaucuuacacuuucucaaguauucucuuguuuaauguaaaaugacaagacuugagauaaggcugauuagaaauaauaacuuaaccaaccccaauaaagucauuauuuaaaauuuuuuuuccaguaaaauuauacacacacagaaucaaugcugccugcuaucaucacuauuauucagcaucauucuggagucuagaugcuacaauaaauuaagaaaaagaaaugguauaaauguuaagaaggaggaugaaauuaaucauuucauaugaugugacuguaaaguuagaaaaucuaagaacugcaaauaaaagagaguguaaaagagcugggcgugguggcucaugccuguaaucccagcaguuugggaggccgaugggaagaccacuugagcccagauguuugagaccagccuggccaacaaagugagacccucauuccuacaaaaaauagaaaaaauuagcucagccugguggcgcacacuuguagucccagcuacugaggcugaaguaugaagacugcuugagccugggaggucaaggcugcagugagccgugaucaugccauugcacuccagcauggguaacagagacccucucucaaaaaaaaaaaaaaaaagagaguguaaaaaaguaagugaauaaaaaauauauaugcaugcauauauacauauccauauaauguaaucaauaucuuauauuaaacuacauaaugaaaaaaaagcccauguucaaaaugguaacaaaaccuacuaaauacacagcaauacacauuauaauauauguguaugaccuauauuaaaaaagcccugaauaaaugaauagacauuuuaacacucacuauuguaaagauacaaaucuuuccaaauuaaucgauauucuuaacaguuugaaacaaaauuacagaggguaaauuuuauuuuuauuuuuauuugagauggaguuuggcucuuguugcccaggcuggagugcaauggugcaaucucagcucaccgcaaccucugccuccuggguucaggcgauucuccugucucagccuccugaguagcuggaauuacaggcaugcacugccacgccggcuaauuuuguauuuuuaguagagacaggguuucuccaugcuggucaggcuggucucgaacuccuaaccucaggugaucugcccgccucggccucucaaagugcugggauuacaggugugagccauggcgccuggccguaaauuuuaaaaacuaaaaauuauucugaaauguaucuggaauaauuguucuaaaaaacaggaacaauguguguacacuugaguguguaugguagggcuguaaauacauuaaacaguguuaagcuaugaugauuaaaauugaugguacuugggaauagacaggucaacagaagagaaugaguucagaaagagaucuagguguacauggguguuuguuaugucacagggauagcauuucaaaucagugagggaaaagauacuggguaucagaauuaacuauuuuaaaaaaacaggucacuaucucaccuuauacacaaaaaugcauuucagauagaauaaaaauguaaguacggucugggagcagggaaaaagaacuagcucaucaaccauaaaauacuagaagaaaaccaagaaagauauuuaagccugauaauauccagcagcagcaaaaguguagggaaauacacacugguacaugguuggugugaguguacacuguacaacaauguuuauauuuuagacucaauauguuuacaucuaccuuuguuuuguggaaauaguuauacaaauacacagacuuaccacugcucaugauuauuguuuguaauagugaagaauuagaaacaaucuaaauauguaucaaaaaagggucugauuaaauaaaaagcacuuuaaaaacaugauauuauauagugaugagaaacaaugagguagggcaauauguaauacuaaugaugacagcuaacauuuauacccacauauguguaucaagugucauuugauacaauacaauguaaauacuauuauuauucccauguuagagaugagaaaacaaaggcacagagaacuuaaguaaacuuguccagaauccaauagcugguaauuggcaaagcugggguuugaaccuagacaguucagcuugacauccaugcucuuacugagcaugcuauauugcaucucaaaacauggcaucugugguagaauauuaggcacaaaccaaaauaaccaccacaacaaaaacaaaacaaacacaaaaaaacaaaaaaugcaaguguggaacaccauauauaguauuauuuaauauacauuuguguguggaaaaauaucugaagugcaaauagcuaacaguggaugacugguuuucgagguuauauaauacaagggguaauaucagaaaaauacuuauuuuuucacuuagauuauuagaaugacuauagcaagcacuuuuuuuuugguuuuguuuuguuuuguuuuguuuuguuuuugaggcagagucuugcucuguugccaggcuggagugcagugaggcagucucugcucacuacaaccucugccuccuggguucaggcaauucucauccuuuagccuccagaguagcugggacuacaggcgcaugccaccaugccuggcuaauuuuuuguauuuuuaguagacaggcgguuuuaccauauuggccaggcuggucuugaacuccuggccucaagugaucugccugccucggccucccaaagugcugggauuacaggcaugagccacugcggccaucaaagcacuuuggauaaaccaaaccuaacugaagaagaucacuugaaaacaacuacaaaauauuuagcuuauuccaaaaaaguguguuuauauauagcaccucaaauaaaaaauuaaggauugagucuagcuaucagacaagcauuuuucaaacuggguuucaacuccuuugucagucaugaaccaaucauucaagagauauuuauugaaugcacacuacauacuagucacuguucugggcauuugagguacaccuuauugaaucaaaaaucacuguccucacggaacuuacauucuagugggagagcugggagaagcacagacaugcacuaucuaucuauaucauauauacgauauaugcguuaaaaauugauaaauguuauggaaaaauauugaacagaauaagcggagagccaugggaggaggaagcuuucaauuuuuaaaugguuagggccucacugaaaagaugacauuugaucaaguacauaaaggaggaaaggaaguuagccauacaaauauccagaagagcuuuuccuggcagacagaacaaugggugcaaagguuccauagugggcauaucuggaauauucaagaaaacaaggaggccaagaugucugaaauggagagagaaaaugagcaguaaucagagagaggccauguggggagaggaggggggcagucacauagugucacuguauacggcuuuuacucugagugaaaugcggaguuaacggaggguuuugagcaaaggaguaacauuaucugaaauauuuuaaaaggacuauucugacugcuacuuugagaagaaccuguaggggagcagaaaaaccagaaaggaggcuacugcaauaauacaggugagcaacgacgaugacuuagacuaugaugguacaagugaaggaagguggcaagaagaggucugauucuggauaaauuaugaaggcagagcccaggcuucugguuugaaaaaucagaaugauaagagacaguaggaaaaugauagauuucaggggaagaucaggaguucaguuuuggguagguuaacuuugagguguguauuggauaucuaaguggagguauuaaauaggacauaaauggacauaacagccuggcacucaggagagagguauaggcuuacgauuaagcccuggggcacuguaauguuaagaugucagagagaagagaaagcacuaaaggagaauguaaaggagcauauacugagguaggagaaaaaccaagaaaguccuagaaauccauuaagaagggagugaugaacuguagucaaaugcugauaacagguuaaugcuagauuuaggaacauggaggucacuggugacuuugaucaaacuaguugugaucuggagcacaagccuaauuguaaucaguuaaagagaaugggagaagaauuagagacagugagacaaugcuuuccaauuuugguacauuccaacuaacauuuuguuuuaaaauaaagagaauaaaauuguaaagaaaauagcagaacuaaaaaguuugaaagccaccaugugagauuaaagagaaauaaaaaaaaugucuaagauaggucacauuaaugccacaaaagagcgauuuaucuuuaucccacuuaauuaagaaauaauuacuucacaauuggcagagcacgguagcucacgccuguaaucccagcacuuugggaggccgaggcgggcggaucaugaggucaggagaucgagaccauccuggcuaacacagugaaaccccaucucuacuaaaaauagaaaaaauuagccgggcuugguggcaggcgccuguagucccggcuacucaggaggcuaaggcaggagaauggcgugaaccugggagguggagcgugcagugagcugagaucaugccacugcacuccagccugggcaacagcgcaagacuccgccucaaaaaaaaagaaaaaaaaaagaaaaaaaaagaaaaaauuauuucacuaucagguaaaugguccaaaaaaugccugugauaccuaauguauuaaaagcuuuauagguaaucugucacaggaguugagaaaaacaauaaaggcuuuauagauugucauuuuuuaaaaaaguuuucuuaacuaagaaagagaaucauuaagcaaucauuaaaagcaaucauccugcagggcaauggaguauucugcuucaucauacagaaagccaauaauuucugguuaaguacuaauuauauaaaugucugauuauaagaacuggcuacaaggaaaaacuggccaauccauggcuaaugaaaacaucuuuugccugacgaguuuucaaauucuaaacaaacauuaccauuaccagcuaguuuugaaaaauacucagaacucaaacuugcaaauguauauauaucaaugaaggcuggaaguuaaggaaacaaaacaaaacaaaaaagcauguaaaaauaauaaaaagcauguaaaaaaauuaagaagcauguaaaaauaagaaauugucuuauucaaagacuaacacaacaaagcaauuauguaggaugauaacaaugaaacagaaaccaaaaguauguguaucgccuccuaagccuugauauuucauauuaggugccccuuccuagagaagcugccaaccccacaaauggagguuaacuguccagucuacugguuccucagcacccuagcccugacccaucacagcucuuacuacucugaauuguagcucucuacuguucaugucaaugauuugaccaaaauucuguauagguaaggaccaggguuaucuuugucaucugaucagugguuucaaaaaugaagcauuuaaaaaaccccuuuuuuuuuuaauggaugggcaaagcaauaaccaugcaauaauuaauaauuuccuaaccuaaugccuuagugaagaauacuuuuucuaaagagaacaguucucaaacugguucauccugggaagcaccuggaagucaugaugcccuuugugggaugccaugcuuuuuuguggaauacaucaaaaagaauaaauuuaauucaucacaugguuagaagcaacuugaguaaguucaaauauacacauacuuuauugaugcaauuuuuuuuuuuuuggauggagucucgcuuugucacccagccuagagugcacuggcacaaucucaacucacugcaaccuccaccucccagguucaagugauucucccaccucagucuccagaguagcuggaauuauaggcacacgccaccacgccaggcuaauuuuuguauuuuuaguagagacgggguuucgccauguuagccaggcuggcuaacuccugcaaccuccaccucccgaguucaagcaauucuccugccucagccucccucguagcugggacuauaggcgugugccaccacgcccggcuaauuuuuguauuuuuaguacagacaggguuucacuauguuggccaggcuggucuccugaacucaggugauccuccugccucagccucccaaagugcugggauuauaggcaugagccaccaugccuggccuauugauguaauuuuuaaaaguacagucagccggccgggcgcgguggcucuacgccuguaaucccagcacuuugggaggccgaggcaggcagaucacgaggucaggagaucgagacuaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaaaggacagucagccaucuguaucugugggucccacauugguggauucaaucaaccuuggauugaaaauauuuugggggguaggagaagagaccguauagaacacguacagacuuuuuucuugucauuauuuucuaaacaauacaauguaacaacuauuuacauagcauuuauauuguauuaaguaaaaaguagacaugauuuaaaauauaugggaggaugugcacagcuuauaugcaaacacuauauaccauuucauauauggaacuuacgguguccucuuaaaaccaaucccccacagacagugauggaugacuguauaacccugaguucacaagaaagaaagaaaagaguugucaaaauuugaugaguuauuucugaguuuuuaaaauuaauguuucuuaguuaucuguucauuuugcuaacagaaaagugacaguaggcaguaaauguuuaauaaagaaaaacaaaauacaaauucagaucuuuuuuucuguuuacugugauaaaaaccauuagcucacuauuagcggaauaccgcaguccaguuuucgagccaauuugagaucaacugccuacagccauucagcuucuccacaaauaaagacuuuuccuuugauggcuucauuguuuuccucaaaaguuucccccuccccgcuuuuuuuuuuuuuaaccucucccuuuauuuucuggaaguauuugucaaaguauaguuccugggucaucugucugaaugugccagagugcuuguuaaaugcaaauuccugcugaaacaccauaccagcguucccaacagaagcucuggggaaagagcugaaaugaucaauaucucagcuaauucucugaccuccugaucagcccgccucccaaagugcugggauuacaggcgugagccaccucgcuaggccauaucucagcuaauucuuaugcacauugaagccuggaaaccauuacacaaaaaaacagugacucucaauaucuuuuguuucaaagagagcuuuaacaauucugucccaagccugauuucaucaucuguaagccuacagauaauugugaaggcccuaaugugaugcaaauucaggauuggcaauuccuuuucuaaaauaaagaaauuauauuauuuuauuuauuucuauuuuuauuuuucauuuuauuuuuauuuuuuauuuauuuaucuuuuuugagacagaguuuugcucugucgcccaggcuggagugcaguggugcgaucucggcucacugcaagcuccaccuccuggguucacgccauucuccugccucagacuccugaguagcugggacuacaggcgucugccaccacacccggcuaauuuuuuguauuuuuaguagagacaggguuucaccguguuagccaggauggucucaaucuccugaccucgugauccauccgccucggccucccaaagugcugggauuacaggcgugagccaccacacccggccauuuauuucuuuauuuuucauuuuauuuauuuauuuuugggacggagucuugcucuguuguccaggcuggagugcaguggugugaucuugguucacugcaaccucugccucccggauucaauugauucuccugccucagccuccugaguagcugggauuacaggcaugugccacacuaauuuuuguauuuuuaguagagacgggguuucaccacguuggccaggcuggucucgaacuccugaccucaggugauccacccaccucagccucccaaaguacuugaauuacaggcgucagccacuaugcucggccuauuuauuaauuuuuuugagacaggguuucacucuguugcccaagcuggagugcagugguacaaucacagcucacggcagccucaaccuccugggcugaagugauccugccucagccuccaaguagcuugggcuauaggcaugcaccaccacgcucauauacuuuuuguauuuuuuguagagaugggguuucuccauguugccuaggccagucuuuaacuccugggcucaagugaucucucugccuugaccucccaagugcucuaauucauaggugugagccaccgugccugccagaaauuauauuuuaaugaugcagucuuacaaagcucuuggauggauaaaucuacaucaucauaaguuagauuauuaggaagcuuaucauagauuguggagcugugucauuuuuccuaaguagaucuuuaaauaucaccuaaaguugaucugcaaagucaggaaauaaugcauuacuuagaguccaaauuucuagucucuuugaacuaagcugaagugaucaaauguuaacaucauuauucaggucauguuuuuauuuuauuuuauuuuuuuacucaaugaaagcugagcugaccugcuaauauauuacuguuuaagucaaaagccuuacucagaaauuagaauaauuccuuuagccuaagguaaauuccuccagcuaucaaucaccuucgauuuguaagucuguuucuuugcaagcucauaagguuacacuuaggauaagcagacuagacacuguggcuccuuucauuuaugucuguguccugugccaauaugacuagugucaggaugggggaggaggguaucugaguccacagaagcuugcucugcugguuuaaaauuuuggauacacucugaacauguaauacuggccacaaaaccauaaauuuccuuuuauuaccaccucuaaguaacuggaauaggguugaaagaguuucagcucugucaacuguagaaaagucaauguuucuggccuugguuuccucauuugaaagaaaauggaauaacuguagaugaguaauucucaauugaugagguagagcacauaaauuccccuaagaaguggggcacacuuuucauuauccccaauccaagaauccacugcuacugguaugagaguguaguacucuucagaucuggcugauccaacauacuccuuuaaguugaggcucugauuuuuuuuuuuuuugagauggagucucacuugguugcccaggcuggagugcaauggcaaggucucggcucacugcaaccucugccucccaguuucaagugauucuccugccucagccucccgaguagcugggauuagaggugcuugccaccacgccuggcuaauuuuuuguauuuuuaguagagacgggguuucaccauguuggucaggcuggucucgaacuccucaucuccugaucuugugaucugcccccaccuuggccucccaaagcguugggauuacaggcaugagccaccacacccagcugccucugauuuacaauaacccuuaaaaccuuauuuaugcaagguucagugaauuuuaaaaauaugaaaaauuacuggccuagcauuugauuucuagauggguguucagaaauuuucuccaauagagggguaaaauuuuccucuuacagucuuucacaucugauaaggaaaaacaguuguacuuaccuagcucacugcuggguuagcaucauuuguuacuacuuucuguucccaaauggcuuuuuaauggaaacauauccuuauauaaugacacaggguugagugaaaaauuaaccuacucauaucccauauagggauguggucuucauacuccaagaguugacugagcaaggaaaggcagaacauaugcagaaccacugagcucaugucaaauaauggcauauauuauaaaugaacacuugcaugcuccccacacacaugaaugucuguugcauacauuuaaaaaauaacugugauauaaaauuauauaggucuuuuuccacuaauaaauaugugacauaaacauucucccacauuauuacaaagucacuguaaauauguuuuaaauggucaccagauauuucuucaaguagaugacauauuguuuguuuuauuuuccagguuucaacaguuuuauugggagguuuuguuuucugugaaauacacuagaggcuggcugaagaaggggacacauucccuuuacaagauaaggguuucccaccacuaaagaaaaggcaugaggcgugacacacugggguuugaauccgccuccuucugcuuugcucacauuucuuuuuuucucuuucuuuuauauguauauuuuugagacgaaaucucacugucacccaggcuggagugaaguggugcgaucucagcucagggcaaccuuugccucccaagcucaagugauccucccaccucagccuccaaggaugggaccacagaugugcaccaccaugccaggcuaauuuuuuuuuuuuuuuuuuuuuuuuuguauuuuuggcagagaggggguuucaccauguuacccaggcuggucucaaacucuugagcucaagugauccgcccaccuuggccucccaaagugcugggauuacaggcguaagccacugugccuggccucuucuuucucaaaaaguaucacagaacacaaacacaaagccaagagauaaaaacagcaacaucaaccuccaacagggccacacccacaccuugucccacuccccaggcugggucaggccugggaggggcuggggcagcuacuuacucuacaguccccaggcugcagaaggcugcaggcucagaaggggugggacuaaauuaauaaauuagaauaaauuggggggaggaaugcaacuuugugcugggagggccccuucucucuaacacgcaagagaguuguugggggaagguaggaggcaucgccaaaggccacuaugguggggguaagagcagcggaggcagaagucaccuuuucuuccauguucuucccaaacaaagcagaagaauuagggguagagggaugucuacagccauacuaaccugaaugggcuggaucucaucugaucugugguuauuuaaacaugucagcuuccacauacagauugaguaucccuuaucugaaaugcuugggaccagaaguguucugcauuuuggauuuuuucagauuuuggaauauuugccauaugugcauaaugagauuaucuugagaaugggaugcaugucuaaacacaaaauucauuuauguuucaaauacaccuucuacacacagcuugaaaguaauuucauagaauaauuuaaauaauuuucugcaugaaacaagguacacugaaucaucagaaagcaaaggugucacuaucucggccaacuagauggacaaucaaucuguaguugcuugguauccccaucauuacugacucuugaauuuauaugcaaccauuuucuuacacuuauucacauauaaguacuuaacacuuaaaaaacaggacacaccauugguacagugaaaaaauaauguguuaaguguaacuaaguaauacccauaucaguguuaaacaacagcaacaaacaauggcaagcugaauaaacuguggugugccucuguuuugcugcaacccauuucaugaggucagguguggaauuuuccauuugugguaucacaagugcucauaaaguuuugaaauuugaaguguuucaaauuuuagaggacuuugaauuucagauuuucagauuagagaugcucaaucuguaaaaagcauuuuuucuugaaaaauaauuuaagcugauucuuauaaaaaauuucaaauaagaaauuuaauuagauuauguuucuaauaguaccuuaagcaguuauucuuuccaaagcaucauucaggggucauuuuagucuuuucucucaugaguuaaauaaaauuucaagacaggugaugagaauggucucaaguucaggugaugccuauugagaaugccuuaacuaaaaagcgucccugacuucugcucuacaucaaaucuguacaaaggagaaaaggcugauuccagcccagagguuccccaauuccuuuccucuuuuauagaacccagacuccugccuguccuugcuguagguauuauauuugacccauagugcuuuuuacauugcuuugcucuugacugcccauguuucugaccucagcuuagcaaaaugaaaucucau

SEQ ID NO: 13914 - RNA, 26779 nt, Homo sapiens
augagauuucauuuugcuaagcugaggucagaaacaugggcagucaagagcaaagcaauguaaaaagcacuaugggucaaauauaauaccuacagcaaggacaggcaggagucuggguucuauaaaagaggaaaggaauuggggaaccucugggcuggaaucagccuuuucuccuuuguacagauuugauguagagcagaagucagggacgcuuuuuaguuaaggcauucucaauaggcaucaccugaacuugagaccauucucaucaccugucuugaaauuuuauuuaacucaugagagaaaagacuaaaaugaccccugaaugaugcuuuggaaagaauaacugcuuaagguacuauuagaaacauaaucuaauuaaauuucuuauuugaaauuuuuuauaagaaucagcuuaaauuauuuuucaagaaaaaaugcuuuuuacagauugagcaucucuaaucugaaaaucugaaauucaaaguccucuaaaauuugaaacacuucaaauuucaaaacuuuaugagcacuugugauaccacaaauggaaaauuccacaccugaccucaugaaauggguugcagcaaaacagaggcacaccacaguuuauucagcuugccauuguuuguugcuguuguuuaacacugauauggguauuacuuaguuacacuuaacacauuauuuuuucacuguaccaaugguguguccuguuuuuuaaguguuaaguacuuauaugugaauaaguguaagaaaaugguugcauauaaauucaagagucaguaaugauggggauaccaagcaacuacagauugauuguccaucuaguuggccgagauagugacaccuuugcuuucugaugauucaguguaccuuguuucaugcagaaaauuauuuaaauuauucuaugaaauuacuuucaagcuguguguagaagguguauuugaaacauaaaugaauuuuguguuuagacaugcaucccauucucaagauaaucucauuaugcacauauggcaaauauuccaaaaucugaaaaaauccaaaaugcagaacacuucuggucccaagcauuucagauaagggauacucaaucuguauguggaagcugacauguuuaaauaaccacagaucagaugagauccagcccauucagguuaguauggcuguagacaucccucuaccccuaauucuucugcuuuguuugggaagaacauggaagaaaaggugacuucugccuccgcugcucuuacccccaccauaguggccuuuggcgaugccuccuaccuucccccaacaacucucuugcguguuagagagaaggggcccucccagcacaaaguugcauuccuccccccaauuuauucuaauuuauuaauuuagucccaccccuucugagccugcagccuucugcagccuggggacuguagaguaaguagcugccccagccccucccaggccugacccagccuggggagugggacaagguguggguguggcccuguuggagguugauguugcuguuuuuaucucuuggcuuuguguuuguguucugugauacuuuuugagaaagaagaggccaggcacaguggcuuacgccuguaaucccagcacuuugggaggccaaggugggcggaucacuugagcucaagaguuugagaccagccuggguaacauggugaaacccccucucugccaaaaauacaaaaaaaaaaaaaaaaaaaaaaaaauuagccuggcaugguggugcacaucuguggucccauccuuggaggcugaggugggaggaucacuugagcuugggaggcaaagguugcccugagcugagaucgcaccacuucacuccagccugggugacagugagauuucgucucaaaaauauacauauaaaagaaagagaaaaaaagaaaugugagcaaagcagaaggaggcggauucaaaccccagugugucacgccucaugccuuuucuuuaguggugggaaacccuuaucuuguaaagggaauguguccccuucuucagccagccucuaguguauuucacagaaaacaaaaccucccaauaaaacuguugaaaccuggaaaauaaaacaaacaauaugucaucuacuugaagaaauaucuggugaccauuuaaaacauauuuacagugacuuuguaauaaugugggagaauguuuaugucacauauuuauuaguggaaaaagaccuauauaauuuuauaucacaguuauuuuuuaaauguaugcaacagacauucauguguguggggagcaugcaaguguucauuuauaauauaugccauuauuugacaugagcucagugguucugcauauguucugccuuuccuugcucagucaacucuuggaguaugaagaccacaucccuauaugggauaugaguagguuaauuuuucacucaacccugugucauuauauaaggauauguuuccauuaaaaagccauuugggaacagaaaguaguaacaaaugaugcuaacccagcagugagcuagguaaguacaacuguuuuuccuuaucagaugugaaagacuguaagaggaaaauuuuaccccucuauuggagaaaauuucugaacacccaucuagaaaucaaaugcuaggccaguaauuuuucauauuuuuaaaauucacugaaccuugcauaaauaagguuuuaaggguuauuguaaaucagaggcagcugggugugguggcucaugccuguaaucccaacgcuuugggaggccaaggugggggcagaucacaagaucaggagaugaggaguucgagaccagccugaccaacauggugaaaccccgucucuacuaaaaauacaaaaaauuagccaggcgugguggcaagcaccucuaaucccagcuacucgggaggcugaggcaggagaaucacuugaaacugggaggcagagguugcagugagccgagaccuugccauugcacuccagccugggcaaccaagugagacuccaucucaaaaaaaaaaaaaaucagagccucaacuuaaaggaguauguuggaucagccagaucugaagaguacuacacucucauaccaguagcaguggauucuuggauuggggauaaugaaaagugugccccacuucuuaggggaauuuaugugcucuaccucaucaauugagaauuacucaucuacaguuauuccauuuucuuucaaaugaggaaaccaaggccagaaacauugacuuuucuacaguugacagagcugaaacucuuucaacccuauuccaguuacuuagaggugguaauaaaaggaaauuuaugguuuuguggccaguauuacauguucagaguguauccaaaauuuuaaaccagcagagcaagcuucuguggacucagauacccuccucccccauccugacacuagucauauuggcacaggacacagacauaaaugaaaggagccacagugucuagucugcuuauccuaaguguaaccuuaugagcuugcaaagaaacagacuuacaaaucgaaggugauugauagcuggaggaauuuaccuuaggcuaaaggaauuauucuaauuucugaguaaggcuuuugacuuaaacaguaauauauuagcaggucagcucagcuuucauugaguaaaaaaauaaaauaaaauaaaaacaugaccugaauaaugauguuaacauuugaucacuucagcuuaguucaaagagacuagaaauuuggacucuaaguaaugcauuauuuccugacuuugcagaucaacuuuaggugauauuuaaagaucuacuuaggaaaaaugacacagcuccacaaucuaugauaagcuuccuaauaaucuaacuuaugaugauguagauuuauccauccaagagcuuuguaagacugcaucauuaaaauauaauuucuggcaggcacgguggcucacaccuaugaauuagagcacuugggaggucaaggcagagagaucacuugagcccaggaguuaaagacuggccuaggcaacauggagaaaccccaucucuacaaaaaauacaaaaaguauaugagcgugguggugcaugccuauagcccaagcuacuuggaggcugaggcaggaucacuucagcccaggagguugaggcugccgugagcugugauuguaccacugcacuccagcuugggcaacagagugaaacccugucucaaaaaaauuaauaaauaggccgagcauaguggcugacgccuguaauucaaguacuuugggaggcugagguggguggaucaccugaggucaggaguucgagaccagccuggccaacguggugaaaccccgucucuacuaaaaauacaaaaauuaguguggcacaugccuguaaucccagcuacucaggaggcugaggcaggagaaucaauugaauccgggaggcagagguugcagugaaccaagaucacaccacugcacuccagccuggacaacagagcaagacuccgucccaaaaauaaauaaauaaaaugaaaaauaaagaaauaaauggccgggugugguggcucacgccuguaaucccagcacuuugggaggccgaggcggauggaucacgaggucaggagauugagaccauccuggcuaacacggugaaacccugucucuacuaaaaauacaaaaaauuagccgggugugguggcagacgccuguagucccagcuacucaggagucugaggcaggagaauggcgugaacccaggagguggagcuugcagugagccgagaucgcaccacugcacuccagccugggcgacagagcaaaacucugucucaaaaaagauaaauaaauaaaaaauaaaaauaaaaugaaaaauaaaaauagaaauaaauaaaauaauauaauuucuuuauuuuagaaaaggaauugccaauccugaauuugcaucacauuagggccuucacaauuaucuguaggcuuacagaugaugaaaucaggcuugggacagaauuguuaaagcucucuuugaaacaaaagauauugagagucacuguuuuuuuguguaaugguuuccaggcuucaaugugcauaagaauuagcugagauauggccuagcgagguggcucacgccuguaaucccagcacuuugggaggcgggcugaucaggaggucagagaauuagcugagauauugaucauuucagcucuuuccccagagcuucuguugggaacgcugguaugguguuucagcaggaauuugcauuuaacaagcacucuggcacauucagacagaugacccaggaacuauacuuugacaaauacuuccagaaaauaaagggagagguuaaaaaaaaaaaaagcggggagggggaaacuuuugaggaaaacaaugaagccaucaaaggaaaagucuuuauuuguggagaagcugaauggcuguaggcaguugaucucaaauuggcucgaaaacuggacugcgguauuccgcuaauagugagcuaaugguuuuuaucacaguaaacagaaaaaaagaucugaauuuguauuuuguuuuucuuuauuaaacauuuacugccuacugucacuuuucuguuagcaaaaugaacagauaacuaagaaacauuaauuuuaaaaacucagaaauaacucaucaaauuuugacaacucuuuucuuucuuucuugugaacucaggguuauacagucauccaucacugucugugggggauugguuuuaagaggacaccguaaguuccauauaugaaaugguauauaguguuugcauauaagcugugcacauccucccauauauuuuaaaucaugucuacuuuuuacuuaauacaauauaaaugcuauguaaauaguuguuacauuguauuguuuagaaaauaaugacaagaaaaaagucuguacguguucuauacggucucuucuccuaccccccaaaauauuuucaauccaagguugauugaauccaccaaugugggacccacagauacagauggcugacuguccuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauagucucgaucuccugaccucgugaucugccugccucggccucccaaagugcugggauuacaggcguagagccaccgcgcccggccggcugacuguacuuuuaaaaauuacaucaauaggccaggcaugguggcucaugccuauaaucccagcacuuugggaggcugaggcaggaggaucaccugaguucaggagaccagccuggccaacauagugaaacccugucuguacuaaaaauacaaaaauuagccgggcgugguggcacacgccuauagucccagcuacgagggaggcugaggcaggagaauugcuugaacucgggagguggagguugcaggaguuagccagccuggcuaacauggcgaaaccccgucucuacuaaaaauacaaaaauuagccuggcgugguggcgugugccuauaauuccagcuacucuggagacugaggugggagaaucacuugaaccugggagguggagguugcagugaguugagauugugccagugcacucuaggcugggugacaaagcgagacuccauccaaaaaaaaaaaaauugcaucaauaaaguauguguauauuugaacuuacucaaguugcuucuaaccaugugaugaauuaaauuuauucuuuuugauguauuccacaaaaaagcauggcaucccacaaagggcaucaugacuuccaggugcuucccaggaugaaccaguuugagaacuguucucuuuagaaaaaguauucuucacuaaggcauuagguuaggaaauuauuaauuauugcaugguuauugcuuugcccauccauuaaaaaaaaaagggguuuuuuaaaugcuucauuuuugaaaccacugaucagaugacaaagauaacccugguccuuaccuauacagaauuuuggucaaaucauugacaugaacaguagagagcuacaauucagaguaguaagagcugugaugggucagggcuagggugcugaggaaccaguagacuggacaguuaaccuccauuugugggguuggcagcuucucuaggaaggggcaccuaauaugaaauaucaaggcuuaggaggcgauacacauacuuuugguuucuguuucauuguuaucauccuacauaauugcuuuguuguguuagucuuugaauaagacaauuucuuauuuuuacaugcuucuuaauuuuuuuacaugcuuuuuauuauuuuuacaugcuuuuuuguuuuguuuuguuuccuuaacuuccagccuucauugauauauauacauuugcaaguuugaguucugaguauuuuucaaaacuagcugguaaugguaauguuuguuuagaauuugaaaacucgucaggcaaaagauguuuucauuagccauggauuggccaguuuuuccuuguagccaguucuuauaaucagacauuuauauaauuaguacuuaaccagaaauuauuggcuuucuguaugaugaagcagaauacuccauugcccugcaggaugauugcuuuuaaugauugcuuaaugauucucuuucuuaguuaagaaaacuuuuuuaaaaaaugacaaucuauaaagccuuuauuguuuuucucaacuccugugacagauuaccuauaaagcuuuuaauacauuagguaucacaggcauuuuuuggaccauuuaccugauagugaaauaauuuuuucuuuuuuuuucuuuuuuuuuucuuuuuuuuugaggcggagucuugcgcuguugcccaggcuggagugcaguggcaugaucucagcucacugcacgcuccaccucccagguucacgccauucuccugccuuagccuccugaguagccgggacuacaggcgccugccaccaagcccggcuaauuuuuucuauuuuuaguagagaugggguuucacuguguuagccaggauggucucgaucuccugaccucaugauccgcccgccucggccucccaaagugcugggauuacaggcgugagcuaccgugcucugccaauugugaaguaauuauuucuuaauuaagugggauaaagauaaaucgcucuuuuguggcauuaaugugaccuaucuuagacauuuuuuuuauuucucuuuaaucucacaugguggcuuucaaacuuuuuaguucugcuauuuucuuuacaauuuuauucucuuuauuuuaaaacaaaauguuaguuggaauguaccaaaauuggaaagcauugucucacugucucuaauucuucucccauucucuuuaacugauuacaauuaggcuugugcuccagaucacaacuaguuugaucaaagucaccagugaccuccauguuccuaaaucuagcauuaaccuguuaucagcauuugacuacaguucaucacucccuucuuaauggauuucuaggacuuucuugguuuuucuccuaccucaguauaugcuccuuuacauucuccuuuagugcuuucucuucucucugacaucuuaacauuacagugccccagggcuuaaucguaagccuauaccucucuccugagugccaggcuguuauguccauuuauguccuauuuaauaccuccacuuagauauccaauacacaccucaaaguuaaccuacccaaaacugaacuccugaucuuccccugaaaucuaucauuuuccuacugucucuuaucauucugauuuuucaaaccagaagccugggcucugccuucauaauuuauccagaaucagaccucuucuugccaccuuccuucacuuguaccaucauagucuaagucaucgucguugcucaccuguauuauugcaguagccuccuuucugguuuuucugcuccccuacagguucuucucaaaguagcagucagaauaguccuuuuaaaauauuucagauaauguuacuccuuugcucaaaacccuccguuaacuccgcauuucacucagaguaaaagccguauacagugacacuaugugacugccccccuccucuccccacauggccucucucugauuacugcucauuuucucucuccauuucagacaucuuggccuccuuguuuucuugaauauuccagauaugcccacuauggaaccuuugcacccauuguucugucugccaggaaaagcucuucuggauauuuguauggcuaacuuccuuuccuccuuuauguacuugaucaaaugucaucuuuucagugaggcccuaaccauuuaaaaauugaaagcuuccuccucccauggcucuccgcuuauucuguucaauauuuuuccauaacauuuaucaauuuuuaacgcauauaucguauauaugauauagauagauagugcaugucugugcuucucccagcucucccacuagaauguaaguuccgugaggacagugauuuuugauucaauaagguguaccucaaaugcccagaacagugacuaguauguagugugcauucaauaaauaucucuugaaugauugguucaugacugacaaaggaguugaaacccaguuugaaaaaugcuugucugauagcuagacucaauccuuaauuuuuuauuugaggugcuauauauaaacacacuuuuuuggaauaagcuaaauauuuuguaguuguuuucaagugaucuucuucaguuagguuugguuuauccaaagugcuuugauggccgcaguggcucaugccuguaaucccagcacuuugggaggccgaggcaggcagaucacuugaggccaggaguucaagaccagccuggccaauaugguaaaaccgccugucuacuaaaaauacaaaaaauuagccaggcaugguggcaugcgccuguagucccagcuacucuggaggcuaaaggaugagaauugccugaacccaggaggcagagguuguagugagcagagacugccucacugcacuccagccuggcaacagagcaagacucugccucaaaaacaaaacaaaacaaaacaaaacaaaaccaaaaaaaaagugcuugcuauagucauucuaauaaucuaagugaaaaaauaaguauuuuucugauauuaccccuuguauuauauaaccucgaaaaccagucauccacuguuagcuauuugcacuucagauauuuuuccacacacaaauguauauuaaauaauacuauauaugguguuccacacuugcauuuuuuguuuuuuuguguuuguuuuguuuuuguuguggugguuauuuugguuugugccuaauauucuaccacagaugccauguuuugagaugcaauauagcaugcucaguaagagcauggaugucaagcugaacugucuagguucaaaccccagcuuugccaauuaccagcuauuggauucuggacaaguuuacuuaaguucucugugccuuuguuuucucaucucuaacaugggaauaauaauaguauuuacauuguauuguaucaaaugacacuugauacacauauguggguauaaauguuagcugucaucauuaguauuacauauugcccuaccucauuguuucucaucacuauauaauaucauguuuuuaaagugcuuuuuauuuaaucagacccuuuuuugauacauauuuagauuguuucuaauucuucacuauuacaaacaauaaucaugagcagugguaagucuguguauuuguauaacuauuuccacaaaacaaagguagauguaaacauauugagucuaaaauauaaacauuguuguacaguguacacucacaccaaccauguaccaguguguauuucccuacacuuuugcugcugcuggauauuaucaggcuuaaauaucuuucuugguuuucuucuaguauuuuaugguugaugagcuaguucuuuuucccugcucccagaccguacuuacauuuuuauucuaucugaaaugcauuuuuguguauaaggugagauagugaccuguuuuuuuaaaauaguuaauucugauacccaguaucuuuucccucacugauuugaaaugcuaucccugugacauaacaaacacccauguacaccuagaucucuuucugaacucauucucuucuguugaccugucuauucccaaguaccaucaauuuuaaucaucauagcuuaacacuguuuaauguauuuacagcccuaccauacacacucaaguguacacacauuguuccuguuuuuuagaacaauuauuccagauacauuucagaauaauuuuuaguuuuuaaaauuuacggccaggcgccauggcucacaccuguaaucccagcacuuugagaggccgaggcgggcagaucaccugagguuaggaguucgagaccagccugaccagcauggagaaacccugucucuacuaaaaauacaaaauuagccggcguggcagugcaugccuguaauuccagcuacucaggaggcugagacaggagaaucgccugaacccaggaggcagagguugcggugagcugagauugcaccauugcacuccagccugggcaacaagagccaaacuccaucucaaauaaaaauaaaaauaaaauuuacccucuguaauuuuguuucaaacuguuaagaauaucgauuaauuuggaaagauuuguaucuuuacaauagugaguguuaaaaugucuauucauuuauucagggcuuuuuuaauauaggucauacacauauauuauaauguguauugcuguguauuuaguagguuuuguuaccauuuugaacaugggcuuuuuuuucauuauguaguuuaauauaagauauugauuacauuauauggauauguauauaugcaugcauauauauuuuuuauucacuuacuuuuuuacacucucuuuuuuuuuuuuuuuuugagagagggucucuguuacccaugcuggagugcaauggcaugaucacggcucacugcagccuugaccucccaggcucaagcagucuucauacuucagccucaguagcugggacuacaagugugcgccaccaggcugagcuaauuuuuucuauuuuuuguaggaaugagggucucacuuuguuggccaggcuggucucaaacaucugggcucaaguggucuucccaucggccucccaaacugcugggauuacaggcaugagccaccacgcccagcucuuuuacacucucuuuuauuugcaguucuuagauuuucuaacuuuacagucacaucauaugaaaugauuaauuucauccuccuucuuaacauuuauaccauuucuuuuucuuaauuuauuguagcaucuagacuccagaaugaugcugaauaauagugaugauagcaggcagcauugauucuguguguguauaauuuuacuggaaaaaaaauuuuaaauaaugacuuuauugggguugguuaaguuauuauuucuaaucagccuuaucucaagucuugucauuuuacauuaaacaagagaauacuugagaaaguguaagaucuuucugcucugggagcaaaacauaaucuuuggcuaagaauaagaggacuagacugggugcaguggcucacgccuauaaucccagcacuuugggaagccgaggugggcggaucaccugaggucaggaguucgagacuagccugaccaauauggugaaacccugccucuacuaaaaauacaaaauuagccgggcaugguggugcaugccuguaaucacagcuacucgggagguugaggcaggagaaucgcuuggaccugggaggcagagguugcggugagccgagaucacgccauugcacccuagccugagcaacaagagcaaaacugcgucucaaagaaaaaacaaaaaaagaauaagaggacuaauaacuauuugaaucccuggcaguuuacaucugaguaccuucuccaagugacacauuaagaguuaugacuaaugaaguuugcuuccaaaguuauaugaaauaaugcccucuuuuuuggucuccuggauaauaggcuagguuuggccuuccuugauauucaguuauuuggagcucaaaguggacaagagcuguugcugccccuauccugggaagcuaauccuucacaugcugcuaacuuggguuagaucuucugccagcagaaccucacccgucuuuccccuccaagcaagucagugccggugauuccuuggacaccagaaaugcuaaucuugucuauuugaauaggccuaaaggucagguuuaacagauuguucaaguguaucugacuuugaguuaacuuucuucucauaacucuaucugggcaauagaaagccacaaauuuuaaaucucaacuguaaucaaguaugaaaugucuuggcuuauuuuuccuugaccaguuagcugccuuucacagauaaagauuauaucuuagauaauuauuguagaaagaggaagauaaaguuuuauacuuuuaaaaaaacccuguggaaauuuacuauuuggucuacccuuaacaauugccauauuuagugguugucuacuuuuuguuguuguuguugggguuuaaauuuuaguucaaguaaccaguucaauuucucaguaaucauagucuacuuagcuuuguuucuuucucccaaguuagcaauauuaguauuucuccucauuuuuuuauuaugaaagaugucaaauauaagugaauuaguuguauuacaaaaugcccacauucuggauuugucuguuacuucaugguuaauauuagaacuuuuuuuuuuuuuuugagacugagucucacucuguugcccaggcuggagugcagugucgugaucucagcucgcugcaaccuccgacuccccgguuccagcgauucuccugccucagccucccgaguagcugggacuacaggcgcccaccacuacacccggcuaauuuuuuauaauuuuaguagagacgagguuucaccgugguagccaggauggucuugaucuccugaccucgugguccacccgccucggccucccaaagugcugggauuacaggugugagccaccgugccuggaaauauuagaacuuuuaaucaucauaguuuuaaugacuuagaugcauuugcugagaauaauuugaauauuuguguaaugccacugcuuaaaaauuccuaauauuggucugauuccuuuugaugccauuacugaguaugaucuuaguggagaaauccuguaaacuccaagaacaagauccuaacuuuagaauaucuguauuuucucuccauuucuaacaaagauuucuucuauagcugugaaugagcuacucaaccacucugccugugcuauaaauaacaauuagaucugccuacuucauuuaaaguucaguggguuuacugacugauguuuauaaagcccauaggagauguaaagcauaguuuaaauggugauaauuagagaaaugaguguacuauuuugguucuuucaaacaaguuuacauuuagcacgucauaucuucuguagacauuucuuauuucauauguacguuuagaucaaaagaaaggaaaacuaucauuaaaugccuacugugugguaagcacugugcuagagucuuccacugcuucuucucauuuaauuuuuaagucuccaucuaaccugugaaauaagcaaguuauuauuuccauuuuacagacaacgaaccaaggaucagagauguauaauaaccuuauucuuuauuacaaacaucauguuagagccacacuaugaauccagaccuuuguaaauuuucuaagcuaaacuuuaucaugagaacccuucaagaauucuucugaaugucacauauauggaggaaaaucucuccaaaaaauguugguagcuacuaaugaagaauuucuuuuaucuucugagcggaaacauuuaauauguauauuaaauaaaauguuuuuuaaguguuaauuuucuaguuauauuacauuuccugucacugacucuguucuaggauguuggcaaaggaugaacugaugaccauacuugagaaauguuucaagguuuuuaagucuuauugugaaaaccaccuuggcagcacagcuaagagaauagaggaguuccuggcccaguuucagagccucgaugguaagaguguaauauccuuccaauucuauuggccaugacagucauuuaacuaaaauggcauggaaaaccccaccuucugaugugcuuagagauaaagagauaaaguaguucaugaucagucaguaugccaagccucauaguaucacauuuuaacaaucacaaauaggccaaauguuucucuucuagauuugguuuaaacaauggagagcaucaaaugggcagaaaaagaaaaucuuucuccagaucgacaguuugggggauuugucuuuaaaaagucaacaaaaagaaaucaaaaagauuggaaagaguagcagggugucauaauuaagaacucuuuuuagagguuuuuucuuaagcauuucaucaaguucuuuauagauuuccaaagcacugcauaaaucaucuguaagcuugaaaaauuaauagcuaugaacugcuuucacagcagugaggcucauugguauguugauuaccaaaaucugcaugaggcuuacuuuaaucggauuuacaaaagcuggaaucuuucaguccuaaauuaacugaagcagccuggcacucuucacuguuggaggguuacaguuucucucuuuugcuugaccuccacaugaucauuuauauauccugaaugcuuagggugucugauuguauauagguagccauguucuguucccuaaauacuagcuuuucaugggcucuucucuugcucuguuucuagcaccaaaguaugguauucuuuuaguagaacaauaacaacaauaaaauauauugguguguacguuuuacuuuucccaaauuuagggcaauuuuuuaauggaguuuugggggaacagguaguuuuuucauauauaaucacauagaauuggacaugacauguugaaaauaucuuauuuaaaaugucuguuuuaauccuuuuuuauguuuggcaagugcuucuuugucuuaaaaaucuuuuggcuuuaggaaacugcuuuugcaaaaaucuucccauaucucuccauagcuacaaugugaggcaccugaugagugcucagucauggaagaugaaagagaauguuugccugacuagaguggccugagcagccagagugaggaagucaucagcaggcacuaagggauuuucuuucagguuaugugugggcauugcucuugccacugcagcaugaacucaaccacucuucagaacacaaaaacuuuuaagggcuggauguugguaucauuaagaucauugaguucagcuauauaaccagaaacuaaagucuaggagaagacggcagcuuguuugagaucacacagcuagcuagugguagcacucagaccagagcccaucucucuuaaccacuaguucauuguuuuucugucgcuaauucacgauauaaauacgcccuaauagugaucacuggaucagcaaggggccaaccuuaaguacauaaauaggguaaaaggcuuagaaaaauagaagguaaauacuguguaaauuucagucuuuuacaaaaugggacuuauggagauugcuguaaaaauaaacugcacauauaauuuuuucuucuuuuuuugcugggcaccauuaacgagguaaucuagauacauuuuuaauuagaguucauauaauaugagcuaguaaacaaauucugugauaugcuagagcuaaauaaaggaaugcagcuuuugaaaugggaaggucgaagauuaagaugauuaguagccuaaagaauaaagaauuuuacaaauuaaagcacaaccacugucuugaagaaaugucuguuauuuccugauuuucaaaagugacucauuauuaauaauaaacugaaacuaaaacuccccacguuggaugaguagaaauauuuggcuauaugcuaucuguguuccuuaacauuuauuacauauuacaguuuggguuuaaaauuacaguugggaagaguuaaguaggacagagugucauaucagauuuuuuuugagacaggaucuugcuguguuguccaggcuuaagugcaguugugcagucauagcucacaguucccucagaccuccugggcucaaguaauccuccugccuccaccuccugaguagcuaggacuacagaaaagggccacaacauccagcugaauuuuuuuuuuuuuuuuuggagacagagucucccacuguuguccaggcuggagugcaguagcaugauaggcucacugcagccuauaccucccaggcucaagugauccucccaucuuagccucccaaguagcugggacuacaggcacgucccaccacacuuggcuaauuuuuuuguauuuuuguagggaugggguuuuuccauguugcucaggcuggucucgaacucuuggguucaagcaaucugccugccucagccucccaaaguguugagauuauaggcauaagcccccucaucagccuaauuauuauuauuauuuuuuuuuuuuuuaaauagagacagugucucacuauguuucccagccuggucucgaacuccuugucucaagugauccucacaccauggccucccaaagugcugggauuauaggaaugaggcacuucauucagcccauauuagauauauuucaaaggcauauuagguuuauuaacauguagcaaacuacauguuaaugacaugggacaaagaaucuaguagacauuuuaaccuuuaguuaugucuuuuuugaaccagaaauuagcuguagcuaaaaagcaguuuauucuuuaagccaaugcauauucuccagcugcauccuccugucauaguuuuaggccaaacaaaccaugugugugggguucacaaaacccaaccugcacuugaagaagaauaugagagcauuaugcucucuagaaggagcacagcuguacauuuaagcaguuaugguuuucuuucccuuugcuaaagaaccaugaugcacuuuauguuuuaguggauuauuucaaaacuuuuacacacuacccuccucauacucaaauuuuguuguuuacaaucuugacauaaucaaaggaaaacaguuuuaaguuuuuauuauuuuuuuaaaaagcuauguauaacaucaaaaauauuugagacuggcugggcaugguggcucgugccuguaaucccagcacuuugggaggccaaagcggguggaucaccugaggucagcaguucgagaccagccuggccaacguggcgaaaccccuucucuacuaaaaauacaaaaauuagccaggcaugguggccggcaccuguaaucccagcuacuccggaggcugaggcaggagaagcacuugaacugggaggaggagguugcagugagccaagauggcgccacugcacuccagccugggcaacagagcaagacuccaucugaaaaaaaaaaauuuuuuuuuuugagacuuuuugcuguugguuugagggaguuuuguuagguuguauuuuguuuuguuuucauugugguuacacuuuuaaaauucaguagcugauuuuuugaagacaucacuacagcacaaguuauauauuauuggccuucagcuucuguaagaaaucauuuaucagauggaaucuugaucccuugccacauuaaaaaaauauauauaggugaaacuuuuacuuuggaguaguagaaauguuuguucccuugacuuggauuuacccucauugaugucuacugguuuuguauuaaaagcagaaaccaaagaggaagaagaugcuucugggucacagccaaaggggcuucagaagacagaccucuaucaucuucagaaggucaggucacucucuucccuuccagcugcauccugugacacucccuuuuuucaguuugugcucuagauuaacucugccuggauguuuuuguuuucauuuuuaaaccacaaccaggaacaaagcagacuuuuaacucacuucuaaguugaacauccuguuagucccauugccaucauuacucuacauauacacauucuggaaccuacuagcuaacauagguggaaaccauuccugugggcucagcaagagaaagagaaucagcuagcaauaagagaaaaugggaacauggcugcacaaaucugauuauuuaucugauguauuuuucuguuugaucaaacugagagauuuaaaagagccuaacuaauuaguuuuaguuacuuuccuugauuuuuuaaaaugcauauucaaguauagagcagaaauugagccacaguauauccaauauauucuuuuucagauaguucuaacuuuaggaucuugauugucgaaaugaagaaccuucuuuguacugugauaccaaauuaugauaaauguagaguaaaauuucaaucuaaguaaaauaaaacacauggaaucuauucuguuaguauggcaaaaaggcaagauuuuuuucuuuauccuguuaaguccuuuucuuaaaugacuuaauggacugaauagugagcacucugccauguaauuuaguaguaaagugaacugcccuuuucuucuuucccuaaaaauuugcuuguauauuauaaagcaaaacaccuuugaggcgagauucuugccagaccuuaaaaauaaaaagaauaaacaaaacccauuuugaucuuucucuguacauccugucuuauggaaagggcaucaggugcuucuauagaacuuaccaacagagcucccucugagggguuuucugucugaggaucaccagaaaagcuauguucuuuuaucuauaguccuuauuggaaaugaaggaguuaagaagaaguaagaagcaaaccaaauuugaaguacucagagaaaauguugugaacuucauugacugucuagugagguaagucuaaauuuagcucuuaagagcuaaaaaucaugcuguuuuuccaaauaacacuggugucauagcugucuauagccaauccagaacauuuuucuccuagguuaggcuuuaugcuuuucaggucucuccaucuagcuuagaguuguaauuuuuaggccaggcgugguggcucacgccuguaaucccagcacuuugggaggccaaggcugguggaucacgaggucaggagaucgagaccauccuggcuaacaaggugaaacccugucucuacugaaaguacaaaaaauuagcugggugugguggugggcaccuguagucccagcuacucgggaggcugaggcaggagaauggcaugaacccaggaggcggagcuugcagugagccaagaucgugccacugcacuccagccugggcaacggugcaagacuccgucucaaaaaaaaaaaaaagaauuguaauuuuuauucuuuuuccaucauuaucaagaugucuaaucaaaugacuuaguucauucuuuuaaucucaguuaagaauauaggcuuaaauuugaucuacuucauuaggucagguggggagagaugagauagaaagugaauguuucucuuucuaauaauaaaguauuuguauuacacuuuaucuuugcuaggaguaaaugcuggaucugagccaagcccagaaaguagagcagacuagccaugcugcucuauuuuauccugaagaaagaacauuuaauucuaaacaaugccagugcaccucauuaucagcacuaaauuuauguugagacaugugcuggguaaauuuagaagucuaccaauccagccuguauuuuaagauguuuccuuuuuaggaaacccagaucauucugauucauggauuucccaaaagucagcuuuauguagccguguaaaaucacccaccuaaguuugguggaaguugggcaugcuacagaaaaaaaugagaagugugcaaaagaaaacgauuuaauaccuaaaaaguggggcgggggggggagaaccuguuaucauuguuuauuguaauuuuuuuuuuuuuuuuuuuuuuugagacggagucucacucugucgcccaggcuggagugcaguggugugaucuuggcugacugcaaccuccgccucccggguucaagggauuuuccugccucagccucccgaguagcugggauuacaggcaugugccaacaggccuggcuaauuuuuguauuuuuaguagagacgggguuucaccauguuggucaggcugguccugaacuccugaccucaugauccacccaccucggcuucccaaagugcugggauuacaggcgugagccaccgcgcccggcccuguuuauuguaauuuuuaauggcaguuuaaacccaacagcaggcuaggcacugaauaaaguacugagaaaauagcagcacaauuauuaaagagaaagagugcuuuucugacaaauuacaugucuuuucugaaagugaaaagcuuaguuuuccagaauaauguggggacagagucauuguuccuagucauuggggagaaauugcuaaugccaugaaaagguccaaaacgaucaaccaaggccgggcgcauuggcucacgccuguaaucccagcaucuugggaggccaaggugggcagaucacuugaggacaggaguuugagaccaaccugaccaucauggugaaaccccgacucuacuaaaaauacgaaaaauagcugggcaugguggcgcacaccuguaauccuagcuacuugggaggcugagggaggagaauggcuugaacccgggaggcagagguugcagugagcugagaucgcaccacugcacuccagccuaggcaacagagcaagacuccaucucgagaaaaaaaaaaaaagugaugaacugcaauauuggccaaauacuggucaaaaauuacauagaacccacagaguuaaccuugcccuacugggcuuuccuguucuuguagagucuagccccaaacucuugacucuucccuuuuaccaggcagugaacaugguagucacuaaaaauaauuuugcaaugugauuugccaauuuuaggccaaaugucagguuccagaguucuuacaaauuccaaauuguaggcucugaaaucacaucagccguuucccugucaugauccuucaccuaauaugucugacuuuuuaccuuucugagcaguuguugaaauaaugcucaguauaauuaaauguguuuuguuguaaaaucacaaaaucuuccauacuaggauuuagugucuuuaccaagauugucccaggagggaagagauuagaauuguagcauguuaaagcuaaaagagaccugaagagucagcccuguggcagcuaaaggccagagaggggcugugacucaugcaaggucacacagucucauucuccugacaucugccaaaaggcccucuccauuucucuacacugcccucaacagccacaccacagaugucugggcagagcuuggaguuauggagaaaggauguccuuuaaagacaaauauaagcaggagacuucaggaggcagaguucacaguauaccaugagcagcucuuggcaaaaauacuggcaggcaagaauaaguugccagaucuugagagaugagaauaaauugccacuuucuaaguuacuguuuuugccaauagcaagcuucaacuuuguagcccuuguugauacuaauuccuccaguuccuucagaaccaccucuuucagggaaggccuaucauuugucuggucugaauccaaaaugagcauaaugcagugcuuuagugccagacucauugcuuacuucuucucacauaaauaagucacagaaguauauuucuaugucaaucuccaagucugcagucagauaaaaauucuaauguauaauguauuuuguuacuguuguuguucaacuaauguagccaguggaaacaaaauuaaggcagauauuuuauuuuugcucugaugguucuuugaggauaucuagagaggucuuuugccuugggaaaugccugaauuucuauauaucacauguaaaaauguuaaaaugugaggcgauaguuugaguuucugaaguugacucuaucugauugccuuguuagauauccaauccuuauuacauagcagggacugcaacaagaucuuuuaaugacagccauguauaaugauugggaaauaacugccugagguuaguguaggaagaguuuauggucagaaauuacaaauugguagccagccaucacagaaacuauuuccugaagcuacagcuaaguuaacuuaaccuugaguaauuaagauguuaacaguaucugagguauagaauauuguuucuuagugaggaucaagucaaaaucauacacucuuugcaaguaaguuuuguuccaguugacucuggagaaggagcagcaccuagaauuagaaugagcaaggggucauuagcucuugagaugggggagaaaaggaggauggugaagagugauguccauguugaauacccuuuccacuuccucucuucuucagagcuccuggccacaucgggacaaagcaaguguaggggauuucuagggagugguauccucuccagaagaagagaaaggauacuuggaagaaggggaauaauguccccagugacugggcugagguagcugcuuugcucugcuuguacugguaggaaaaggagcugacacaagcugucauguggccaaaauacuuuaggcucaggacuggacuaagccccagaaaucuucuuuaugaagucaugugaguuaacuauauacuuuaauccaguuagugacauuacucugucuauggguuaugugugccaaagcuucuccccuccaauuugccacccuccaggcauccaguauaguaucacugucauggcacagaccaccugaugggcucauuauacaugcaaagcaaauuuuuaaugccauauuuuuuaguuccgaauuuauuaaaauuguuuuaucaucuagcucauaggugaaaaaaaucccaaauuauggcagauuuuuuauaagugaaauuuuauuaaugauuuguuuuucaauacucugaaacuaagauuuagucuuuucugccuucuaacguaauaaguaauuccaauauauaaaaaacuuuugggccgggugcgguggcucacaccuguaaucccagcacuuugggaggccaaggcugauggaucaccugaggucaagaguucaagaccagccuggccaacauggugaaaccucaucucuauuaaaaauacaaaaauuagccgggcguguuggugggcaccuguaaucccagccucucaggaggcugagggcugagucaggagacucacuugaaccugggaggcagagguugcagugagccgagauugcaccacugcacuccagucugggugacaagagugaaacuccgucucaaaaaaaaccaaaacaaaacaaaaaaaccccacaacuuuugaggugucauuuccaugaaagauaucaacuaaaaauuuucugugauccaagaagaauuuccugaacucuuaauuccaggccuguguuuaauauugccaaagguuaaauguuugcugugcuagaaaauguagauaucuguuuucucauuuacuuuaagaaaugcuaucuuaaagauuucuaagcagaaauguaguauauauacauuuguuccuaaagguuuaacucagaacugaaauauacagcuucuuauaaagagucuagagguaguuuuaaaaacuauuauauggaagagaugcaguucugagugaaacuguauuagagcugauauuuggguuuguuucauucguuuguuuuugguuguuaauuuugcuuuuaguaaaugguucaguccucuacagagagaggauugacaaaaauguuauagugaaaauugaaguccaacagagcuuaaaggaaaaaauauauauauuauauauaaagaaaauaaaccugugcuuaucuaaacauggaugccugacuggcuguuucagagaauaccuucugccuccugagacacagccucuccaugaggugguguacuucagugcugcccaugcccuucgugagcauuuaaaugcugcuccgcgaauugcccuccauacugcacucaacaauccuuacuauuaucucaagguaagaugaacauuuaguuuucugauaguuuagcucagacucugggcgucauugucauaaaaauauacuaaauuugcaguuauguuuuaaugagcagagagucggcaauucaggguugcacgucucauauauuuuuaaaaauucuuuagacuguagaaaaaaauuucuaaccccauaaagauagcaauuaguagucaacuguugcugccaguuuuugaccauguguaaucuuugcccuucacaugcuaaagucagaucauaggcacaaagacuugagaguauaauguuaccacucuugugaaaauaaaagaaauguuuccuguaaacauaacagcagacagggauuaaacaauauggccuaauaaauuacugaaagaccgaaaugguuguuucuagugggaaagagaaauacuuugggacuucaucuuggauuuuaaaacaaagaaaggucuauucugagagcaucugcagagcugaguguagaggauaaccagcagucugccacuaaaacuccuggggcagcacacuucagcugcccuugcuaaaguccagacacaguuaucaacuccuggaagcucuuuaaacaauaguucaagacagcucacaauuuuagaaacuagcuuucuuaugaccgggcaaaaugaucacuuuaaacauucaauaagcuguauauacaugaaagagugguaaguuaaauacccagaaaucuugccacaauaaauacuuaagaaacaacuccguaagaccuaugaagagcauuccaguguacuggcuucucauugcaaaacggcacacaaacaugcagaguauuacaagaauauugaguaggacgauauaagucaaugguuuucagugauggugaaaaccacugaauaauuucauacuuaaccaaaaaaucaguuaauuuuaauauauaaaccauaaauuaaaacuuacaaaaucugucuucuucuuggcuggugggucacagaagagaacugguaugauuucaguugucuuugggugggauauauuauaauauaccccugauauuauaauaucagagcaggguguguauguaagacuuuguguuucucaguaaaagccauggauuucaaauagguugaagaaacacugaugguuucuauagggcuuaaggucugcaguguugacaacguagucuuuucuuuaaaagaaauuuauaccccugguaagugguauuaguauuuacuaauacaguauaguaauuguuagaauucagcuaauuauaaguguuggaaguaccauuuuauuaaguauuccuaaagauuuccauaaacuuuuuacauuaagugcauucaggucugagaaauuaguaauuuauggauugaaaugaaaaauaugcuuaucuucuaauccugggaauauucuucuagugacuaagaacuagagggguuaugaccaagacauaaaccuaaacaagaacuagcuaacuauugaauagacucacucacuaaauaagggaaaccaagauuccauuuacugguuuacucaguuuagguugggggcuucauuaaugucugauuuuauuccuaauaauuuauaaaaguuagucaucuuaguuuacuguuaauuguuagaaugaagcacugaaaagcgaagaaggcugcauuccgaauaucgccccagacaucugcauagcauacaaacugcaccuagaguguagcaggcucaucaaccucguggacuggucagagguagguuguagggaaaagaacaagcuagauauuuuucuaaccaucc

SEQ ID NO: 13915 - RNA, 1617 nt, Homo sapiens
augguuauaugcuuuuuauuugugacauuugaauacccaagcucacauauaacugauuuccuaaauaucauuuaauuuuauguugcuuuucuaauugauuuaauuguuaguuuuccuuauagucaaaugcuuaauacaaucauaaauggaaccaaaaauauaguaaacauuucuuuuucugauguauguaaaaaagauacaggaaaauucugaaaucagaucacuauaagcuaguaaaacaggcgaauuauuugauuagaaauggacucuuccuucauaaguuacacaaauccuuauguagucacugaaaauucuuacucagaauuaauaccuguccagagggaaacagccuguuauaaaagcuuucuguuaauauauuuuuuaaggcaggaaaacaaucauuauuuccaaacacacuuuguuugucuaauucuaggagagaaucaccaauuucuucaagguccaaaaugaucagaacaagaaugacaacagugucaaccaaaugaugccuccaacuccuuuuaaugauugugccuugguacacauuuccucaaagauaauggcuauacuuuucccacaaucuuuuugcuuuuguuuucucccagugugguacucauggaguauggaagggacauaagguuuagagaacauaggaagcaauuugcuuccaucaauaaccagaaugauggauugacauaaaucagcacaaaaagauaaguguaauucuauucaagucccuuaauguuuugccaauuaagguuuuuuuuuuuuuuuuuuugaaacaacaacaguguaaucuuuaacagggauguuaaagguaagaagucaggaagauaaaccaaaaugauugaguaugauaaagaauuuugcauggcgauuaaaauagaaaaccuauaaauguagaaaaagcaggucuggacuuagcaaagaaacaauauaguuuggagaaggcaugaaauaaguucuuuucauguucacugcuggucacagccauaacagagagugauguggagagcuuugggaagguuucacguugaguuacaucaguggucaacaauggagcaacaagacuccguagaggaugccacccugggagaauugcaagggaaaggaggcugaagcacaacugguaauagccuucagauauuuaauggauaugcaaauaaagcucugauuaauuguauuuucacuuauuauauaucaucuuuggaccuuucuaaaagugggacacuagaaaagauauacugaaacucaaaaagaauacuucagcucgaguugaauggaauucaagauguuguggaggguucaguggguugguuauaccaaagaaugcuauagaauuuccaugcccgaagaacugugagaggaguauagauuuuuucaccaaggaaguuacuggcaugguuugagagauagaaggaauugauuaagaaaccucucaaaguuucuuccacuuaaccuggcucugagacucugggucuuuggaaaugagaaaauacccagggaagagaaaacgaacaauuuaagaagcaggaaaugacucuagaucaguauuucucaauuacagccguguaagacauuuucuuccuaaucaucucucccuugcaccaucaccau

SEQ ID NO: 13916 - RNA, 3631 nt, Homo sapiens
uaguuuucuuggaggagugaugaggaugagaccaaagaaaaugagcuggcaucagcaagggauucggguucucagcuauaccgugugggcccauuugaaauccucuuggacuguagacagggacagcaaucagugagguuucuucuagugucguggcgcuaugagaggcauggugauacuguugucaaaagaaucccaaggcaagggcaggugugcuuucaggggcuguggaaucaaaagaggcagugguauugugguaaggcauucaaugaucaaaaugaaaaccaacuguucucucugaaucguccaguuugaagggcucagaauucccuguggcaccaugcugccugugguccuagagguaacagccacaugauuccaguaugcaccaaggcccagaagcaccacucucuaaugccugcugguguccucaacagcacuggcuggaaagguacugcugaagauccagggagaaauaaaacuguuuuccugcaucuccauuuccuacuagaucaaguccucaacuucccaugacuugcaaggacuucuggaucugcuucccgccccugucuguggccuugcauacaccuugcuucuguuuaucuugcaucuuugcacacuuguuccuucugcauggagagcccuauuuccuuguuuccuccagagcacuccaguuccucuuucccagcccugcuugggugugggugaagcuuacaagccacguaggugggagacagagcaauucccagaaagggagcagaacucugggugugaugaaagagagauagaggaucccagcagcgccccagagcugguugcuaagaauuugcccuggcagcuggcucuccuucagacgggggugcaguucugcuuugaaggugagugucugacuucaaggaagacccaugaaaaacaucaggcugcuugcugcagggaaauccccggaaaaagagaggagagaaaaaaagaaaagaaaaacaaacaagcaaauacaaaacaucccaaacaacucuacagccaaguccauguggcaaagcgggaaccguagaaggugggaacaacagcagggcagcucuugccuggccucgggcacagggaggccacugugucgcugucgggaccacagcuguccaaacgaggcuggcuccccacuuccugugguguuucucuuuuagcuuucuagaauccaaauagcuguauguaucagaggaaauaacacuggccuuuucccaaaugccuuggcaacuccaggggaaggaccccucccaccccgacuccgguggacaggcagguaacuccacaaguggggccuccuggggcaugacuuucuaaggagcccucaguugcauccuuggugcagagugagggugaguccagggcugcuuaaucugcuuucccggaccauucccagcuguuugugugaggcuguggagggagugcugcaaguuagggaucccugggaacccucggggagagucucccugccaugcacucccccuaggcucaggggacuucguucuugcccucaaggccuuuucugcaguggucaagcugguggagcuuccugccuggaagcuuguuuucagaggaggguaaagggaccaggagucaaugguggaauccuuaggcgagguucaggcaugaggccuaaacauuuuuuuaggaacuauuuuuuuguaacguuguugugucuguuucagagcaucugggagagagaauuccaguaggggcugacaucagccaccccaaauuuauuuuggaacuaggcuuuauugguauaaauaacuugagaagugaacgaaugaaugaaugaagccgugccaggucacaagagucagagugaacaagauggggcagugauaagagagccaucauuaaccaaagugucuuguguuccgaauggaguaguuucuaucauuuccugcaccuuuucugugugccaggcacugugcucaaugcuggacaucauuucauucaauccuuacaucagucuuaugggguaugugguaucauucuuauuuuacagagggguaauggagguuaaguaccucggccauggccacaucacuaauaauuacccuggccaagguugaaacuugaaaacccauccuccuaaccagucuacuauauccugagccaucgugcugaauauaucuucauucauaucuacaugugcuguuucaguugagucucugaaucagcggcuguaccacaccagcaugggccacgggaguagggacucggcuggcaggaccguucccaggaggcccacagccagggcugcuguucuuccuuugcuagcaucccaaagucugaauucuuauaaagcaggcagggcagccagucuacaaaaauauuuuuaaaauuuccccaacucuaaguauauacaggauccaaccagcacacaggaauuagaaauguucuuucugcucucuuuuaggaauguggguggcaaauaagccaaacgaaauaaaaauagaaacaaggcaggccagacuucccuaaaccacacagaacaauauuuauuugauuaauucuguuccuaaacaacagcccacauuacugacacggagggcguuuccacgauggaggggugcgugugugugaaugugugcacauaugugcaggcucccaagugcacauauacauauguauggcuagauaaacacacacacucgccacccacggagaauauuuauucauaccgauacaaaaaucaaacugcucuucuuuuuccaaacccugcaaacauuaaaaauaagucacuuuauguaaacauauucagccuccugauuuacauuguuucuuauaaagacagagcugcacauuuuugaaguucucucauuuaaccacaggagauggguuacggacacaugguggguugccucauagugcaucgugaaagcaagagcauuaaucaaaacuguuuguggucacuguaucucugcagauccccucccuagagccccgcagcccaccccucauucugcaacucugugcuuuuuuuuuagcacccugucuugcucuguggauccaccuaccauguccuucccaccuguaucaaccuggcugaugcacugaugggacaggggauccaaccugauuucugcucagacugaugcuaccugugaucaaaggagccugugauuucugcucaaagcgacacugagaucucugacauuuggcugcugcuccccgcuccuuuccuccucuguuacccaacuucuccagagcccccauggaggucugcacaguuggcaggagucugccucccuccuucucauacccagcauuugucagcgcagcuggauugguuucuggcagaugcugcugcugccccuuguucugggaugagcaaagggugacugagugcacccacccgcuuugaggaaugaaacagauuucagcauggcccaaugcccccuguaggguugugcaguuccuuaaaggcuggaugcgggagggcaggggaaggaauucucacauuugcuucugucauguggccuuucuaucaggagugggagggaaggcacuggccggugaagcagagaguaccggaaacuccagguuagguugcaggcaccagaguuuuauuuauucugacagaagcuuaaugggggcaacucuuaau

SEQ ID NO: 13917 - RNA, 1683 nt, Homo sapiens
cgacagcgcugcacgaagcgagugggcgggcgcucgugcccggcuaaaagauggcugcuggcgccuggcagccaccgccugggagguuacuguaaggcccgcagcucccgccagcucccgcggacugcugccgccuccuuaccaugaagccaguaagucgucgcacgcuggacuggauuuauucagugguaagucccggggaucgcgggcccccaccgugucgacucacugggcccgcaggcggaaaggcccuauuucuucagcacccagaaacuccaaaauccauuccugaauuaagcauuucacucccucaccucgacuccgccucuuccuggaggauacgaucuuccgcuucuuacguaagggcugcuggguguacccgccacuggaaccccauuuauucgacuuuguuacuuuaauucccaccuuagcaauggcaacgguaaccugacgggggcgaggggaaauaucagguagauuucacaccuccuuugcgauuuuugguuuaguugcugcuugccaucguuuuaaucuccuggggcugcaucaucuaugcuucgauggugucugcaagacgacagcuaaggaagaaauacccagacaaaaucuuugggacgaaugaaaauuuguaacucuucuggauuuaauuaucugaaaauacaguucuuucccucaugcuuauguagauauaaaaauaaaauucauaaugcaaaguucccaaguuuauuuuugcauuauccuuuauaacaagcacuaguaugcaaauuuuucacuuagagauuuuaguauuuuacauucucaugacaaaauuaacagcaaccuaaaucugacagucuugagugucagaucauaguuggaauaagcuuuucaaucaaguuucuaaauucuucaaaaaugauucggaaagcuuuuuuuuuuuuugagacggagucuugcucugucgcccaggcucaguggcacuaucucggcuuacugcaagcuccgccuucuggguucacaccaaucucgugccucagccuccgcaguagcugggacuacaggagcccgccaccacgcccggcuaauuuuuuuguauuuuuaguagggacgggguuucacuguguuagccaugauggucucgaucuccugacuucgugaucugcccgccucggccucccaaagugcugggauuacaggcaugagccacugcgccuggccggaaagauuuccuuaaaacaaaagugcauggaauugcuguucuuacauuuguuuauugugauauuucacuguugcauacccugauaccaaauuaguguaaguacuguguaagaaaaaaacaaacaaacauguaacuaaauacuuuuccauaccguuuuccaagucaagaaugaccagaaaaaguagguagucucucauauuuguuuagcauguccacuuuuuacuuauuguuaaauuacucagucucaaauuguacaaugcuugaaaacagauaugacaauuucugagauuaaacuuuauuaaaguuacuuuuccagaaaauucaguaaauaugguaauauaggaacaaacuuaggcucauaagccuuuuaacuuuuuacauaaucuuuaaugauguugaucaggaaauucuuucauugguggaauuacuucuccagucuccagaauuguaucacccuaggaaaacaaagauacaguuaguacaaa

SEQ ID NO: 13918 - RNA, 1683 nt, Homo sapiens
uuuguacuaacuguaucuuuguuuuccuagggugauacaauucuggagacuggagaaguaauuccaccaaugaaagaauuuccugaucaacaucauuaaagauuauguaaaaaguuaaaaggcuuaugagccuaaguuuguuccuauauuaccauauuuacugaauuuucuggaaaaguaacuuuaauaaaguuuaaucucagaaauugucauaucuguuuucaagcauuguacaauuugagacugaguaauuuaacaauaaguaaaaaguggacaugcuaaacaaauaugagagacuaccuacuuuuucuggucauucuugacuuggaaaacgguauggaaaaguauuuaguuacauguuuguuuguuuuuuucuuacacaguacuuacacuaauuugguaucaggguaugcaacagugaaauaucacaauaaacaaauguaagaacagcaauuccaugcacuuuuguuuuaaggaaaucuuuccggccaggcgcaguggcucaugccuguaaucccagcacuuugggaggccgaggcgggcagaucacgaagucaggagaucgagaccaucauggcuaacacagugaaaccccgucccuacuaaaaauacaaaaaaauuagccgggcgugguggcgggcuccuguagucccagcuacugcggaggcugaggcacgagauuggugugaacccagaaggcggagcuugcaguaagccgagauagugccacugagccugggcgacagagcaagacuccgucucaaaaaaaaaaaaagcuuuccgaaucauuuuugaagaauuuagaaacuugauugaaaagcuuauuccaacuaugaucugacacucaagacugucagauuuagguugcuguuaauuuugucaugagaauguaaaauacuaaaaucucuaagugaaaaauuugcauacuagugcuuguuauaaaggauaaugcaaaaauaaacuugggaacuuugcauuaugaauuuuauuuuuauaucuacauaagcaugagggaaagaacuguauuuucagauaauuaaauccagaagaguuacaaauuuucauucgucccaaagauuuugucuggguauuucuuccuuagcugucgucuugcagacaccaucgaagcauagaugaugcagccccaggagauuaaaacgauggcaagcagcaacuaaaccaaaaaucgcaaaggaggugugaaaucuaccugauauuuccccucgcccccgucagguuaccguugccauugcuaaggugggaauuaaaguaacaaagucgaauaaaugggguuccaguggcggguacacccagcagcccuuacguaagaagcggaagaucguauccuccaggaagaggcggagucgaggugagggagugaaaugcuuaauucaggaauggauuuuggaguuucugggugcugaagaaauagggccuuuccgccugcgggcccagugagucgacacggugggggcccgcgauccccgggacuuaccacugaauaaauccaguccagcgugcgacgacuuacuggcuucaugguaaggaggcggcagcaguccgcgggagcuggcgggagcugcgggccuuacaguaaccucccaggcgguggcugccaggcgccagcagccaucuuuuagccgggcacgagcgcccgcccacucgcuucgugcagcgcugucg

SEQ ID NO: 13919 - RNA, 3120 nt, Homo sapiens
gggggcgcgcacggaggggcagccgaagacaguagcuccuuggagaucccaggcuggggaaggagggaggucuaggaaaggucucgggcccauucacugugcgugccggggauggguugccagggcaccacaccagcccuccaaaagggaaaucgugggcccaggaacugacagcgguccuacccacgcggccaacugccucccgaccgcggcuccaucgguuucccggcgccaauggcgccagccaggggacuaggggcagcgcgagggcucaaacucaccggugcgggcugaggccggugugugagggagcgggaaggagcgccgagcugugcgcagccgggguaguuaccgcuccuccgccucucaccgagcguucuggaaaguuccgcccggcgcgccgcagccguccucuuuuguagccgaacccgggcgcgucacccgccggaagucccgcccuucucggccgcugccaccgccccgccguuaccugggcaacggcgcgggggcgcacgggucgggaggagcugcgccgaaaggccuuguggguguuggugcuagcgcggcuucccggcgcucguggaaucuucuggagcccuuuucuccacucagcgagccugagagugcggaagucuccggcugguggggcauggcccaggagcacugcaaguccuaggguucccaaaccugugggguggccgccugggcccgcgagggcgggaagggcucgaguacagugacccagcgggagcugugugugaacgggaaagcucuuggaacagucuugccccccccccccccccucuuacgggcgccucuucucuuuuugggaacguggcgagcaaaaaaugcuugagccaggugggucuaguccccagaccaauagcauaggccuugggucuugcuguuuuucacgcgugguccaaggcggcauaauuaaucaaauugugaaguuguuaaggcuuuuugugcaaguccaggccccuagacacauguuaucugcccuggaccucgcugauucgugcagauugagcucagugugucugggacugagcuaaacagugagacguuuggaccgucuuugauguacagagggccguggacuccucuggucagguuuucacccaguuuggcuacagaguagccgcaagagugucugacuaaaacaauuuguuuaauuauuugaccucacuuuuaaauccuacgggucagggaaccuggauguacaaucugcaacguaagaccucggacuugaaaaugguaccacgggggcuuaaugggaauugggguccgcuucuuuauccagggacacagcagguaugucaguaucuagcaccaagaaagauggaguuugccacgcucgguggcucacguguguaaucccagcacuuugggacgccagcgugggcugauugcgugagcucagaaguuugauaccagcccaagcaacauggugaaaccccgucucgauuuaaaacaaaaacagaacuggagaugcagaguugaaaagccccaguuagacuuuagugagaagccaaacaagucaacagacugccagagaaaccaugagguagaagucaguaggggagagccuccuauauuaaccugauagaucagagagaauuucuuugggaaaguggcaauugagcugaguuuugaaaaugggaggagagcaguggacaaagcacaggggaaggcuauacuaagguguggaagaauaugauguuuuuaggaaauugcaacuaauuggauauagccauagcuaagggagcuagaauagccggaggugaggcuucaaagcuaguuagggcaugccuuugucuguugguauauaugcuacgcuaagaauuuugaacuuuauccuuggaagcauccucaugcugccucuucagccuuuucucuuucauuaauuuuaacugugcauuccagucacagaacuauccgcaguuucccauauacgccuuuucaccuuuguaugcuuuugcauuggcugacagacaccugauuuuuuucaaucuuagguguugccuucucaaguaucaccucugguauaaaguuuuuuguuuaaaccaaccguuaauaaacgucuaauauuaccaggcaguguacuagggcuuuguaauacaaaaaucacguaagucaggccgggcgccgugccucacaccuguaaucccagcacuuugggaggccaagguggcggaucaccugagauccggaguucuagaccagccuggccaacuuggugaaacccuucucuacuaaaaauagaaacaauuagccagguaugguggcacgugccuguagucccaccuucucaggaggcuguggcaggagaaucgcuugaaccugggaggcggagguugcagugagcagagauggugccgcuauacuccagccugguugacagagcaagacucugucgagucucagaaaaaaaaaaaaaucacauaagucguggucccugccuucaaggagcucacaacauagggaaccagaaacaaacaguugaguguuaaaugcuaauaaaggaagaguagggggugcaugguggcucaagccuguaaucccagcacuuugggaggccaaggcaggcggaucccuugagucccggaguuugagaccagccugagcaacauaauaagaccucguuucuacaaaaauuagaguuagugugguggugugggccuguacucccagcuacuugggaggcugaggcaggaggauggaccugggaggucaaggcugcagugaguggugauugcaccacugaaccucagccuggacgacagagcaauacccugucuaaaaacgaaacuaacaaaaaaguuaacacuuuuaagaagcauucuuacguaaaauaaaauaaaaaaacuggcaauaacuuuguauguggucuucguuuguacagaaaugggaucauuauacaagcuguuuacagcuugcccuuuucacuuugucaucuuacuaugccaggauaaauaacuaaucugccuuguuauuuuuaauggcguaguauguaggcaccguaauuuauuccccuacugaugaauauuucagcaauuuccaguguuuuacaaacugcugcagagaaauuagcaaauacagcuuugaguacucaug

SEQ ID NO: 13920 - RNA, 1167 nt, Homo sapiens
aaguuaggguccuuuauugggggaugucagcagagaacgugggacaugaaaacaagucuuaggaguuugagaaggggcucccaggacaggcuccucugcuuuaaggagccuguccugggagaauaagcagggccccaguaugugcagaaguugucagggggugcccagggguauggugaaggagagguaguccccaagggcaccccagcggggccgguagaucuggaagauggugauccaggaggugagcacuaucacccagaagaggaagcccacagcugagcgccagacaucugucaugggaaacagaagcuggaaggguuggccuccggcugcucuccagacuucccuagaccagccuucccuucucacccagagccccaacauuuuggauccuccauugucccuucccaccaagauuccccgcuucccccucuccccugccacuggccucccuccucugugcucuagacucacagccuuugauuuggcucuguucuguguaggcugggacaaggaaggccucucggaagaaccagaagauguugaccaaccagagaaaaggcaggaaagcaaaccccccuagggagaaagaaaaacaaacaaacaaaccccaaaaccucauaaggcaaugaagaucuucuccaacucccaccgagaucuauuuggaagaaacucucccacacccaaguucaaauggagauuucuguugucagggacucaggaaucuggcuccucuuugggauccaggaaucugauuccucaaccaucucuuucacaggacccaagaguccaggcccucaaucccccuccucucuugggauccagaaauugaggccccagcuuccucauuccucaggacccaggcccuccccacucaaauccaggagucggcguucgcagguccuucaucucuuagacuuaagaauccaggccccgaggcccucuucccucgggugcucuaguccaguccccucucuucuccugggacccuagcgaucugccuuacccagguaguacuuccggcacagguucaauuucuccucauuggacacucgcuccagguucauagcugcgcuggggccgggucgucccaagggucugcggggcaagacccaagccuugacccuaaguaacagaugcaaggaucacgaacaaccacgcccc

SEQ ID NO: 13921 - RNA, 1167 nt, Homo sapiens
ggggcgugguuguucgugauccuugcaucuguuacuuagggucaaggcuugggucuugccccgcagacccuugggacgacccggccccagcgcagcuaugaaccuggagcgaguguccaaugaggagaaauugaaccugugccggaaguacuaccuggguaaggcagaucgcuagggucccaggagaagagaggggacuggacuagagcacccgagggaagagggccucggggccuggauucuuaagucuaagagaugaaggaccugcgaacgccgacuccuggauuugaguggggagggccuggguccugaggaaugaggaagcuggggccucaauuucuggaucccaagagaggagggggauugagggccuggacucuuggguccugugaaagagaugguugaggaaucagauuccuggaucccaaagaggagccagauuccugagucccugacaacagaaaucuccauuugaacuugggugugggagaguuucuuccaaauagaucucggugggaguuggagaagaucuucauugccuuaugagguuuugggguuuguuuguuuguuuuucuuucucccuagggggguuugcuuuccugccuuuucucugguuggucaacaucuucugguucuuccgagaggccuuccuugucccagccuacacagaacagagccaaaucaaaggcugugagucuagagcacagaggagggaggccaguggcaggggagagggggaagcggggaaucuuggugggaagggacaauggaggauccaaaauguuggggcucugggugagaagggaaggcuggucuagggaagucuggagagcagccggaggccaacccuuccagcuucuguuucccaugacagaugucuggcgcucagcugugggcuuccucuucugggugauagugcucaccuccuggaucaccaucuuccagaucuaccggccccgcuggggugcccuuggggacuaccucuccuucaccauaccccugggcacccccugacaacuucugcacauacuggggcccugcuuauucucccaggacaggcuccuuaaagcagaggagccuguccugggagccccuucucaaacuccuaagacuuguuuucaugucccacguucucugcugacaucccccaauaaaggacccuaacuu

SEQ ID NO: 13922 - RNA, 8403 nt, Homo sapiens
cgcaggccccagccagcucaggcuacacuaucccaggaucagcauggccguccgccaguggguaaucgcccuggccuuggcugcccuccuuguuguggacaggggugagugggcagaaccuggauucucuguggcuuuguguugguaggugagcuuggggugagagcagaagcagggccuggagcacccugugaggccucagcuuuuuccauguaccuucauucugcauaugcacccuccacugugcuggggaaaguucugggcugggagaaaagaaacuuggguucaaauccugacuggcgcagaauuaccaaaguccccuacccucuuggggccucaguuucuccagcuguaaaagagggcauuguuccaguucaaagcugcacugagcaacuauugggcuggaggcuguggggacagaagggagcagguaggucccagcucucaggagagacugacaaguaugcugggugcagggugguggaugcuaagagagaccuggccgaggucuucugagcucccgaucucucugaaaggcugugguuugggacuugggcagccaugugagcacgacagagcccuuucccaggacuggacacauauacuuggggcagggcccucucaggaucugggccaucccugcaaucucacagcuaccaugucaggcacuguucugagcccuuaagacagauuagugacccaaacagaaaaagcacgguccugauggagcauaaauccaaugggguagaggaaaaggggaaaggcaauaaacaagaugguuacaauguauguuaaacgguauguuagaagcugauaaaaguuaaggaaaaaauacuuggcagggugaugggcacuggaaggggguugcaauuucaaaucaggggagguaucucugagaguccgauguuugagcaaagcuugaaggagaugagggacuaagccauguggauaucugggagaagauuccaggcagagggaacagcucaggugcaaaggaccugaggcaggggcaugccuggagugacugagguacuguaagaccaguguggcaggaggggacauuguacggagugauaggagaggagaugagagaggcaaauuggaacuguaccgggaaagaccuuguuggccaacauaagaacuuggcuuuuccucugacuaaaaugggaggcacugaaagcuuugagcagagaguuaugucuuucaaggguugcucugguugguacauugagaauaaacugaacagggaagcggggagaccaguuaggacccgccuggacaaaagccauaaguuauaaggcaacgccuggcaggauccagggccacugaccucauggccagucccacacccauuuccccagcuggaaacagaccugggcacagggggaaagggaaacgggucuggggaccuguucaggagcagccugcuuacgcccagccuggcaccuacaccuaccuacuccuugagcaguugggaacacugaaaagccugcucugaagaaguuugguuuuuguuuguuuguuuuuguuuuuguuuuuugcacauuucagacuacugccugggcugagugaggagggggcauuuugggucaaggucaagggcagccuggggguaaauguagcuuuuccccacaucccccagaaagaaacucugacaucuuagaguucugaacacccccuccucccaauacacuuuaauuuuuuuuuuuauuuaaacaaaaauuuuuuuuucaagacagagucuugcuuuguugcccaggcuggagugcaguggcacgaucuuggcucacugcaaccucugccuccuagguugaagcaauuauccugccucagccuccugaguagcugggauuacaggcacaugccaccacacccaacuaauuuuuguauuuuuaguagagacggaguuucaccauguuggccaggcuggucucgaacuuccaaccccaagauuugcccgccucggcuucccaaggugcugggauuacaccaaugcacuuuaguauucaauuccugaacacccacaguguaggacauugaaccaagugcugcgcaaaggcagacauaaaggaaccccaaggagcucaggugcauagggaggcggggugacccagugagugggacaguacaugguggugugaaagaagccuccauccagaucugcucaggaaacuguuggggacgucaaggacagcuucacuggggggcagcaucaagccuugaaaggaggguaugauucggcgggaggagaacggagacgaagacauuucagggaggggacauggcaugagccaaagcagggcccaaucuaggacccgugagcagagaggaauagcuggggcauggagagguguacugggaagucagcccaagaagcaaguuuagggucagcuuacgcaguacccuaaacauaagacuaagcagcucagguccauagggaggcuuagugaucaggacagggaaccacggaagggcuuuauauuuuuuaaaugcuuuucuuuucccuaacaguuaaauaucaagaaaugcacaaaucuuaucacucgaugaaucuugacaauguauacacucguguaacccaaacccccaucaagauacaggaccucuugagacaaggacuuagggaagaaaaauaaauacagaacauuuccauagccccagaaauuccccuaugucagucaaucccugcccccaucccagugcucugacacuuuuuuuuuuuuuuuaagagacaaagucucacucuguugcccaggcuggagugcaguggugcaaucauagcucacugcagcuucaaccuccuggauucaaacgauccuccuaucucagccucacaaguagcugggacuacaggugcgugccaccacacucagcuaauuuaaaaauuuuuuuaaauuuauuuuuauuuauuuauuuauuuauuuuugagacggaguuuugcucugucacccagguuggaguccaguggcacaaucuuggcucacugcaaucucugccuacuggguucaagugauucuccugccacagccuccuaaauagcugggauuauaggugugcaccaccacgcccagcaaauuuuguauuuuuaguagauaugggguuucaccauguuggucaggcuggucucgaacuccugacuucaggugauccaccugccucagcuucccaaagcgcugggauuacaggugugugcuacugcaaccugcccucauuguuaaauuuuuuguagagaugaggucuugcuauguugcccaggcuggucucaaacuccuggcuucaagugauccuccugccccagcuucccaaugugauuuuuuuccaucauagauuaguuggccuguucuaggauuucacauaaauggaaucauaggguauauaaucuuuugugugugguuucuuaugcucagcaaacuauuuuugagauucagccacguuauugcauguaucaguugcuuguuuuaauuguucaguagugccccauuguauuuauuuauccauucuccuguugaaggacauuuggaucacuuucaguuugggcaauuugacauggaaggguuuuaagcaguucagugacaggucuagguuugcauuuugauaccccaaugccaggcuuaaacagcacauuggggugacuuagucuaaguuucuguuucccucucucuguggaaauacccuguaauagcaucuccaggaaaauauaaaacuacauugccuugcacaccuccagugaugggaaacucacuacuucuggagaaagccucuuucacuguggcauagcucccacugagagaaaauucugcuucauauggaacccaaaccugcuucccugcagccuccucacagagaugggcucugcuuugugagguugaaaagaguccaucucucccucagccccaggauagcccuucagagacuucagggagcauccugcccuucucuaauuuacauaaacgcccuuccuuccaccugugccauuagacauagcuccaguucccucauccacccaucaugcuugucagucacaucacaguuugcucauguccuuuaagcaguucagccagaccuugagggguacaccaguguauguagaaagagucaggcucuggacugcaacagacgugugggaaaauccuaccucugccuuaacaaacugcauugcgucaccucuuugagccucuuucguaguucguuaaacugaccuaugccccaggaaacagauucugagcuauacaugcaauuuacuggggagcguucaugggaguaacauccaugaaggaugagggaaguugacuuccaugcagcacaacagaggcuucagaugauccuacaggcagcuuugggcgaggggaucaggcccuuuguaaccacaucaacccgacaugggauaugggcuguuccuggguaguggaugcagcccugggcaaggcagcuucauucucugaggguaauuccuaggaagagacuugcagugaguggucaauauuucuggcagcaggggaaaugagugccucagacuugcgcgagggcucuugauggcagaacacagcauccacuacuaucuccuuucuucccucuguuacacagcaguaagauagggguggagaggaguuaaaaucauguguucucaaugcccggcacauaauaacugcugaauugcuauuuuauaauuauuauaugggacacaacaauuccagugggaucuaacuaacaaggaauaggcuggacugucaccuuccuaauuuuugaauuucugucucuguuuauggaacccaagaucacaucagcuuucuggcagccccauugucugguggcucaucaccuuuccuugaggaauuccagguuggguaguugcuggaccaagcucccugaagcagaagcaguccucagaccccuagaccuggggucuagagccggcauaaucuaauucuugcuucuuuguguuucagaagugccaguggcagcaggaaagcucccuuucucaagaaugguaaggcagcugcguguuguucucaccuucucucugcugagaggaguccucucguccaugcugagaaaccaguuauucuucuccacgauccugcucagacaccuucaauggcuccaagguggccaagguggccuccuggccugcacauuccccacauuagcccccaaggcugaguaggcccagcccccucacccaagucccaagauuggccucaaagcccuuaugaugucccccaccugguguccaaggccccuuccaucagugagaucuccccacccaggcuuagcaggacagggugugcucucugcucuguauagugcagacaggcaggccacagaguucaggccaaagaggggacccuggcacacugaaagcaccuguggagugugccagccucccaccaccacauuccaucugauugucuaaacaccaaguuguccccgaauccugauuccaccuuggcccuuggccuaaugcccccagugacccagaaggcagugguacuggcauccuugagacucuugagauugccccuucauguaguggaaugaggaggcucggagccaccuucccauccacagccucagcaucguccccgucaguccaucagaauccagccccgcuuauucagugccaaagagccaaauaguuuacauacauuauuucaauuagcccuaugugagagaaacgccacuauuauaauuuuuacagaugaggaaacugagacucagagaguggaaauaccucaauuaagguuauacagcuaaucaguggcaaaauucagguuucuaggguucgggccuucacgguugcaccgcacaaccuuucucagccuaucccugucucaggcacuaaugccaguccugacugaguucucaccuugaccucaggccuguccuaaaacccuuucagacagccucaauuaagccccaagcucugccccauuucuucagccuucgcacacuuugcagccuuucugacaugggccugauagaucaugcaggccagggagaguucaggagcccccagggagagaggggccuccugggaaugaugggugguuccguauccuggggucuucaaugggaccagcagaaguucugauuagugccucugaagagggugugaacaaguccccaggagcuugagggcacaaacucacuccacacacauagacauaaacacaggcauacgcuugaaugccugcacaccgggggcuccagagacacagguacacauauguacacauccagccauaggcacacacguggucaugcacacgcacauacaagcaaacacaccaaggggcucugagugguugguuucaucuucacuggacccacacugggggccuucuugacucugauaccucacuggggccccacugguuccgagcagaaccccuguaucccuccccacugccucugaaucccugaguccucucccucccuucucuuccacagcccaucugugaacacaugguagagucuccaaccuguucccagauguccaaccuggucugcggcacugaugggcucacauauacgaaugaaugccagcucugcuuggcccggauguaagucugccccacaaccccugcuugcuugggugggccccaucucuggugcacagucugaaaggagcaagacuugaccugcuucuuccuucauacacgcuugaccugagaagaguccuccaacauaugccccuaauagaaugagugccagauuaacucaaagaaggcacaugguuccaagcagaaaucuagaagcuggugguggauagggaguaggggcagaaaccauuuuccuuguucugccuugauugacuaggugaccucaucuguuuuuucauucgucuagccagcaauuauuuauugagcauuuacuaugugcuaggcacuggggcuagaacagagccuaaguuagacagcaucacuggccuucuggaacauacaauugguguaagggggaagccaggcugauagucagccaauugcagcacagaauuuuuuuuuuuuuuuuuugagacagacucucacugucacucaggcuggagugcaguggcacgaucuuggcucauugcaaccuccgccuccuggguucaaguauucuccugccucagccucccgaauagcugggauuacaggcgcccaccaccacaccuggcuaauuuuuuuuuuuuuuuguauuuuaaguagacaugggguuucaccauguuggccaggcuggucucgaacucccgaucucaagugauccacccgccucagccucccaaagugcuaggauuacaggcaugagccaccgugcccggccuucagcacagaauucuaagggaucaguggggcacacaggaauaaguagaaauuagcuaggaaaaaggagcaagggaagauaauuccaaguagaugaauuugaaaaggucuacaaggaaaaguuuacauuugaggaaauauaagaaguuggacauguuggaguauaagguuuaagggagaaucagggagaggcaagaagugaguccagaaagaugagcagggcuagaacaugaccucccuacaucagaucaccuauuggcucuuaguuucuucaucaauaaaacccaucuucuaugauccugagaacuaaaugagaccauggaagugaagaaaguccucggaagcugcaaagcucuggauagaugugaaaguuuguauuugaggaaauauaaggaacaucaggauguuguccuagcuuagagaaagaucaugcuaaucaaagacucaugguuaggagguacauugggaguggaauugacaggcuugguaugugacuguauguaaaggcugaggggaaggaggcagcauacugguuucugauuugugggcuuggguggccagugguuucaugggcugagaugggugguuugggggucuguaccaguucuguggggggcagugauguuuguggacaguugagccccuaggacaucccacuggauauggacaacugcaugaacagguaggacauagguccgagcuggagacagauuuggcagccaucagcgugcgcuggugguggaaaccccaggaagcuaaaaucccccaggggaaggguguacaaaaaaggaaaagcuguagaaggaugugcccauggacccuugggaucugcccuguauccauacacugcauaugugggcgacgcucagcaggaugucuggauggacugugccaggucccugaaugguacacuacagcuccugagaagguagccucaugccugucuucuuugauccuagaaaaaccaaacaggacauccagaucaugaaagauggcaaaugcugaucccacaggagcaccucaagccaugaagugucagcuggagaacaguggugggcauggagaggauaugacaugaaauaaaagauccagcccaacugag

SEQ ID NO: 13923 - RNA, 12848 nt, Homo sapiens
cucugcaaucuuccagugggcuucucugccccccaucugccugugcuggauggccccugagcaaagcacuguaauaggugcuaggaaggacacgaagaagucuauguucaaacauguucuugcccucaaggaguuuacauacaagaaaccagguuaaaauuaugugaaaggggcagacaggccaggaauacgggggaaauuaagcaauuuaacuuuuuauuuaaaagagauggggucucucuguugcccagauuggucuagaacuccugagcucaagugauucuccugacucccuaaguguugggauuacaagcauaagccaccacgcccagcugcaauuuaauuuuaaaucagaguucaaaacaauagaauuuaugccacugugugugccugccaaacgaacugaacagacaguaacugcucuaauaguucagaggagggaaagaucaccucaggcugggggcgagggaugggcuuaaggaggggcacuauuugagcugagucuggaaaaacagccagaauuacaggaagcagagaggcuaccagaaaguggguguagaccagacugaaaggaggcagcauucuccuccuugggcccugggagcuccuggggaguaagacuugagucucccccaucucugcaaccccacugcagguacauaguaguggcaguuugugacaugaacgggcaaacagccagggcagaugcagcuaacggguagcccccagugcuuuuugcaccucuccaagauugggugacuaccaguccccugaccccuucaccuacccaauccuuuccuguccucgguucuuuuccacugucuccacccugggaaguggcaucaacacaggagggcauugugcuccuucaauguggucuauucauacacauauagccccuuuccacugcucagugucggugaugugacucagaagggccacauuuucgcugggucccaucuaaaggccugacacugcagugaagggcaugcuaagucuaggcacagguccuggcagcaggaaggagacagagccucucccaggcacacauccccuucucuguuucuggaagaagacuaagaaaggagugggaaaucgcagggagguccaggcccagggcuaauagguggauggaucuccuggguucaguuccuucucugagcuggcucccacuccucuucugggauggugaggcccaggagacuacaugggccaccaugccccugccccaaugcuggagcaucagagagaaaguuggggcuggguuuuguuggagaugauucagcauguucagccagcaggcccuccauggaggauucauguccaaggaggguggaggucauccuacugacaucuugcucuagagguccaauguccugcuguccgucuacagcuugcuccagagcugggaucacacaguccaccucucacuucgggccuccacagucugcaccaggccuucacccagcacagcaaaguccuccaggauugcuucaacauugggcaccauuacuagcuccccaccucgagacaucaccaugcgccccuuugugcuggaggccuggggaaaucagagaagagauguggguugagugucacagcggcacacccagagacaccaagcuggguacagagugggggugguggggauagaaacacaagcccauacacuccgcaccugacacggguuugcccauaggacagacuacacacagacaugcaugcccacacagaaccacgugcacacacucaggaacacagcugucaccagccagcacaccuugaagggcugcggcuggaagcuggugggcuuccagaggacaccaaucaccucuccaccaugcuggucauagaagaaaagggccagauccccaaaggccuccuagaaagggacagaacagagaagauuauaggcaggcauuuaagagcuccuccacagccucagcuucaccuggaaguccccuccccaggucauucagcuguuuaggaccaacccugagcugcgucagauagagcugaggaggaucauagcccagcacgggcaucagggaugagggccccggcuggcugagcaggccccggcagaaggaggcagcuggcgaguccacagccuggcggugccgcgggauauggcgaggagacaggcgaaucagcacgucguaaauguccaagggcggccggaacacugucuaaggaaggggagaaggaggggucagcaggacccccuugacugaggaacuggaccacaaaccucuccacacgcccaccuugguuuccuccuuccaucugaccacccucuaugggcccaccugcccauuugaagacugaagcaccaagacccacagagcaaacagcuguugcauagcccggcagaaggagcacaggcuagaaacaggagacccagauggaacccagguuccccaggcucugccaccccaggcaccacagcagcuucaacaccuccucuguucagucucaccaaacaaggggaccgggucuccugugagaucccugaacgcugaacuuccaaagacagaauccccagaggcccuggagucacugcuggucagaagcuuacccugauguccccagguccccggggauccaugagcugcuucucuaacaugggcagggcuucagcugccaggaccacaagcugcugcaggaucugcgggguacagacacaucagacuggaacugaagugggucucucccaggucaggcugggccugcuuuuuccuugggaagaaaaccacacauuagggggcagguaugggguugaaccugggcugaggguccauccuguguccacacagaguuuuugcggucuugggggguaacaaugaccaugacggggagcugugcccgagcugccaggaagccacugcggaucuccaccugcuccuccacuagagacaagaauggguccugggucagccugcuccucccuguaagacacccucuacucccccagguccuccuacggugcccccaacggcugcucaucacagguauuuuucaacacucccccccaccaaguggcaaaggugacgaaagggacaucgcauuugccucaacuggguggggcauuaaucgcccaaccucagcccagaggcaaaauuuuccacugcuuggcacccccagucugguuuccgggccugcacaagcugagucuugccccuggcccccucccaccaugggcuuccacacaccuggggaauuaggaaccugacacccugcucucugcagagaccgagugccucacguuacaaccagaaaucaccacucccacccccaccaagaggucugaguaucugugcuacacuuccuagcuccgugcccuaauacuucuuacgugguauucaggaucccccuucuauucuccucuuccuuccacagccccccgccagguagcuugcuuaccacccuaucauucugucucugacaauuaagagcaaaccaugucauaauggucaggcuguucaccuggaccucuucuucaugucaggcuuagacaucuggggcuggggaggcacagagaaaaccuaacacugccagggaaacccuugccugcaauccauaaagagcuguucuuccagcagucugaccccuguucuaccacuuaccagugagcucauuauugagguugacaaagaggggguuguucuuccaaucaaacguugauaccaagaaaaggaaucgaaggaagccaaccuggggggaacuaaagggcuggaguaagcaaagaauccagggcccagccacauauccccaggcuucucucaggcuauggagcucagacccccugguguggauuggcagggcagggcaucuuagaaccccuucugccacuugcucaaccacccauucccauguagacuuagggugcagcacgaaggaugauggcuggccgcaaggaaacuucucagcuggggaaaaaguggagggaaucaccucggaggggugaagggcucagggugcaggaaaagggcagcggccaccagauccaggcucucaucagcgaaacccucaccaagaagcugggcacgcacccaccgcuuggccagccgugccacaccagagaaggcugggugcugcugcugcagucugcagagagaaggggagugucagcgagacucagggccccacugccacuguucauccagccccuacccaaggccagccucagugauaauagguuacauauguaaucucauauucucuuaagaaaugcaccaagaaguugacccuaguguuauuuccauuuuacagaugacaaauauagggaccaaggaggaaaaucugaccauagggucacagucaguaaguggcagagccaggauuccagaaccugccugacuccagaacucauaccccuaacuaugauaccaucuggccccuggagagacagguggcuaggugaggagaaugggggcaggagggggccuacagacaggaagaagcugugucaguggccuuacccgugcagggcacuggugagcaguggcaacugccuugugucucucucaaggcggagggaggcagcugugucccucagcgagaucauccccucugggcucugcaccuccuucaggaucuggggcucccgcugauaggccacgcgaauccgaaacacaaauccauccuguuggaagaagguauggaaagagaaggaugugucagcccagaaccccgggaguacucuguggccuacagcccuauuacccagcgugguacccacaggggugucuucuuccacgcccugacaucccuggugccccccuucccuggggacauaucugccugcaccagccuaaccuuaaggacauccgugugcguggcaguggcacggcacugcagaccaugcuguugugucaacagcucugccaggcgcagcuggaaggcagcucggacccgcugcacggccucagcguccuguggccacuggccacugcccuccaggugacaaaccacugaggaagaagagucagaggucucauacuguggccuggagcuggaacuaucccucccacucccucccaagggcccucuuaccggucaugggcuccacguaggccggacagggcuuaucgagccggggcagcagugaggaccgcucccgcagagucucauagaaggagaaggcuggacggacuggaguuggugggaacaccuguggaagaagaggggcugaggaaugggccuaggacugggagggagugcccagagucaggaguuggaaguggggaauacugggugacuggagcagagguggggccacuaagcagaaaggucaccugcaccguugcaccucaccucuguguagcgcagcacugggugagcucccugaacagcagacacggucagugggagacccucuagcccccacaguaggcgacugaggucgucguagcaacguaccgccgcuaccagggccuccucaccugugcuggaggucugagagggagaagacggucaggaggcuggacccuacagaaggccagcuucaccuggauucugccccagcucaggcugcagcagagccagcaccgccgccugcuggacaugccaggaagugcaagcuggccaaggcugagaggacucucuccccgcagauugauuacucuacaaucacuagccuugaccccaagacccuuaccucuuucaggccuuggauaagugcauccagggggccccccacauaguggacacagguuucugggaugucagcauggcugaaaaagaggcagagacacagugagaaaauuuggggcuauguucucgcucaacugccugggccagaccccugaaaaggcuccccagcccacacugccuucuggaauccagaugccaacacucacagugccaagaggugggugaccaccugguggggaauaaggcgcuucugggacauagaggcugccucccagaccacagcuucccgaauggcuccguccuggaaacgccgaagcuccgagcgggauccccagaacuggcggaauuuagcagccugaggaggcaagggugguaguagagcuggggaaggaagggcucuguggacccuccccaacaagcuucaguccaggugccaugaggacgagccaccccauuccuuccaguguacaugcuggggucccccaccucaggcuggucugccucuggacccagcucaaggacgcuggucagucccucaggccggagaaggagucccagggucagggucccagagucuuugugcuuugguggaucuuggcugaugucccacugcaggauuucaaaaggcugagcucaguccuccaauccuccagccuggccuagaaaccuacuuucuagcuagcuagaaacgccuagcuggaggaaugguguguccuuugugucucuugggacccuggauccagcccaacucagacccaaacuccccaaccuacaccaccucaccucugggacugggggucgagagugagccagcagguucagccgagcccccaggcccugcuccaggaggguggucagggggcccaaagcagcugagacauaguccccaccauuguccugcagcucuggccagagcuucagccgguggcacgcugccugcaggcgacucaguggacggagacuggagggguacaaagggccaaagagggguaaucagguugcuggccccuaguaccaccuccucccugaaugaucugagcaccugucugaagaccuuugccccaccacuguagccccgaagagacaggacccgccaacauacccugucaccccuaaacucacugcaggacauggucaaaagcccggaucauggguuugggagucaucaacagcagguggaacccgucgucagcucugcuguccagcaacaucauagacagccgugccucaugcuguaccuggagccacagaagggaccaucccugugcccuucauugauccaagggcuuagaccaggagacaugcccuaaacuuaacucuuugaagaggaguuucugggguucugguacuugcaaaagggacagagucugggcugagacaucaggggaacacagauugggggcccauugguaccuggugguaaguagaggcagugacaucagcacagagguugagauggccugaggaauccaggaagacaacggagaaggccugguggaagucagccagggccggcuugggggguguagagagaagcaggucaggauuggcaccuuacuugcaggccuccuggcauagaccuggcccuuccccaacucaccaaagagggaucugagcugagacauaaacugaucccguugacugucaggucuguaguggcugaagugaaucacaaguguauuagaagguauccccuucuggggacccagcccuaaugacacccucccucagccgauucaguuugcucaucugucugauggcaaaacaccaaaagacugcuacugggaugagaggauucccaggaggaguggagccccuggccuuuccccaccuaguugccucacccagaaacugcaagacacuucucaggaccugguagccacucauggugguauggaucuugcguguagacacaaggaagacaaccagcauggagacaaggaacccaguaaacccacccuggcccugaaagagacagggagaggcugaggucagagccugcccaucacacaggcgcucagguagggaggcugcgccacccccaacucaccuuguccagcucccgcugccgcagccagaccuucagaagugccacgccauccuucaggcccugggcugaacucagaaugguugacagcagcugcaaaugggacucgagaacuguaucuugcaggacccauguguuauagcgggggguaggaggcucugggcuaccugugggaugaaaagggaagccaugagaggaaaaguccccacaccucuucccuccagcuccaccucaacaccagggccugcucaccauccccugcaggacucugcccucgguaccaggcagagcgcacauuguucuugguuggcagcaagcggcacgggcggaagaagucagguggagggcacggaugcagacguacagugaccaggcgcucauccuuuccugccagagacagugagugcugagacucugcaggagcccuuggagccagagggcuccccauccuguccccccauacuugaggccuccgugccucugugccuucuccuccagauuuaccaucccaugcuaugcccucagcccaaugugugccucucaccacgcggccgcagcaacagugaggguuucagguggcagccauuuguguaggagaagcaaacacugccaaagaggggguccugggccagguggugagccaagugggccagguagagggcacgcuugcggaaguagcgcugguucagcccguccuuguccuguaggauuuccuggaggggccaggggagaagagaaggccaggcacauaagugcuuguggagcugugggccaaggugaaaccaaggugagagagccagggcuccucugcugacagaagugccugagccacgguuagcaacacuaggcccaguucucauaucuggagagcaaagcuccaaaaggacagcaacuggcccgagggaucuaagcugccuucaggaugccugcaauggucugcucuucugauuuagaauucugacuucaauccccuggcaagcggcagauaagaaagagggauccaggauuuguagguagucagguggugggccucuauccccuaaacccuggaccuuacccugggcauggucagugccacauccacauugaugucuggucggaugcaggugcccagaagguagcugcccacaacaguaaccugggcugggggcaggaagcggaaacagcccuucacggcauagggcacuugguggaggggcacucgaaccccagcugggagccaugccuggucagugagcugugggggcagagacagggacacauacugauucaacugccuuccucacauguacccuuuaugucuagaagacauuuuaacacaucgauauguuugaaaccaaacucccaaucuucccauaacuaugucuuccuugcuaagacaacuccauaugaguugcucaagccaaaaccacuuaaaucaccuuaacuuagcucuguuaagaauacccauuuuacgagccgggcgugguggcucacgccuguaaucccagcacuuugggaggccgaggugggcggaucacgaggucagaagaucgagaccauccuggcuaacacggugaaaccccgucucuacaaaaauaauuagccgggcauggcggcgugcgccuguagucccagcugcuggggaggcugaggcagaagaauggcgugaacccggaaggcggagcaugcagugagccgagaucgcaccacugcacuacagccuggggaacagagcaagacucugucucaaaaaaaaaaagaauacccauuuuacuaccaaaauguauucagaaauggaucacuucucuaaaaagaaaacuuuuuuaaaacagagagaggaaaagauuuaaaaaaaaaaaaaaaaaagaaagaaauggaucacuucacuacuuuccucccuaguuugaggagccaccauuucucagugccuagacuaguuccuaacuggucucucuaaucucaucauugucccucucgauucuacuuuugacacaacagccggaguaaauuuuucuaaaacuaaacuuuuuaaggcuggaaaagugaacguuuuaggcugggcacgguggcucacaccuguaaucccagcacuuuggaaggccaaggagagcaaauuaccugaggucaggaguucaaaacuaaccuggccaacauggugaaacccccucucuacuaaaaauaccaaaaaaauuagccgggugugauaaucccagcuacucgggaggcugaggcaggagaauagcuugaacccgagagguggaggcugcagugaacugagaucgcgccauugcacuccaguguggaggacaagagcgagacuucgucucaaaaacaaaaacaaaaacgugaacuuuuaaaaguuagagggcaucacuguucugcaaaauaaaauccagcaguggcuccccaucucacccagagcaacagccaaagucccuacuucgggacacaaugcccugcaugauaugcuacuuuuccccaucaccuuucugaacucaucuccuucuguauuccucauucauuccaaggaauguaacuggaacauuccugccuuugugccuuuguacuggcuguucccccuuccuggaaugcuuuuauucccuuagauaucuauauagcugacucaccuacuucaagucuuuacacaaaugucacuucaauaaggccuacuuugugaacacccccuuuaaacuuguaaaccacucccauccucuaauacucccaauccccuuacauugcucguccuacuuuuuccuuuuuccaguguuuaccacauucuaacauugccauagaguuuaccuguuaugcuuaucuauuaacuauaaccucagcauuacagcauaggcuauuauuuacugauauauccuaagaacacaaauacugcaaggcauggaaguacuugcugaaugaauacacaaaugaccacgcucccagcuaagcuuccuugcugugagaaugagcucccugcaccccaacccuuaaacagaguaacagcaaggccccuguuugauauacccccacuggaggucucucuugggcuucccaguuccccaggccacuugcuuaccucugucucagggacugagggcacccucacaacccgcugguugaccucccguaggaaggcaucaauccgauccuucuucuucucugacagccuuacuuccuuuaguagcuccucuaccuguaagagaggguagaagacaguccaucagccucagggucccagguacacaccucgaacaaaagcugcagacacucaacaguaccuguaaacgaagcaagcuggaguggaacaagaucucagucucccgaaggcgauuaagcuccucauugguaggcuccuuguacaguucugcccugcugagcuucacuggcugcaggaggcccuucgcuggagguucagccaauguacgcuuccuggaggaugcuuucuuccccucuuugccugugccuuccagggcugguuccaucaccuguggccagugagggagaagccauuuugagguaauagguaucuagcaucugcugccuaaagugccaccaugauagguuguggguaaaagcuucaccugcucugucccucuuuugaguaggagucagauuuuguaaaacucaggagaaucguuacuuggaugaacaucacugagcgcugagccgaaaauuccuugaguuaagagcucuccugucuaccugacaccacaagcauggagcucuguuuggaauugguagugauagaagcugacugggcccaggcuggacacgguggcugacgccuguaaucccagcaguuugggagguggagcugggcggaucagcugaagucaggaguucgaaaucagccuggccaacauggggaaacuccgucucuauuaaaaauacaaaaauuagccaggugugguggcacaugccuguaaucucagcuacgcgggagacugaggcaggaaaaucacuugaacccaggaggcagaggcugaagugagccgagaucgugccauugcauucuagccugggcaacagagcaagacugucaaaaaaaaaaaaaaaaaaaagaagcugacugagcccugcccuaaguaaugcccaggccccuuguauuuucaggaaguuuccucuucugcugauauaggccugggacuucucaaaugucuuucccauucucgcuccaaccaaauccugccagguuccaccuccucuaggaagaccugacugccucaguuuacacuaaauacucacugauggaaggagcuagaaccgacuggaccccagaggacacauuuagcaagucauuaaauccucaaaauaauucuugaagacacuugaagucccacuauucacucgagguuccacaacugguacacccguacuaugagcaggcuucaaaggcaagcgugcaggaucccaaaccuuuuccccuacagccgugggcccauccgcuccacgaugccucucaucccagagagccuuacuggagcgcuccaggagaggcaccguaugcccuccgcuacagcggggagcacagaacuggacacaaauucuguggaggaagaucccgcuuaucgucaaggaccaccaaauaaaagaaacgacccaagugugggucucuucaacuuugaggugcagagcuccagaagagagcagaggcucuaccggcuucacugcuucuaaccaaauacugccagguuccaucaccccuagcaagcccugucucagugccacuggcuggaaacauccuccagaaugggccgccggcauggcuuucacccgcaagcugucagaucacgccaucucgggcccugcagccaagggagcgcacauugagccucuguuccuccccgauggcucaacccaccucuggcucuccagucgcuccgcgaagcugcucuccagcuggcgccggccccaucacucaggguccagcacucucccgcacuucagauucuagccgggucuauaccucauagcuucccacgugggcggaaaugccuaacuccaggcccaaguccagcccaccccaauuccucaggacuccacccacuccagagcuauuggauuaucagucgauuacucgcuugccauuggccgggcagucucaaggcccgcccauuaggggaggggacaaacggguuucugugcuuuacggccucuucgcgacgcuagaacg

SEQ ID NO: 13924 - RNA, 5198 nt, Homo sapiens
ggcauuggccccagcccucccccgggauggcagugauccugcccgguggugucuagggugagaagggguaggggcucaccucagcagaggaguagccggaggaggaguaucuagacaugucaaagucaucaucgcuggccauggaggaaagagagggaaagugauaccaagaaauuacauagaaaacucucugcaaucccaccucccauuaggcagcauccuauaccucccuuacaguuccaaauagcaaaaucucaauacgaacugugcuugcugugcaaaugcaggauuuuaaagacaaguucccuagccccacccuuaaaaucaauugcuauccuuaaccuccuucuaaauauagcaguuacuccuuucacccccuucucaucuuuuuuuuuuuuuuuguagacucaaaucacccugacuuguaggauauucccaaaguccaagucuagccagguguuuuccagggaguagggcuccuuccugaggggauggggcauuaagcaucauauucugcuguccagagacaacaucacaggccaauuagggacaaccauuggaucaguugucccaggaugacagcagacaacgcaggccccccuuuccucucucugccaccucucuucaacccccagucccugguguaaaaaaauucccaucccuggagaauucacccuuggagagauucuggcugaagaauaucccaauucugacaauauagcagguguggccuguacagcccacuugugcuauacagguuccuuugggcugcccagcuacccccaagcccccauacacaccuguccgugucaagggcuaccaguggcuucucaucagggcucuggucaagugaggaguagccuuuauuggggacgaccagccuaggugaagaauuucgggaguuagaguggcaaaguggagcauagaaaccuggcaagggacuggguugggccccgucccaccacuuucuucccucccuccccaccuuggauccuguuaaggcugucuccucucagagaggagcugggccugaggagggagggaagagggggaggcucaggaccagcagaaauagguccuggcuggcaggguccaggugggguagggagggccucuaccuuguucgggccaugacauuguucuucuuggguugcugguugacagggcuacccaugcugccauucuucagggagcccuuccgggccagcucccgcugcuucucugcaggagaacaugggaaggaagcuguguccugccccugaggccacccugucuuacuacucagggcagccugggcugggccuccacugugaaaccacuugcuccuagaaggacugaggcagggaucccaacuccaggccccugcugcuugguggagauaguaccuggcccugcacaaccugaggcagacaguggggggcaaaaagaggaggcugcccccuguuuuucaggaaccacaacucccauguuaggguaguuaguguguacuugaugccagggaaaggcuggcgggggagagacaaucacagaaggauggcgcagucagagagggcuuccuuuaggugacaccaugaccuggagagagguggacauucuaggaaggagggauagugugugcaaaaaugcauuuaaaagugagcauaaguguggcucuggauagaggggugaagagagaggucagguuagagaaguaaaauucauuuauucagccacuuauucaacaaauauccaugucacuaauuauaagucugguccugugcuaaggggccgaagacccucucugguuacaaacucagaacaugaaggacuugaaugccagacagaggaguuugggauuaacgcagaaggaagaagaagccacugaagguuauggugugggaggugcaggauggggcuacaaaguaaggggcagaaggcugggggagcccauuuggcuacgcugccugaguggugcuccugacuccuuugccaaggucugaguucuccaagguuccaaagccuaccagcuucauggagcuggccaucaggugacccaguccacugccugguaugugacaacuguuaccagaaguagcuuccugggucuuggaggagucccaucuacucuucccuacucaucucaaguaaaggccagaucuaggaaaaggaacuguuagguggagagggacacuagggaaaaugacucauaaaauagccaaaugcuccagaggguaaggaugggaaggaccuuuacagcuacugugacucacuuggaaauuuccccugaccucaugucucugaaucucugucuucuacucuuugacccucuuucuuugccagugcucagcugauuccagcuuuuucccagcuucuuuccagcagguggcagcugccauuaccacuccaggccucuagggggugcaauuugccuuaaaguuccuggugguacuaggugcaacugggacaaugcugugaauuuucaugaggagcuuugaugguaauguaauggggagaaaaaaagauguuauuuuaaaagcaugcugaaauuguuugaaauagugggaaaaaagcaaacaauaaacuggcaaaaccaaacuaaagacuacuauacaaccauuuaaaagaaugaagucacaauaugaugacauuggaaggagcuccaagauuuaggugguggaagagggaaggccaaguuucagaaaaugugcacaauaugauaccacuuauguuaaaauacaaaguaaaacuacaaaaacugaaaaggcuuggaaugguuaccucuuaggaggagaaugugaugggggagaguaaagaaguuaugcuuguuaaaauauuuguauugugauauuaaacaauaauaggcuggguaugguggcucaugccuguaaucccagcacucugggaggccgaggugggcggaucacuugagaccaggaguuccagaccagccuggccaacauggcgaaagccuaucuuuacuaaaaauacaaaaauuagcugggcguggugaugcgcgccuauaaucccagcuacuugagaggcugaggcaggagaaucgcuugaaccagggaagcggagguugcagugagccaagaucaugccacugcacuccagccuggacaacagagagagacucugucucaaaacaacaacaacaacaacaacaacaacaaccaacaccccugauaaauaaaauuggcugcaguuuuaaucugauguccuaggaauagaaacaaauuccaaggagaggacuauucuuguuuagaaaaacagcucgaggggcucccuggauguggucuggaaggacagaagcaagcaagguaagaaaaaaaaauaguaguugaauaauaaaauacaggccucuguggaaaggaaggagaaaguuguaggcaaagggcccuuaggacugaggaggcaucaguaauuguugggcagcuggagccugaggaggaggauggacaggaggguggccuugauggcagaggaacuuggaaggauaguaaugaccuauauuuaauuguaaauucuuuccuguauguccuguuuuguaauuucucuucaagaaaccaaaguuuucauaaaaguguguuauauacagcagccaugagacagugaaacuuuggucccugaagggagagggacagcccaugaggugaagggagggcaauagugguaggagcuguggacaguggccagaagcgaggggacuucacaggaucaggcugcacaguaaacugacuuuggaauggacaugagacaaagccacaagggaaaugugacccagaaaggaagggagauauuuggguuuucuaagaaacgaagggaaaacucccccagauaggugccaacugggcccagagaucucuagaugggcugagauuguaaucgggagaggggcucggcuucuaggguuggaacucucuuuccuuucuaucccuuagacauaacaaguaacaucccacuucuaaggcagcuuccucucagccugauccaguguuugaugggacuuccaaguccucucucugggguuccaugcuuuucccccugcagcuaugccccagaauaccuggaacguucuuggcuucagagaugccucuuagaguuucaggcuccugcagagaacuguaacugcccucuuugccugcaggagacaaggugccucgcagugccaaugacuugaaggcuugagucuuggaaucaucuaggcugagcugguuuauuuguggcaccucauuguagacccagcccagaguaucuugccuacuccccacaucucccucaccccccagacacacucacccagcuucacuuggagcggggaugguuuguaauucauggcuacugacucacccucccgggcgucacagucuccgucagagauggaggcggcggcuggguccuguggggagaaagcaguaagacagagaguuguuagggagugaagacagggggcugcucucaguccugaagcuagccuucccaccugcccucugggcuucugugagcauucaccccucagagcaggcagggcauucagggagagaggggcagacccaucuaccgugggacaaaaacacugggcuagguagaagaaccaaggaucuggguuccauguacacccaacuuggugucuguccucaaaguccugugugguccagccuccuccagaaagcccaucaugauuucuuuaaacucacaggacuuccuucuccuaacucccauacuaguagcccuuccccucaggcccuuccuguguacuugcuuggcaaggucuuccuagguuccugugaguuuaagucuggguuaaggggagagcaggugcugucugagaugggucuucucccucuguuucccugugcuggacaggucccuucacaggauccagagaacugacugaccaagccacaccagccuucaaggcuacagccacuggacaaaaaaauaguucuaaugaggacuucuccaguucacaaaugacaccuaaagagugucuccggggagaaccugaaaaguuggcuagguacaguaggugagaagacaaauaaugacaaaccagcagguggccaguuagucuuuugcugcccagagugcaaaauacuugauucuacagauggucaggaagauaggaaagcacacauucuguguauuguccugagucuggaacuuuugacauccuccucacugcccucuucacuucacuaaucucuaauugggcuggg

SEQ ID NO: 13925 - RNA, 4419 nt, Homo sapiens
gcaagcaaguccuguaggcauccuggagcccaaggauucugcaguaggcagcuuucacagagguucuuccaguguaguggcucuagcucugggugaaguaggaucaucaaugucggcccccaggguucacagcuguucugagccccgcccccagguggcagggcagcccagucagucagucacgugcuggcggcuggccaaucaucgggggcggcgcggggaggggugguguggacggagaaagugaaaggugaggcacggcccugcagauuuuccagcggaucccccgguggccucaugucgcgcaguggaaccgauccucagcaacgccagcaggcgucagaggcggacgccgcagcagcaaccuuccgggcaaacgguaacugcaccgcggcagggacucgcuggggcgcggagccgagcccuccccuuccuuaggaagcuuucguccccuccgaagguuggaacgcucaucccgagccagaccgacaaggcguacagucugcaggccuguacgagcagcaggccaauuggcgcugggaaaguccaauccugggccucuagcuccugagcgggacagggccgagagggcgcucccgagcuugggccugcuggugggugagacccaggagagagggagcuagagagcucugaggacugaucuugacugucugcccccagaccaucagcauauccgcuacaacccgcugcaggaugagugggugcuggugucagcucaccgcaugaagcggcccuggcagggucaaguggagccccagcuucugaagacagugccccgccaugacccucucaacccucuguguccuggggccauccgagccaacggagagguaagccuguagagcccugcaucugcaggcugggccacggggaguaguucccucuuagaacuguccuccacccacagggauagugaaccuccuucugggucauaucccaccaagcuuuuugguccccuagggugggccuucccuacucccuuguagccuguccagucuuugaagcccaccagguaacuggugguauggggcagugagugcuucuagccuauccuugucgguaggugaauccccaguacgauagcaccuuccuguuugacaacgacuucccagcucugcagccugaugcccccaguccagguaaccuggcuccaacugcugcuggggaggaggguggcuagaccucuugagggacuucugcugcagagagugauacuccuuuaccucaggacccagugaucauccccuuuuccaagcaaagucugcucgaggagucugguaacuauggauuuccccucuuacaacuuucaaaccagaguuggagacucagcauugggguucggcccugcccguagcacagccaagcccuaccucucgguuaucuuuucucccgucaccacccaguaaggucaugugcuuccaccccuggucggauguaacgcugccacucaugucggucccugagauccgggcuguuguugaugcaugggccucagucacagaggagcugggugcccaguacccuugggugcagguuugugaggucgccccuuccccuggaugggcagggagggggugaugaagcuuugguucuggggaguaacauuucuguuuccacaggguguggucaggagggaguugacuuggugucuuuuggcuaacagagcuccguaucccuaucugauagaucuuugaaaacaaaggugccaugaugggcuguucuaacccccacccccacugccagguaagggugucaggggcuccaguggguuucuuggcugagucugagccagcacuguggacaugggaacaggauuaauggaugggacagaggaaauaugccaaugauguggaggcuuggagguaaaggaccugccuguucuucucugcuuuugccccuugacagguaugggccagcaguuuccugccagauauugcccagcgugaggagcgaucucagcaggccuauaagagucagcauggagagccccugcuaauggaguacagccgccaggagcuacucaggaaggugggagagagccaagcccuguguccccaaggagucccuaacuuucuuaucccaugagagagguguguaaaggagaaagcuagaggugaacuaguagagagagacuugcuaggaggccuuagcaauaauccaguaaucuaaaggaaagaugauggugacuuagacucgggugguuagugguagagguggugagaagacaucagauccugggcacauucuuuucuucugcuucccuugccuauuugcugaccacacuccggcuccuaugucaccuugaugacuuccuauccauucugucuuccuaggaacgucugguccuaaccagugagcacugguuaguacugguccccuucugggcaacauggcccuaccagacacugcugcugccccgucggcaugugcggcggcuaccugagcugaccccugcugagcgugauggucagucucccaaguaggauccuggggcuaggcacuggauggagguugcucccaguagggucagcaucuggaccccaggcugagagucaggcucugauuccagaucuagccuccaucaugaagaagcucuugaccaaguaugacaaccucuuugagacguccuuucccuacuccaugggcuggcauggugaggcuuuucaaguaccuauauuuagccccaacaccauuucugggcuccuggggcucagccuagugaacugcaaccucaaaggagcaagccuugaaacaguugcugggggaaguggccagaguagagaugcugggacugaggguggagcagcaaacuuggugaaacuacaucuccaaugugcuuucuaaucuccugccagcucuucucaagcaggggauccugggagauguaguuuucagauaccugguuggguuugggaguaggugcuaaccuggauaacuguaaaagggcucucucuccccacugucucucuucuuucugucaggggcucccacaggaucagaggcuggggccaacuggaaccauuggcagcugcacgcucauuacuacccuccgcuccugcgcucugccacuguccggaaauucaugguuggcuacgaaaugcuugcucaggcucagagggaccucaccccugagcaggucaggacucagaacagucuggcgucuccagacucucacaugcaguaugugcaggcaccugauacuucuguugcccuugugcuccagucauugcacaaggcagaaaacagcucuggcaggaagggacugccaaaguuaggagcccuagggccuggaaggagaguaugguccucagaucccccuucucuccugcuuccuccagggaacccaacagucaugacccugauaguuucccauaacaaccugggcauuccuugggacucaggagcugcuaaacucuuucauccccugguggcuucagcaguccuuaucaccagccucacaaucccacaggcccacccccagugggccuguggcauucauauuucauauucauauuucaaaccacaauauccagcaaaaugucuccugagcacccagaacuccauaccaucggccgggugugguggcucaugccuuaaucccagcacuuugggaggucaagaugggaggauugcuugagcccagaaguucgagacuagccugggaaacauaggaagcccucgucucuacaaaaaaaauuuaaaaaguuagccagguaugguggcauauacuuguggucccagauacuugggaggcugagauaggaucacuugggcccaggaguuugaggcugcagugagccaucaucauggcaucauugcauuccagccugggcaacagagcaagaccucgucucaaaaaaaaaaaaaaaaugaaguccaugccaccauucuuggcagcccagcccuuauccuccuuaauugcucccugucccuuuuccaggcugcagagagacuaagggcacuuccugagguucauuaccaccuggggcagaaggacagggagacagcaaccaucgccugaccacgccgaccacagggccuugaauccuuuuuuguuuucaacagucuugcugaauuaagcagaaagggccuugaauccuggccuggaauuugggcagauauagcauuaauaaaacugugcaucucaaacuuuuaucacauacucuaauaucagaggagugugaaccuucagagaucuaggguuaaaagcuaaaggcauagcuccagcuacaacuuuucuuugucuacagauguguaaaaucuugaugcaaaaaucuaccccaaauuucugaacaaaauuaauauucaguauuauaucuagccuauagauucucuuacucuugguguaaugacagcauucccaguuuaggaaacuguuuuaaaaucuugugucuuggu

SEQ ID NO: 13926 - RNA, 10721 nt, Homo sapiens
uuguuuccaguccugcuguuccaggguggauaggccuucaggcggagacccaggaauccagcuccagacucugucccaagcagccucuucaguccgggacgggacaggaaguguccggcggagguggggguggaggugauuggcaguuggagucuccaaugggccaggagccccccuauuucacuccucuccuuccauuggcgccugggcggagccacccccgcugcgggggcccagggcgggagggaguagaggccggggcagagggcgagggcgagggcagagggcgcuggcggcagcggccgcggaaggugaggccugguguagacgccaaagucuugucaggagugggcggggcagggugauguaugaucugaaaggccgggagugacuaacgacugucaguguguaugugccugugaggcugugucugugugacaguaucauugugugcgauucugagugucacuuggugcagcugucagcuaaugugacugcgugugucagugugcauggagcuggaggugcauguggcugugcaagugugggauuauguguguaucugucaaugcacauuuuuggugggacuggguuguguguuugugugagagggacugugaccacaugagggaauguguuuugggaaggucucugugggguuugagaccaugucugccagcgugagaguggguggcuggcuuugugugugccaaugugugacuucagcaguagcagagcaaaagugagguuugugacuauguguguguccuggguccuaacuuaaaccgugugggaguacagcuguauucauguauugggggaccuaccucaagagcccaugggacugaccuuucucuuaaguguccagcauugacagacacacccacaacacacguggcuuccccuccuuccucugcucaagaauccccagcaucaggucuacugcuccuuauuuucuguuucccugcuuggcucaguuucccuuacgugccguuuucugucccuauugcugucuuacuagagauaccucuguguguuucuucacagcuuuguuccccuggucucucugugugggugcauuuccaguuuugccuuuccuuucucucugucucucucugugccccuaugccugccuucccugcugaucuugaucucuggcuaguugggggccuguaacagugaugagaugcgggucugccccggcuaagagcucccugagagagggggcuuagaccaugaugaagaguugcuuuuaggcggugcugugagcccugguaggggcugugugcgugugugacugcgugaguguaugaauauguguaagugugucugagucugaggcgguguggcugugcccgugugacugugagugaccgcaugugagaguguaugagucugaggguaacugugggucuuguguaucuggcaccaagggaccaaaggcauuuccuggugcuggggcccaaagaauggagggggaggugagaaauggcuggaacuuccaggggagggggaacuggacucuuuggccucuccuuauaucccccaaccuggggccucccuuccccuggaagcacagccagcuguacccuaaggaaacauuuggugaggagugaaaagagggggaguuuguaucugauuuuucauuugauuguguccacguguguucaaaggcaugcccuuuuguuaacugugccucuugagucugugugugaaugugacugugucuggcugugugaaaacacagggcaucucucacugacagggacauaaguauuagccacccuccuuucccucuugcuggccuuggcugugucuguggcuuccuuuccagacuugggggaggccucuucccuucccagggccuugggugggagggaaggagggaggaggcaggagcagggagggggccuggcuaggggcggcagagcuccagggcuuagagggggcggggcagggaaggggaaggaggggauggcucuggggucccagaacugaguggaguaggagacgggggcuguagcuggugagaggaaguccuagaggcuauggacacucugcugcugggaucaccgagguaggguggggcuaagcaggguaaguguggcuggguggccaggggugagccaacuggacacacucagacagacacacagacagguggaggcccugcucugcucuacuccuacuccugaaggguccgugcucuuccucuucuggucuuguucccagagcccuuuccccgccugccccuucguucuccauccacuucaccacugccuuccuccuucugcucccccuuguccagaaucucucucuccuagcaucccccaccugccauauagacacacuguuagcuuuuugaguuuccgcugaccccaauccagucuuuccaacacuucccacacugccccaucaccuccuaguccugaucucugaguaucucuuggugcuguggcccccaugccugucccugcaggcucccaguuccucucagccucucauccccuucccuccccuccccuccccgccacccugucuccauuuccaucugcuggcuccucgcccacccccagccucuggcagcagccagggcaucuggaucugcuuaacuacacagccccagccugcacccuagccccauccagcuucacaaacuggagaccaacgaagugucaagagccaggcccagcugaguggcccaaguagccagaccaaggagccagguucaggcgagaagccuggcagccagggcaggggugggccucagggugggagugcaggaugggcucagauccaugaugacacccuucccccagggugauaaggucugccuagguuaaucagaggcagugauaagcccuggaccagguggggguaaauaccagaauucccaacagcuggacuggagggguuaaugggaguggcugagcuggugccagugcuuggugccaggggugggcgccaagggcaguggagggggaguugcuggcacagucuguugccuccggcuuuuguucugggcccuaagcccaggacugagauggagggugugaggggguguguguguccgugugugugugugugugugugugcgcgcgcacgcacaugcaaagcacuggguauacagugggaaaggggaccucaggucaguucccgcagugauuucuaacagccuuaccccacuuggugcaucaauuuuucuccuaggaagccucaguuuuggagaggaagagccaggcuuuagccucccaucucaggggucggggauuuuugacucuaccucuccccacagaugagcagcagcugcucagggcugagcaggguccugguggccguggcuacagcccuggugucugccuccucccccugcccccaggccuggggccccccaggugagaagaacccugcucuacaaccucccaacucugacuugugacuugccacccucacuguggccccuucccaugccuaacuugugacaccaccccugcuccugucauccaaccuggguccucucucuacccuguucucugaccucugucuccagauuauaacaugaugcuuugauccagugagccccccaccacccagguuuuaacagucugcuucuuaucugucauucucacaaaguggggagggggguaaaggaagagccuuaccucagaagugcccuccacagggguccaguaugggcagccaggcagguccgugaagcuguguuguccuggagugacugccggguaagugccccaccugccuguuggucugacacucaugacccuuucuugacucugccuaguccucaugucccgccccucccauccuugcccgcucuguccguaauccucaccucucuaucuguccuaaccgucuaacuauccuuauucaacagaaaauucaacugguauguuuugagcaucugccaagugccaggucuauucuaggcucugggauacagcagugcuaaugccaggcaaggugccugccuucaaagagcuuacaucuuaguggggaagacaauaagcaaaggagaaucuugccagauaguaauaccugcagggcagaaaaaccaaagugagggaugucgaagaggacaacugagugguuacuuuuuuuuuuuuuuuuuccgagagucucacucuguugcccaggcuggagugcaguggugcaaucugggcucacugcaaccucugccuccuggguucaagcaauucuccugccucagccucccaaguagcugggauuacagguaugcgccaccaggcccggcuaauuuuuuuuuguauuuuuaguagagacgggguuuuaccauguuggucaggcuuugaacuccugacuucaaguaauccacccaccucagccucccaaagugcuagauuacaggcgugagccaccgugccuggcccgugguuaccuuuuaauugguaguuaggaaaggucucucugaggagaugguguugaagcugauuucugaaggucaggaaggaggcagccaugcacacauuaagguauaagcgcucgugacagagggagcagcuagugcaaaauguccugaggugggaaugagcucaauacccccgaggaauagaaagaagaccaauguagcuggaguuuucagugggugagggggagagagauaggagcugaagaaggaaaggaaggcaagggcuggcucacaaggggcuuugaaagccaguaaaaggaauuuggguucuauugcaaaugcaguuagaagccaauggagagcuguggcauggucugacuuaugcuugacaucuugucuuuguccauugucaccucaucucacuuccagggacccaguguccugguuucgggauggggagccaaagcugcuccagggaccugacucugggcuagggcaugaacugguccuggcccaggcagacagcacugaugagggcaccuacaucugccagacccuggauggugcacuugggggcacagugacccugcagcugggcugugaguuggggaggguggcacugaugacacauagggauccugagggaguaugggaccuaaguaagcccucugggaccaggaggaccugaggacugcucagucuccagguguacccucugccucuagacccuccagcccgcccuguugucuccugccaagcagccgacuaugagaacuucucuugcacuuggagucccagccagaucagcgguuuacccacccgcuaccucaccuccuacaggugugugugugauuggguguggaugccuacacauuuggguaugcuggugcaaugugggugugggaggcagggagguagguucugaggaaagccucagagagggcagaaggcccucuuuuccuuccugacuucagauggcccccuccccaccaggaagaagacaguccuaggagcugauagccagagguaggacgugagggagcaugugggggcuccagcugggucccacaguaggcauuuucaaagccaaagaccacauccucccuucuaggaggaguccauccacagggcccuggccaugcccacaggauccccuaggggcugcccgcuguguuguccacggggcugaguucuggagccaguaccggauuaaugugacugaggugaacccacugggugccagcacacgccugcuggaugugagcuugcagagcaucugugaguacccaccccagaccucccccagacccccaucacagagaccccaaauggacucagaucucuccacucccagaguucccaguuuccucccaaccuagacuccauuucacacagagaaggcccuguggagccugagaaggcaaagggaucagagcccaggaggcaugguuauuucagcacacacucuagaggcugcugcugcuacccacacugccugauuggcugccuagccucagagcaggcccuguaccgaaugcagccauaugucauguccucccuugcuggccccuccuuccuugaccugugcaugggagugggacacuaaaacucuagcuggaauuugggccaauucaucuuccuuggaugaaaauaggaauugcucuuuuauucacucaagaagcacuucaaaaguccacccgcagaucucaggugguuucuuuuuuucuuucucuuccuuuuuuuguugagauagggucucacuuugugcccaggcuggaugaaguucaguggugugaucuuggcucacugaagccugcaacuccugggcucaagcuauccccucaccucagccucccaaguagcugggauuacaggcaugugccaccaugucugguuaauuuuuaaaauuuuuuguagagacaggguuuugcuacguugcccacgcuggucucaaacucguggcaucaagugauccucccgccucagucuuccagagugcugagauuacaggcaugagccaccacacgcggccucagcccauuucauaauacagaugaccggucugagucuaauggaugaucaaguuuaagauuuccccuccccucucaggagugucuggcuaaggcuccuuuaaacacacacuuugggaagugguggggaagugauggagacccauagccuacccugacuuugugucuugaugcccuuagugcgcccugacccaccccagggccugcggguagagucaguaccagguuacccccgacgccugcgagccagcuggacauacccugccuccuggccgugccagccccacuuccugcucaaguuccguuugcaguaccguccggcgcagcauccagccugguccacggugaggccuggagugcgucccaacccacggcuguggguccugucucugauuucacgauccuggguguucuguauagcuuuccagugcuggcaggucacugaagacccaacacuucccugugggccaggcuuuguacugggugcuggguugcaguggugacugagagacugaaugucuguccuguggggcuauaacuaugagguaaagcacaucugugggaagauagcaauggcuuuuaaaaaaauaacuuuuuuuuuuugagagggagucucgcucugucaccuaggcuggagugcaguggugcaaucucggcuaacugcaaccuccaccuccuggguucaagcaauucuucugucucagccucccgaguagcugggacuacaggugcccgccgccaugccuggcuaauuuuuguauuuuuaguagagaugggguuucaccauauugcccaggcuggucucgaacucaugaccucacgaucugcccaccucggccucccaaagugcugggauuacaggugugagccacggcgcccggccuaaaaauaacucuuaggaaaaggagugccuuucaccuagaggcacauucuccuacaaacacucauauacccagcugaggauagcagugaauuugugucucaggagauguuaaagauuggcugguaucaggacuagggagcagcagcaucagauaauaacuaauauuuacuuagugcugccugccugugggguaccuggcuacacuuuuugcauacauuguuuuguuuagguagauucaccucuauuuuacaaaugaagaaacugagucacagagaggcccaaagggucauucaauaugugguucaccaaagauuugaacccaggcugccugaugccacagccucucuaaguaaucacuacugccgucuuacaaacacuagguguagacucagcuccaccagacacccaacaugagaccuagacagcuccacuaggcuuuaggaugagacugggagcaaggggugcucuuuguagaugguggcugggaaggcccugcacuuacaagcuggguaacagugagucauguuuacccccagguggagccagcuggacuggaggaggugaucacagaugcuguggcugggcugccccaugcuguacgagucagugcccgggacuuucuagaugcuggcaccuggagcaccuggagcccggaggccuggggaacuccgagcacuggugagagacaaagccaaagaaaagggcagaggccccaucccaaagcaucuaucagcugaaccaguuccaaaagacaggcagguggcacaugcccugcccacacaggcacggcaauugcugucccagacuucagacuuguuugccuacagcccugucuuagcuuaaguccugccccuuggccuccaccccugcaguuacaggcuccacuucuacaagcuuggagcuugccaugcucccuaggagcuggccaugcccuaucaggcuccuccuccuagguaccuugacuuccaaccuaggccuuggccuugagcacaggacgugacccccguccccaccagcguauggacacuuauugggucuugccuuccuuuagggaccauaccaaaggagauaccagcauggggccagcuacacacgcagccagagguggagccucagguggacagcccugcuccuccaaggcccucccuccaaccacacccucggcuacuuggugagcuugggcagaugggcaagacuuguaaaggacugaaaaccccagagaaaaggggacaccgagcuuggucaggcuugcucucagugacauguggcccucccccucagaucacagggacucuguggagcagguagcugugcuggcgucuuugggaauccuuucuuuccugggacugguggcuggggcccuggcacuggggcucugguaagugacugccauuggucccucagccucugauccucacacaugcucugaugcccauagaccacauucaucuccacccuucaugacugcccgcugaaccugucugauucuggaacuaccuccccauaccuccaucccccaugccccacuugauuuuaacugauuccucuccugacccuuuacuaauaaacccuuuggcggagacugagauaacccacauuguuggagagacagcugccuuucuaugccccaggcugaggcugagacggggugggaaggauggauccccaaagccuggguucuuggccucagugauuccaguggacaggcguccaggugaguaggacauccagaagauuuggacuuggagauguuugccccuauuuugaguguccagauuaagagcuggcugcccuagucauuuuaaaacaugcugggaauccaaguugggucuccucauuuuaaugaugucuaggcugagggcugggccuuucauucuugagucccugggcucagaagugggucucuuucccuccucucaggguacugaggaaggaccccagguggacuucccuucaggguauuaguauuaguacuaauacucuuccaggguauuagacucagagcuggauauucauccuuuuuuuucaaggugucuuggaucagugcuagguccccuccuucauucuuaaugugccugggcccagagcuagguccacucccguaucuucaguguguugaagaggcucccucagagcugggcuccucuacucaucuucagaguguuaagcuuagaacugagucaccucccucauucucagggugucugggccaagauccggucuuacugucucuccugauuugccuccugcuucuucuaggagcuccaaaccuguagaggacccaggagggcuucggcagauuccaccuauaauucugucuugcugguguggauagaaaccaggcaggacaguagaucccuaugguuggaucucagcuggaaguucuguuuggagcccauuucugugagacccuguauuucaaauuugcagcugaaaggugcuuguaccucugauuucaccccagaguuggaguucugcucaaggaacguguguaauguguacaucuguguccaugugugaccaugugucugugaggcagggaacauguauucucugcaugcauguauguaggugccuggggaguguguguggguccuuggcucuuggccuuuccccuugcagggguugugcaggugugaauaaagagaauaaggaaguucuuggagauuauacucagaaauuauuauccaaugcugcuuuauuauuuggcuauugggggcuucagcccauuuuccuuagcaucccaaaauucagcuugggcagagucccauggagcuuucucucuuggugcucaaaccacugugacaggcugggguucuggggguggaugcagaugcugcguugagccaggugaagccuggguagagaaagguccaaagcuaugaccauagcuuggggaugagauuagggucauccccaaugacccuaauuagggguuaggagcaaggaccagaugaaaaccugaguuggcaacagaauuagcaguuagggcugggguugggaucagcauuagggguugggacugaggucagagucagggguaucaggggugggagcucacacgaaagccuggaggugacaguccccgucagccuccugcaguuccaccuggaugaccuuccucaguagcuugucugagaguggcuuucgguagagcugaguacagcaggcagugcuggguggcaguaggaaugcuaggggcaacagggccauguguucagagggauccugaccaagaaccucucugccagacagcuggagguuagguuggauuuccugggucuuuucaacuucaucccauucacccagacccccagcuuucuauacccccaaguacucaccugcuguagggucugggcucaggagcaaugacagcagcaggaggcugcagaagguugggggccccuucauguugcucagc

SEQ ID NO: 13927 - RNA, 4841 nt, Homo sapiens
ccccuccuucauucuuaaugugccugggcccagagcuagguccacucccguaucuucaguguguugaagaggcucccucagagcugggcuccucuacucaucuucagaguguuaagcuuagaacugagucaccucccucauucucagggugucugggccaagauccggucuuacugucucuccugauuugccuccugcuucuucuaggagcuccaaaccuguagaggacccaggagggcuucggcagauuccaccuauaauucugucuugcugguguggauagaaaccaggcaggacaguagaucccuaugguuggaucucagcuggaaguucuguuuggagcccauuucugugagacccuguauuucaaauuugcagcugaaaggugcuuguaccucugauuucaccccagaguuggaguucugcucaaggaacguguguaauguguacaucuguguccaugugugaccaugugucugugaggcagggaacauguauucucugcaugcauguauguaggugccuggggaguguguguggguccuuggcucuuggccuuuccccuugcagggguugugcaggugugaauaaagagaauaaggaaguucuuggagauuauacucagaaauuauuauccaaugcugcuuuauuauuuggcuauugggggcuucagcccauuuuccuuagcaucccaaaauucagcuugggcagagucccauggagcuuucucucuuggugcucaaaccacugugacaggcugggguucuggggguggaugcagaugcugcguugagccaggugaagccuggguagagaaagguccaaagcuaugaccauagcuuggggaugagauuagggucauccccaaugacccuaauuagggguuaggagcaaggaccagaugaaaaccugaguuggcaacagaauuagcaguuagggcugggguugggaucagcauuagggguugggacugaggucagagucagggguaucaggggugggagcucacacgaaagccuggaggugacaguccccgucagccuccugcaguuccaccuggaugaccuuccucaguagcuugucugagaguggcuuucgguagagcugaguacagcaggcagugcuggguggcaguaggaaugcuaggggcaacagggccauguguucagagggauccugaccaagaaccucucugccagacagcuggagguuagguuggauuuccugggucuuuucaacuucaucccauucacccagacccccagcuuucuauacccccaaguacucaccugcuguagggucugggcucaggagcaaugacagcagcaggaggcugcagaagguugggggccccuucauguugcucagccuagacucuuccuucucucucucuccuccuccccuaccuuuuaucugggugccuuuuaccuggggcacuaggugagucagaggcaguuggagauguacuguguaaccugugacacuccugggcccuaauucucggccuguugccacagacuccuuccucaucuaggauagccauuucccaugugcuccuaagcucugggcagugaagcugggggaaggauuagugugugauguagggacugauggaacagugaguaagggcagucaagcauccacagcagcaucuaaugauagacauucacacucaaauacgcauagccacacauucaaagucacuccucaaucacuuggucaaccucacaaagucauacucaugaucagacaaccguagacaaaauuauauagccccgguuauacucaaagucccucucccacccaauuguguuuucacagucauccaaucacaagcaaauucacacuagcacacacagauucugacaggggaguuguggguggggugggagcagagggcaggcaagcaccaacuugccuucaccuucuccuccccacuuccuggcuuggccugccugucuuaucagaagaaauggaugggaaugggucccuagagcaggcccuucuggcugaggaggguucuuggcugaggccagccccauucagagaagcugggggaaggcccuuuaugguaauauuaaggguguuuuggagaugcugagguggggcagcuuuccccaggaugaugagacagggaggaaaggugggguagauaaggagggaagauaaaagcucuuuggugcuagguuacuguugucaaaacagguaaaaggcccagugaaucuuaccuuccuguuuuugucuaguccuguuccaggaaugccaaccucuugccagcaggggccuagggucuccagauccagucccugacuuguugaagacauuggacucaagcacucaauuacaucuuuguuuuacucaaauuccagccuccuuccugggccuggaggaacauccccucucccuacccggguucagucacacccucauguccaacugcuauacccccugcaucccacccuccagcuauagccgcuucucuccuaaucccauacccagcugucacuccguucuuuacccccucccugcaaugcaaagcuccuauucaucuuuauccaguccuuuccaggaagcugggagcugccuaggguggggguaugcugccaaguucagugccccuggcuccuuuaagaauuucccacuccugguccagggaucucaaucugcaaguccugcucuauauuugaaacauaaaccaagucauaacacaguaauccagcccuuaucuuguugcagucgucugcuguagggucagccacucucuauggaguaggcuuucucuugggauagggcuuaggccuuucucuugugucccaaggcuuguuggguguagccacugaggaaaucccaaggaaaucucccagguuccucgggcuugucauagaccuucuucaucacuuggcugugcgcuacauacuuucuggucuucccugggcuugucgguccagaagucuucggaaggcagaaaacaaaugcuuuugggugugcacccaucucuccccuuuaagaccaagucuucuccccagccacaaucugcuguagcuuuggccccagccagaaacugggccaucucuuucuuuaacuuaaucuuguggugcccuuucuggugcuggguccagucccuaacugaaggcaggcccacauagcagucccugauucucaccacuugaggaguuagugggucccaggcugauugggugacagaagggggcggcaaagagcaguggcccuuggacucuccuagggagggagcaagaacuucuagguaggcugaugccaaggaucucuaaacuugggaucagacuggaggagccaaaaguugggguaugaacuguaggaaaggucgccaacccaagucgcuccucuguggcaggcagcuucuaggaaucucccccucuuaccauuuacagccugcauccuacaccucugcuuaaaauguuuuagauauacucccagcagagaagauucuucagacagcuggcaaaguccucgcuccgaggaagggaguaacaggcaggauuauuuaguucucuucauauaggcgacucacaguauggguuuuuggggguugggauugggggagacagccauugauaguaacaggaggccugacacugaugaggggcuuugacguggaagggcacccuuccagggagggacgcccugucaguacggaacagagcccguguggggaggggcgcucggcucgaauggcgacagcggcggcagagucaggaggucaguacggugggcuucgguuuaaaucuuuaaugcacuggcuggcugggcagcggcgguggggcugcggcgggggaagccacgacccgagcgcuggggaguaggacccaggccgcuggacagacagcucaucaggccucgcagaggcuccagcuucugcuccccggggugcgccgagcuguggggcgacccgacacuggcaugaggcggggcgggagcuaccggauuccccccgauggguccucagagacugagucccguccaugcccggggcggguccgcgguaucgcagccuccucaccuccgcucccuccgccacaugcgaagccaggggaaaaaguagaaacagccccaguagauccugcagagagagggcagagccgggcggggcggggcggggcggggaggagcugacccuacagacuccgccccgcggugccucgccgucgaggaaggcuccgccccgccucuaaaagcggcucccuucgcgcccacgccccugggaggcucgcccugcccaccccucgcccccgcagaacuccacccucccccaccccggagccgccugguuccuccuccgcagaacccgccuccacucacuccuccuccgccuccagcgccaccucguaucuccucauucccgacauguccugggcuccgaacgucuccuggggagcggcaugauugaaucagggauucccuagccccagguccccuucuccgucauucucaggacgaggcugcccaguucucagguaaucugaggcugaugcccccgagaagccucaguugccaccacgggacagggugggcuuggagauuugggaggcacuggaaguuaaggggugaggaggccggucaucuccggggccuggggcauuuagggggccagggcgagagguuuggcggucauggggcugggagauuuggggcccugggugaggauuuucaggggcuggggucaccuggagggggggcugagaggggucagcgcagccuaaacucccgcccucccuggcuccaccccggaaacggaccguuacuauuacgucacagggaugccguugcgcacuagguuugccugucccccggaaggggugggg

SEQ ID NO: 13928 - RNA, 9950 nt, Homo sapiens
ugggggcgggcucccggucccgcuaucggcggccggcgggcaggcgacuccugucccggguggaggcggcggagccggagccgggggagggggcagcggcugucucacggaccacggcggcgcccgcagcuccucaccggugagggcgccaagccaggacucgggggucccgggagcggggcgucgugaagccagggcuccugguguugggggguugggacacugagggcccguaggcucugcugccuuggggaugcggggccccggggucugcagggugcucggaguccuagaccagggcuuggcugucacagggggcagccagcgucugagucggggaggggaggggaggggagggucgagucggaccggaccagauuggguucuguggggcggaggcaucugugagcagaccagccagccagcgcgggugacaucaccgaccacccucccccgcccgagcccccuccccuccucuccucgccgcgccuuuugucccggccgagcuccgcucugccccgcccaucugcgagggaggagacucccgucagugacuucauugaguagguucuuggggauuggggucggguccuccccagugagaggcgacaggagcucacugccucucgggcccucacaaucacaccugucacagguauacacgcugccacucacaaacacacgcuugcacucccagccucacugacacgcugccauacagccgcucacagccagccagacacugcugcaccugagagcagguggccgcgggucuucucccuucacucuccacauuuggggaucagguccggcaccugcugcgccagacaggccuugcugggcacgcgccucugagaguccaaggagguggcuuccagagcugcagcacuucaggccggcuccgguggagcgaucagaggugaggggcuuggcugggcauguuuaagcgcacagugcucuccugcccacccccagcagcacccccacugcaggcccgaggagcuuuccggagcuucccacacuccuggggagaagacuucuuagccagcuugauguuuaaaauucagcuggagcccuuaaaacuucgagcguggacgcugaauggguuuguaaaguuucgguaagucccuccggagaagggcacucacacccauacccagucaaacccuccacgcggccauccccuccauugccuuccugcuuccuccaacucauccucauccccucugugacauacaggaaccccccuccggccucacccacauauuugaaugaauugcaccccuuaucauuccuuuucucaaacccuucagguauccauuuuccacagacauuuccuccauuauuucaacucuccacauuccucccuuucaacccaucauuaacccauuuuccaccucagccauuuccaucugucacucaucccccuccaucaguaccucauuuucuguaucagccaucuccccucccuguaccucaacagucccccucgccauuuucuccccauuuuuccuuccugccucuaccuuaacauccuccucauucuucuccaucaaaggcagugccaugccauggggcuccuuugucauuccaacacguggccuguggguaggggggaagggaaggagggaggaaagcagaaagagaaaaaggaggcagauccugaaagagcuugcccugugucugcggaggcaagagauguaugggccuagagcagcuagcagguggguaccagggaggaagcuggccggguguggagguaaugcagggacaccaaaaggaggugggugguuggugagccguuccacuggcccucugccuggaagcugcucucguucucuaggggcacccucuuggugugcuaggguucuuucccagucccaggggaaagaagguguggguugaggcagaaauggcagaccacccccccccgcucccucucagacggcuuuugcugccauuuccgaaaacgguugcccccccccccaacgaggugcucuuucuucucugccucucccaaccccaccccccaccccaucucccccacagacgugacaugcugguggggggcaaugggggaguacccgccuuuguggagccuuuucuucgucagagaaaggugacucccagaaccaugagucaacccagccaccugcagcagggccugugggggcagcagugagggccauugucccugcccaccuagggccuugggcgccucccccuuacccgguuacaggccucacuccuggaaggacacccuguacaccucccugcugugaagcagucagaggcagaaaggcaggucucagcuguggcugccagccuaggacauugcuagaaagacucugguucuccuggcuuuggcagggguuggccaagucucagaagggcugagaauggcuucuggccaucccccagagagcucuagcuacaggaaagucccccuuccccugauauccaccacagacacaccgauagagggagacuggaauggaagaauucggguuguacguuucucuuauaacaaaugcuccugcacccaccuuaaaagggacucagaggaauaugggucugaugaugggccggauccuaaaccacaggguggacugggggcguagggugaggcuaggagagguauuaaggaaauggugguugguuagugcccaauugucuccuaacagcugggguugaaaaaguccuguccccaggaugcuuuuguucacucacacuggugcuuaggcggcacagcccucacaguuuuguguguagacgcuggcaaaugaguaaagggaacuguugcccugguugggggaaggauagugucgcccccccugcuaaugagggaguuggaaacagcaguuuccaaaggcugugagucacccugugaucugagucacacgugaggcuuagcaucgucagaggggugggggcggggaggccuggggucuccgauggcagacaggacuccagacacccauucccugacucagucuggcuggccaggacagcuggcggaagacccaggccuguucccgguccugggccacugccccagcugcccucagccugggcaccaugccugaggcguggcguaggagaccacgaugcucaggugaccucacccguuacacugaccuucgccagcuccugugugugggucgcucaguccauggugccaccucgcucagcagggccucucagggguccucagucuggcccaaggaccagggccucagccuagccccaagagugggccacaaccuucagcuuccugcugggaaaacccaggaggugaggacggaaucacagaauucuagaaugucagagccagaagagaucaucuaguccaaaccuuucauuuuacagauggggggacgcaggcccacagaacaggcaugaccugcugaagguuacccagggagucauuuagggauugcaagaucaucaggaacagggcuggggcagaagagaaggcaucaagucuuggcccuggguuucuuucagaaacaaggagaccagugcugguccaguggcugugaugggaaaagauuauuacaagauucuugggaucccaucgggggccaacgaggaugagaucaagaaagccuaccggaagauggccuugaaguaccacccagacaagaauaaagaacccaacgcugaggagaaguuuaaggagauugcagaggccuaugaugugcuaagugaccccaagaaacggggccuguaugaccaguauggggaggaagguaagagggcagcacuccagcccaaucccggaccccuccgcuugguaggggucccaggugcaccaguuuguguagcggggaacuggaggcuguggagggggugagggcagcaaggguuuccagcacugucacccagagaagagagaagcccacccacuacccagcucagcucacccuaguucuccccgccucucucugcccccucccuccucggguucaggccuuagagaggucugaagcaagagccagaggccuuccccgcccuucuuuccuucccagccuuauuaguccugccugaagucuccgcugcuucauuggcugaugaggaagguuggggagagggaguguguggcucucugaggacagagcauuuacauucaucagcauaaaagucuggcccuuaagcagccugggaauuaacuaccagagcucugagcagaaaugguuuuccccuucucucccccggcccugccugcuucuggccagcagaacagagguggagcuuugccucccagaggaaguggcagggauccaaggguggacggggaacugcugcuggcaucuucccccuucccugggguagcugguggccauggggugggaggcaggaaaggcccaaauaaagccucugagagggaggccccucccagcacaucccacggccaugauguagcugcuaauucugggccugccccucagggcugccugccacccgccagccacaggcaccugucaggcuauauuaagagacauugucacgcugaggacucuccuuccugggaagaacuguccuuccuccccaacagaauccaccuuucuuucacauucuccuccucuucacccuccccuuucuauccucaaaacuaaaugggcuaaucauauguagauaagaagguuauuuucuuccccuccuccuggccuuguguuccaugccccucugugaacccucauccucccaacucccuuuuccuauucuccaugcugccgguuccuuccauucuuccugccuaccuccuagacgugccaacucccagauucaccagauaccggcuggaacccccaguauucuuucagcuaagacauuuuucucucuggcauggagggaugggagggauaggaguggaaaagagggaagcagugcagacaccaugccaccaugugaccugucuuggaauugcacccauuccuccauucagccucaccuuuguuuagaaagaaggcaggagcugggagagcucccuugagauacuucaccccuucugccuaagugaagggguccagacaccagguucugaugcagaaccccaucccaggaaggccccugaggaugcggcauggccuuaaggggaccuccauggccuggggagggagaagcagcuuagaaauguugguuauauuucuguccacccugcccaauccccagcagccauuuauuauagagcaguuauacacacagacucugugugcagcuccagcuagggacaaguugcucccagcuugaaaagggggugguaguggaagaauagaaaucccuauagagagaauuaccccuucccaucaucaucaguccagccucccucccucucucacugagcucugccaggcugcuugaacucgcuugauaaucagccccucgauagaaggaaaggagagauccuaggucuugggggaggggugaagaggcagcugccacaagucccugaaccgucugccacuuggccucucuagugaaacucaaaucugcccuuguggucccaggaaauaagaggcuaauuuaggcucagaucuccaugaucaguugaaauucuagauaaauggccucaaagagaagggucucuuuccuagccuggaccccacccauagucucuguauuccggagcaguucucagugugaaccgucuccccacaucccccacuacugccagcacccccuccugugcaugaaggcugccuccaggaaucugagccccuuagacaggaccugacagagagagcagcuaaggucaccacugccaugugccagcccauucaugcauuuugguugcucaacauuaggugugggguauggcguuugcuguuguauaacuccagggagcuccauucccauuguagucuaugucuguacaaugugugaaugacacucccuaaaguuguguaacaccgagcagagugugggaacaaagcauuuaaaaacuuuuucuagaaaaauagcucuucaucuccaagcuaaugagcuuucccacuuuuuaaggcuuccugauuucccguuugagcaggggccagggaaagaggaaacacugcuagaagcagagugaaaguggucuuccucccggguuggaucccuagccuauuugcgacuguucacuuaccagcccccucuguggucacauccugucugauggccccuuguccuauaugucuuuggagauaagcaaagauuugggaaccaaguaucacuuguaaugugacaccaggcuagucauucaaggcuuuuugagacaucuuuggaccaugaguauguggaaaagauuacaggacuggaagucacauccucuaaguccucuaguccuggcuuuuccaccuauuggguaagcaagccucuuugaaucucaaguugugcaucguuauuaaauauauaauuaggaauggaagauaaucuugccagaagccuuucuuacucuauuagccuggcccucucugugggauuuaaagguugcuucuuucuuuaagccugugaacugggagcuagagggcagggggaagacacugggauuggggccagaauaagccacacugccccuaacuucuccuccccucuaggccugaagaccggcgguggcacaucagguggcuccaguggcuccuuucacuacaccuuucauggggacccccaugccaccuuugccuccuucuuugguggcuccaaccccuucgauaucuucuuugccagcagccgcuccacucggcccuucaguggcuuugacccagaugacauggauguggaugaagaugaggacccauuuggcgcuuucggccguuuuggcuucaaugggcugaguagggguccaaggcgagccccagaaccacuguacccucggcgcaaggugcaggaccccccaguggugcacgagcugcgggugucccuggaggagaucuaccauggcuccaccaagcgcaugaagaucacaaggcgucgccucaacccugaugggcgaacugugcgcaccgaggacaagauccugcacauagucaucaagcguggcuggaaggaaggcaccaagaucaccuuccccaaagaaggcgacgccacaccugacaacaucccugcugacaucgucuuugugcucaaagacaagccccaugcacacuuccgccgagauggcaccaacgugcucuacagugcccugaucagccucaaggagguggggccuagucaggcugugugugugugcuggggagaugguggggacauucccucucuucccgccagcuggcacauucuuuccccaccucagucuauuuccuuccuucccacucaccuuaccccaccuuuuccucacuuucugcuucgucuuucccaggcgcuguguggcugcacugugaacauucccacuaucgacggccgagugaucccuuugcccugcaaugaugucaucaagccaggcaccgugaagagacuccguggggagggccuucccuuccccaaagugccaacucagcgaggagaccucauuguugaguucaaaguucgcuucccagacagauuaacaccacagacaagacagauccuuaagcagcaccuacccuguuccuaggcucugccccagccaguccagagccuaccacagcaauacccccaacacucacuccacucaaugugcacccagcuugauguccacuggacacuggcaacuuuuucuaaaaugcaaaaaaaagccacugguuuucaggaaaauguuccugucccugaccccuuuuagagcugggcugccuggggggagugggagggagguggggagagcuagcccaggccaggggucaauguucaugucacuagcuuucaauccaguuuccacugcaguggcuggagagugaccugagugcuacuugaagauauguagagauuccuuauccaugccuguacauagcauguccuccuccccucagcuuugcuaauaccaguccccucccuucccuuuggcuuccugcuguuggggguggaaaagacuagaaaggacauugcuuucucagccccacccccagguccacaguguccaagguaauggcacacauauucaugcacaagaagcacucaccuagagcugucugugccucucugggagaaaggagagaggauaagaagggaaaguucacaaccugugaacagggacuugagcacgagacacuuuucaucuggagcaggggggugagcuccucagcagccuccguaacagcugcccugccuacaccugcagagcuggagguucuguccucccugcugcucucaggaguguucaaggguggagggcagggaauggggccugagguauuaaggcuaagaggugggggacagggcccaucuaccagccuucaucaggaagggaaagggcuuuggggucagguggcagcuauuccccaccaagagauucagggucacagguuuuuccccacaccucugaacucagggccuagccacccccaaacuuccaaaucccacuuuugugauaugugaagcuacucauuucuuacccuuggaggcuguguggggaauuuccagcccuuuuaugccugugugaucccaccccacccccauaguuguauaaaggucauagugaagaagcugggggaagacugcuucagccagauccugggguggggucuuuagguuuucucacuuugacaacccccgaauguuuuuauaguaguuuuuuuguauuuuuuuguaaugacaguauuauguaaaaaauaaaguauuuuaaaaauauggcaucugagcaggagcaacaaaccugggauggggguggcugaggagggccacugucauccucccucccgggcucuggucaccuuugagaagcccaagcaggcccucaguauaagcugaagcugaccucugccuuccucgaagccuccugggauuucuaaaacuuauacuucaaacacagcacagacagaaaguaccacucagcuauuagaagaaacaucuauuugggaaggaaaaauaucccugcucaugagagacagagaccauugucuucagaugugcuagcaugaaaacagauuuucucuucuugucuaaauuuucucugagucagacaaauuuuccuucuaggagaaaauuuuuuucuaggaggggguggagaacuuuuuuuuuuuuuuuuuuuuuuugacacggagucuugcucugucgcccaggcuggagugcagugaugcgaucuugguucacugcagccucugucuccuagguucaagcgacucuccugccucagccuccgaguagcugggauuaccggcaugcaccaccacacccggcuaauuuuuguauuuuugguagagacaggguuucaccauguugcccaggcuggucucaaacucuugaccucaagugauccgccugccuuggccucccaaagugcugggauuacaaacaugagccacugcuccuggcgaggcugaaggacuuucuggcugacuagaagagcuacccccaaguguuugggcccggagugaggagaguagcacucuugugcaggauauugauuucacggaggauggugagcgagaaaccacuaucuggggggggauaucuguggugacgaggauuuauuugacuguaaugugcuauguacgaugaacgacugaauguacgaugaaaaguacuggucgauauuccugugggaagguauguucuuuggaaguauggaguugauguauuauaauuaagguuuuaugguucuggcuuauaagcauguucuaugaacaauagcugugaaaagugcuuucauaugugcuauguacaguuaaacacuuauaguacuauauaauauucaugguggcuagcaguaaaagacagagccuggacauuggagaggguagccagagguaccuggccuccuuggcccacgcuggugaggccuggcuauggacacaggcucccugagaagcacugaacacagcugcaaauccucaaaucucagu

SEQ ID NO: 13929 - RNA, 9950 nt, Homo sapiens
acugagauuugaggauuugcagcuguguucagugcuucucagggagccuguguccauagccaggccucaccagcgugggccaaggaggccagguaccucuggcuacccucuccaauguccaggcucugucuuuuacugcuagccaccaugaauauuauauaguacuauaaguguuuaacuguacauagcacauaugaaagcacuuuucacagcuauuguucauagaacaugcuuauaagccagaaccauaaaaccuuaauuauaauacaucaacuccauacuuccaaagaacauaccuucccacaggaauaucgaccaguacuuuucaucguacauucagucguucaucguacauagcacauuacagucaaauaaauccucgucaccacagauauccccccccagauagugguuucucgcucaccauccuccgugaaaucaauauccugcacaagagugcuacucuccucacuccgggcccaaacacuuggggguagcucuucuagucagccagaaaguccuucagccucgccaggagcaguggcucauguuuguaaucccagcacuuugggaggccaaggcaggcggaucacuugaggucaagaguuugagaccagccugggcaacauggugaaacccugucucuaccaaaaauacaaaaauuagccgggugugguggugcaugccgguaaucccagcuacucggaggcugaggcaggagagucgcuugaaccuaggagacagaggcugcagugaaccaagaucgcaucacugcacuccagccugggcgacagagcaagacuccgugucaaaaaaaaaaaaaaaaaaaaaaaguucuccacccccuccuagaaaaaaauuuucuccuagaaggaaaauuugucugacucagagaaaauuuagacaagaagagaaaaucuguuuucaugcuagcacaucugaagacaauggucucugucucucaugagcagggauauuuuuccuucccaaauagauguuucuucuaauagcugagugguacuuucugucugugcuguguuugaaguauaaguuuuagaaaucccaggaggcuucgaggaaggcagaggucagcuucagcuuauacugagggccugcuugggcuucucaaaggugaccagagcccgggagggaggaugacaguggcccuccucagccacccccaucccagguuuguugcuccugcucagaugccauauuuuuaaaauacuuuauuuuuuacauaauacugucauuacaaaaaaauacaaaaaaacuacuauaaaaacauucggggguugucaaagugagaaaaccuaaagaccccaccccaggaucuggcugaagcagucuucccccagcuucuucacuaugaccuuuauacaacuauggggguggggugggaucacacaggcauaaaagggcuggaaauuccccacacagccuccaaggguaagaaaugaguagcuucacauaucacaaaagugggauuuggaaguuuggggguggcuaggcccugaguucagagguguggggaaaaaccugugacccugaaucucuugguggggaauagcugccaccugaccccaaagcccuuucccuuccugaugaaggcugguagaugggcccugucccccaccucuuagccuuaauaccucaggccccauucccugcccuccacccuugaacacuccugagagcagcagggaggacagaaccuccagcucugcagguguaggcagggcagcuguuacggaggcugcugaggagcucaccccccugcuccagaugaaaagugucucgugcucaagucccuguucacagguugugaacuuucccuucuuauccucucuccuuucucccagagaggcacagacagcucuaggugagugcuucuugugcaugaauaugugugccauuaccuuggacacuguggaccuggggguggggcugagaaagcaauguccuuucuagucuuuuccacccccaacagcaggaagccaaagggaagggaggggacugguauuagcaaagcugaggggaggaggacaugcuauguacaggcauggauaaggaaucucuacauaucuucaaguagcacucaggucacucuccagccacugcaguggaaacuggauugaaagcuagugacaugaacauugaccccuggccugggcuagcucuccccaccucccucccacuccccccaggcagcccagcucuaaaaggggucagggacaggaacauuuuccugaaaaccaguggcuuuuuuuugcauuuuagaaaaaguugccaguguccaguggacaucaagcugggugcacauugaguggagugaguguuggggguauugcugugguaggcucuggacuggcuggggcagagccuaggaacaggguaggugcugcuuaaggaucugucuugucugugguguuaaucugucugggaagcgaacuuugaacucaacaaugaggucuccucgcugaguuggcacuuuggggaagggaaggcccuccccacggagucucuucacggugccuggcuugaugacaucauugcagggcaaagggaucacucggccgucgauagugggaauguucacagugcagccacacagcgccugggaaagacgaagcagaaagugaggaaaaggugggguaaggugagugggaaggaaggaaauagacugagguggggaaagaaugugccagcuggcgggaagagagggaauguccccaccaucuccccagcacacacacacagccugacuaggccccaccuccuugaggcugaucagggcacuguagagcacguuggugccaucucggcggaagugugcauggggcuugucuuugagcacaaagacgaugucagcagggauguugucagguguggcgucgccuucuuuggggaaggugaucuuggugccuuccuuccagccacgcuugaugacuaugugcaggaucuuguccucggugcgcacaguucgcccaucaggguugaggcgacgccuugugaucuucaugcgcuugguggagccaugguagaucuccuccagggacacccgcagcucgugcaccacugggggguccugcaccuugcgccgaggguacagugguucuggggcucgccuuggaccccuacucagcccauugaagccaaaacggccgaaagcgccaaauggguccucaucuucauccacauccaugucaucugggucaaagccacugaagggccgaguggagcggcugcuggcaaagaagauaucgaagggguuggagccaccaaagaaggaggcaaagguggcauggggguccccaugaaagguguagugaaaggagccacuggagccaccugaugugccaccgccggucuucaggccuagaggggaggagaaguuaggggcaguguggcuuauucuggccccaaucccagugucuucccccugcccucuagcucccaguucacaggcuuaaagaaagaagcaaccuuuaaaucccacagagagggccaggcuaauagaguaagaaaggcuucuggcaagauuaucuuccauuccuaauuauauauuuaauaacgaugcacaacuugagauucaaagaggcuugcuuacccaauagguggaaaagccaggacuagaggacuuagaggaugugacuuccaguccuguaaucuuuuccacauacucaugguccaaagaugucucaaaaagccuugaaugacuagccuggugucacauuacaagugauacuugguucccaaaucuuugcuuaucuccaaagacauauaggacaaggggccaucagacaggaugugaccacagagggggcugguaagugaacagucgcaaauaggcuagggauccaacccgggaggaagaccacuuucacucugcuucuagcaguguuuccucuuucccuggccccugcucaaacgggaaaucaggaagccuuaaaaagugggaaagcucauuagcuuggagaugaagagcuauuuuucuagaaaaaguuuuuaaaugcuuuguucccacacucugcucgguguuacacaacuuuagggagugucauucacacauuguacagacauagacuacaaugggaauggagcucccuggaguuauacaacagcaaacgccauaccccacaccuaauguugagcaaccaaaaugcaugaaugggcuggcacauggcaguggugaccuuagcugcucucucugucagguccugucuaaggggcucagauuccuggaggcagccuucaugcacaggagggggugcuggcaguagugggggauguggggagacgguucacacugagaacugcuccggaauacagagacuaugggugggguccaggcuaggaaagagacccuucucuuugaggccauuuaucuagaauuucaacugaucauggagaucugagccuaaauuagccucuuauuuccugggaccacaagggcagauuugaguuucacuagagaggccaaguggcagacgguucagggacuuguggcagcugccucuucaccccucccccaagaccuaggaucucuccuuuccuucuaucgaggggcugauuaucaagcgaguucaagcagccuggcagagcucagugagagagggagggaggcuggacugaugaugaugggaagggguaauucucucuauagggauuucuauucuuccacuaccacccccuuuucaagcugggagcaacuugucccuagcuggagcugcacacagagucuguguguauaacugcucuauaauaaauggcugcuggggauugggcaggguggacagaaauauaaccaacauuucuaagcugcuucucccuccccaggccauggagguccccuuaaggccaugccgcauccucaggggccuuccugggaugggguucugcaucagaaccuggugucuggaccccuucacuuaggcagaaggggugaaguaucucaagggagcucucccagcuccugccuucuuucuaaacaaaggugaggcugaauggaggaaugggugcaauuccaagacaggucacaugguggcauggugucugcacugcuucccucuuuuccacuccuaucccucccaucccuccaugccagagagaaaaaugucuuagcugaaagaauacuggggguuccagccgguaucuggugaaucugggaguuggcacgucuaggagguaggcaggaagaauggaaggaaccggcagcauggagaauaggaaaagggaguugggaggaugaggguucacagaggggcauggaacacaaggccaggaggaggggaagaaaauaaccuucuuaucuacauaugauuagcccauuuaguuuugaggauagaaaggggagggugaagaggaggagaaugugaaagaaagguggauucuguuggggaggaaggacaguucuucccaggaaggagaguccucagcgugacaaugucucuuaauauagccugacaggugccuguggcuggcggguggcaggcagcccugaggggcaggcccagaauuagcagcuacaucauggccgugggaugugcugggaggggccucccucucagaggcuuuauuugggccuuuccugccucccaccccauggccaccagcuaccccagggaagggggaagaugccagcagcaguuccccguccacccuuggaucccugccacuuccucugggaggcaaagcuccaccucuguucugcuggccagaagcaggcagggccgggggagagaaggggaaaaccauuucugcucagagcucugguaguuaauucccaggcugcuuaagggccagacuuuuaugcugaugaauguaaaugcucuguccucagagagccacacacucccucuccccaaccuuccucaucagccaaugaagcagcggagacuucaggcaggacuaauaaggcugggaaggaaagaagggcggggaaggccucuggcucuugcuucagaccucucuaaggccugaacccgaggagggagggggcagagagaggcggggagaacuagggugagcugagcuggguagugggugggcuucucucuucucugggugacagugcuggaaacccuugcugcccucacccccuccacagccuccaguuccccgcuacacaaacuggugcaccugggaccccuaccaagcggagggguccgggauugggcuggagugcugcccucuuaccuuccuccccauacuggucauacaggccccguuucuuggggucacuuagcacaucauaggccucugcaaucuccuuaaacuucuccucagcguuggguucuuuauucuugucugggugguacuucaaggccaucuuccgguaggcuuucuugaucucauccucguuggcccccgaugggaucccaagaaucuuguaauaaucuuuucccaucacagccacuggaccagcacuggucuccuuguuucugaaagaaacccagggccaagacuugaugccuucucuucugccccagcccuguuccugaugaucuugcaaucccuaaaugacucccuggguaaccuucagcaggucaugccuguucugugggccugcguccccccaucuguaaaaugaaagguuuggacuagaugaucucuucuggcucugacauucuagaauucugugauuccguccucaccuccuggguuuucccagcaggaagcugaagguuguggcccacucuuggggcuaggcugaggcccugguccuugggccagacugaggaccccugagaggcccugcugagcgagguggcaccauggacugagcgacccacacacaggagcuggcgaaggucaguguaacgggugaggucaccugagcaucguggucuccuacgccacgccucaggcauggugcccaggcugagggcagcuggggcaguggcccaggaccgggaacaggccugggucuuccgccagcuguccuggccagccagacugagucagggaaugggugucuggaguccugucugccaucggagaccccaggccuccccgcccccaccccucugacgaugcuaagccucacgugugacucagaucacagggugacucacagccuuuggaaacugcuguuuccaacucccucauuagcagggggggcgacacuauccuucccccaaccagggcaacaguucccuuuacucauuugccagcgucuacacacaaaacugugagggcugugccgccuaagcaccagugugagugaacaaaagcauccuggggacaggacuuuuucaaccccagcuguuaggagacaauugggcacuaaccaaccaccauuuccuuaauaccucuccuagccucacccuacgcccccaguccacccugugguuuaggauccggcccaucaucagacccauauuccucugagucccuuuuaaggugggugcaggagcauuuguuauaagagaaacguacaacccgaauucuuccauuccagucucccucuaucggugugucugugguggauaucaggggaagggggacuuuccuguagcuagagcucucugggggauggccagaagccauucucagcccuucugagacuuggccaaccccugccaaagccaggagaaccagagucuuucuagcaauguccuaggcuggcagccacagcugagaccugccuuucugccucugacugcuucacagcagggagguguacaggguguccuuccaggagugaggccuguaaccggguaagggggaggcgcccaaggcccuaggugggcagggacaauggcccucacugcugcccccacaggcccugcugcagguggcuggguugacucaugguucugggagucaccuuucucugacgaagaaaaggcuccacaaaggcggguacucccccauugccccccaccagcaugucacgucugugggggagaugggguggggggugggguugggagaggcagagaagaaagagcaccucguugggggggggggcaaccguuuucggaaauggcagcaaaagccgucugagagggagcggggggggguggucugccauuucugccucaacccacaccuucuuuccccugggacugggaaagaacccuagcacaccaagagggugccccuagagaacgagagcagcuuccaggcagagggccaguggaacggcucaccaaccacccaccuccuuuuggugucccugcauuaccuccacacccggccagcuuccucccugguacccaccugcuagcugcucuaggcccauacaucucuugccuccgcagacacagggcaagcucuuucaggaucugccuccuuuuucucuuucugcuuuccucccuccuucccuuccccccuacccacaggccacguguuggaaugacaaaggagccccauggcauggcacugccuuugauggagaagaaugaggaggauguuaagguagaggcaggaaggaaaaauggggagaaaauggcgagggggacuguugagguacagggaggggagauggcugauacagaaaaugagguacugauggagggggaugagugacagauggaaauggcugagguggaaaauggguuaaugauggguugaaagggaggaauguggagaguugaaauaauggaggaaaugucuguggaaaauggauaccugaaggguuugagaaaaggaaugauaaggggugcaauucauucaaauaugugggugaggccggagggggguuccuguaugucacagaggggaugaggaugaguuggaggaagcaggaaggcaauggaggggauggccgcguggaggguuugacuggguaugggugugagugcccuucuccggagggacuuaccgaaacuuuacaaacccauucagcguccacgcucgaaguuuuaagggcuccagcugaauuuuaaacaucaagcuggcuaagaagucuucuccccaggagugugggaagcuccggaaagcuccucgggccugcagugggggugcugcugggggugggcaggagagcacugugcgcuuaaacaugcccagccaagccccucaccucugaucgcuccaccggagccggccugaagugcugcagcucuggaagccaccuccuuggacucucagaggcgcgugcccagcaaggccugucuggcgcagcaggugccggaccugauccccaaauguggagagugaagggagaagacccgcggccaccugcucucaggugcagcagugucuggcuggcugugagcggcuguauggcagcgugucagugaggcugggagugcaagcguguguuugugaguggcagcguguauaccugugacaggugugauugugagggcccgagaggcagugagcuccugucgccucucacuggggaggacccgaccccaauccccaagaaccuacucaaugaagucacugacgggagucuccucccucgcagaugggcggggcagagcggagcucggccgggacaaaaggcgcggcgaggagaggaggggagggggcucgggcgggggaggguggucggugaugucacccgcgcuggcuggcuggucugcucacagaugccuccgccccacagaacccaaucugguccgguccgacucgacccuccccuccccuccccuccccgacucagacgcuggcugcccccugugacagccaagcccuggucuaggacuccgagcacccugcagaccccggggccccgcauccccaaggcagcagagccuacgggcccucagugucccaaccccccaacaccaggagcccuggcuucacgacgccccgcucccgggacccccgaguccuggcuuggcgcccucaccggugaggagcugcgggcgccgccgugguccgugagacagccgcugcccccucccccggcuccggcuccgccgccuccacccgggacaggagucgccugcccgccggccgccgauagcgggaccgggagcccgccccca

SEQ ID NO: 13930 - RNA, 8488 nt, Homo sapiens
cccuguccccaauuuucaauuacuaaauaucccaucaaacuggggccagccccacgcuccuggccaaacuuccaccgaggugccggcagauggcgauggagccaccgacgggccacucugucuggcgcacgcaucucugugcugccaggucgcaggcgccgccgccgccgcacuuccgggugccauugcaggugagccagggucucccgagaaccucaccccccgguauuccccucacccugaaguaagggagucucccucuuccccucagcuccuaaccaaggugcucaguaccgcggcuagggugcccagcgggaggcuggguaguuaccggaggaggcagagccggucgcacgccugggucccagcggaggcccagucgacucucgacccgggccccagccuccuugcguggcgaaggucgugccucaggucuccuggcgaaccuggccgcccggaagcggagagugacuccuccccuucguccccucggugcccgccaggcggcgccgucggcugggcccggauuccccugcggcuucgaucccuuuccacuggguauugagauuggcgaggggagaggcgcagaaacggcguguaagagagccugacuaccaauuggaauaaguuucccuccugacuguucacauguacaggcagcauuagcauuuccugccuguacaugugaacguuccuaugcucuaccccucgaagauccugauucaguagaucuggggugggaccucaugaaacggcgucucccucuguuguccagacucuagugcagugguucaaucucggcucacugcaaccuccgccuccccgauucaagcgauucuccugcgucagccuccccaguagcugagacuacaggugcccgccacccauuuuuguauuuuuaguagggacgggguuucgccauuuuggccaggcuggucucgaacuccucaccucaggugauccgcccgccucggccucccaaagugcugggauuacaggcgugagccaccaugcccagccuggaaauaggaggagaguaauauugcgagggguuggcugugaaaugguuuaucuccaggaagguuuccgggaggaagugauucuagcugggcuuguauucagggaccagaauauccacugguucuuugccccacaguaaugaauuuacuuccccaccccuaucaggaugcagaaagccucaguguugcucuuccuggccugggucugcuuccucuucuacgcuggcauugcccucuucaccaguggcuuccugcucacccguuuggagcucaccaaccauagcagcugccaagagcccccaggcccugggucccugccaugggggagccaagggaaaccuggggccugcuggauggcuucccgauuuucgcggguuguguuggugcugauagaugcucugcgauuugacuucgcccagccccagcauucacacgugccuagagagccuccugucucccuacccuuccugggcaaacuaagcuccuugcagaggauccuggagauucagccccaccaugcccggcucuaccgaucucagguugacccuccuaccaccaccaugcagcgccucaaggcccucaccacuggcucacugccuaccuuuauugaugcugguaguaacuucgccagccacgccauaguggaagacaaucucauuaagcagcucaccagugcaggucagugugggccacuuugaaggccagaaguaccuuggcaaauuucuucaaaauuugaagucagggagucagaccuuugggugcccagaugcacacuugauuaugguguagggggacagaggagaagaaagaggccagggcccugcugguagggagcucaguuugggggacagaggagaagaaagaggccagggcccugcugguagggagcucaguuugggagacagaggagaagggaucugggcuuuguuccuaugaagcuucuaaucugaauggaguguaaguuuuauucuuggagaccucucaguaaaagggagaagggaagaagagaagauguggaucuuggcuugcaaguguggagaagaaagcagagaaauacaggcccuguucauucacugacugggaagaagcaggauacacccaggaaaaacaacucaguagagauacccagagacagaacuaggagagcauuuuguaggaaggauaagugugaggucuggguggaguacgguuaucagggaaagcuuccugguggaaaauguuaggcccugaaggauaaggauugcuguauggaauugcuguacuuuagguugcaugguugggacuucugaugggucuuuaaagggccucuuuuccucuuuucuccuaacccugacguuugcucaggcucugacuucucuuucaugucccugcaggaaggcguguagucuucaugggagaugauaccuggaaagaccuuuucccuggugcuuucuccaaagcuuucuucuucccauccuucaaugucagagaccuagacacaguggacaauggcauccuggaacaccucuaccccaccagugagcauggggccagagcacuuaguucuaagacugggagcuggggagaacugcuuuaguccacaaauucugagccaccuauggguguaacagccugggcuuguaucccuggacauagaggagugucaaagccuggcugggguugaggagugggucuuagucuucugugcucaguguucuccccuucacaguggacaguggugaaugggacgugcugauugcucacuuccuggguguggaccacuguggccacaagcauggcccucaccacccugaaauggccaagaaacuuagccagauggaccaggugauccagugagugugggguauuggcugggggaguggguuugugucugagaaucucgaagaagcucuuaucuuagagcuucuuuccuggcugaauucugucuucucuaggccuucugcugaagcuagaggcuccauccaucuugauuaacucaauguguagcuuugggcaucaggaucauggccgaagacaugucucuuugccaaaggucuaggccuuacuaauggaguuauagcuggggaugaauaggccccuggagaaaaaucuuuuuucuuuuugagaaaaauauuuauccguuucuacuccugacacauuuauuggcccccaggggacuuguggagcgucuggagaaugacacacugcugguaguggcuggggaccaugggaugaccacaaauggagaccauggaggggacagugagcuggaggucucagcugcucucuuucuguauagccccacagcagucuuccccagcaccccaccagaggugaggccugggauguuccucaucuguucucccaguaaucagcccauguuaccauuacagcauccucaugaauaccucuauuuuaggcccccaaauccaugauccuggguauccuccacucucauuucuuaccuaggccccuaugucugccaucccaaacauugacuucagcuuugugaugaaucuguugaccacugucauuuuccuuuaggagccagaggugauuccucaaguuagccuugugcccacgcuggcccugcugcugggccugcccaucccauuugggaauaucggggaagugauggcugagcuauucucagggggugaggacucccagccccacuccucugcuuuagcccaagccucagcucuccaucucaaugcucagcagguagguaagcgggcuggguuuccaggugacagagcuagggugggcaugaaagaagcauaaugaaccacucuuuuguccuuugacuagucuuagucccaccuuccauaccuaucccucuuccguuaucccucccuuccccgauucuggacagaguuuggguccuugacuuccagguacccccuuuuguaauaccuauucuugccucugccccaauuuaugucucugaccuguuccccuuggccucugaccuuuucucugccaggugucccgauuucuucauaccuacucagcugcuacucaggaccuucaagcuaaggagcuucaucagcugcagaaccucuucuccaaggccucugcugacuaccaguggcuucuccagagccccaagggggcugaggcgacacugccgacugugauugcugagcugcagcaguuccugcggggagcucgggccaugugcaucgagucuugggcucguuucucucugguccgcauggcgggggguacugcucucuuggcugcuuccugcuuuaucugccugcuggcaucucagugggcaauauccccaggcuuuccauucugcccucuacuccugacaccuguggccuggggccugguuggggccauagcguaugcuggacuccugggaacuauugagcugaagcuagaucuagugcuucuaggggcuguggcugcagugagcucauuccucccuuuucuguggaaagccugggcuggcuggggguccaagaggccccuggcaacccuguuucccaucccugggcccguccuguuacuccugcuguuucgcuuggcuguguucuucucugauaguuuuguuguagcugaggccagggccacccccuuccuuuugggcucauucauccugcuccugguuguccagcuucacugggagggccagcugcuuccaccuaagcuacucacaaugccccgccuuggcacuucagccacaacaaaccccccacggcacaauggugcauaugcccugaggcuuggaauuggguugcuuuuauguacaaggcuagcugggcuuuuucaucguugcccugaagagacaccuguuugccacuccucucccuggcugaguccucuggcauccaugguggguggucgagccaagaauuugugguauggagcuuguguggcggcgcugguggcccuguuagcugccgugcgcuuguggcuucgccgcuaugguaaucucaagagccccgagccacccaugcucuuugugcgcuggggacugccccuaauggcauuggguacugcugccuacugggcauuggcgucgggggcagaugaggcucccccccgucuccggguccuggucucuggggcauccauggugcugccucgggcuguagcagggcuggcugcuucagggcucgcgcugcugcucuggaagccugugacagugcuggugaaggcuggggcaggcgcuccaaggaccaggacuguccucacucccuucucaggcccccccacuucucaagcugacuuggauuauguggucccucaaaucuaccgacacaugcaggaggaguuccggggccgguuagagaggaccaaaucucaggguccccugacuguggcugcuuaucaguuggggagugucuacucagcugcuauggucacagcccucacccuguuggccuucccacuucugcuguugcaugcggagcgcaucagccuuguguuccugcuucuguuucugcagagcuuccuucuccuacaucugcuugcugcugggauacccgucaccaccccugguaaauaucucagcucugauucacuuaaagacaauagugaugugaguucggccccucuuguuuucaaggagguguugcuccucauguuccugagcuugacagagggucccaugccccacacaacuaggaaggucuucuugguguccucucucuuaccugccauagccaagcaaauugaucccuccuguugguucccaggguucauggagaggagagacaaggaguccucuaagacucccuguggaaaugcugcauccucaugagcacauuucuugauuuuccagugauggaaguaguaaauugugaauauauaauggcacugagcuguauguguuugagagaaagaaagagauuggccauagcaggauucagauaagccugauggcgcuuuuguaccacagagagaauuagaauaacagaauguugacuguaaggagguugggcugauaggcauuugaguguguaugagaauugauacugaaguaguaggaguauaugauuguggagcaguagccuauggauuagggaauaagaagugacuguaacguggcauaucuuuucuuccagguccuuuuacugugccauggcaggcagucucggcuugggcccucauggccacacagaccuucuacuccacaggccaccagccugucuuuccagccauccauuggcaugcagccuucgugggauucccagagggucauggcuccuguacuuggcugccugcuuugcuagugggagccaacaccuuugccucccaccuccucuuugcagguacccccuccuccuucacuugcuuccauuguuuacucuggcuuuguggaaagaaaggaaaccccuggauuugaauggagagauauggguuuguuggaucuuuggcaccccuuggccuaggcuaauuggaaccugagccagccaggguggccuguugauuccagccauacccucucuugaggcaguagguugcccacugcuccugcucuggccuuuccugugugagagucaagggcugcggaagagacagcagcccccagggaaugaagcugaugccagagucagacccgaggaggaagaggagccacugauggagaugcggcuccgggaugcgccucagcacuucuaugcagcacugcugcagcugggccucaaguaccucuuuauccuugguauucagguggguguaggagagagaucagggaguugguguuuuuucucugugugugcaucacuuucuuucagaccuucaaaaccgugggagagagccuugacugaguuucacauaagugaagugguugcccaagcccaguggccucaaauggcaguucugagacuugaaccugggucuccuuaauccuaguccuggaucauuuccccucuacaaccuagaucuggaccccgcuaguugcauuugaggauuacucuaucaguggacagacuggaaaaacugaggugauagccaggauuuucuucccaaacuguggucauggauccucuuccuuuccuccagaggcagauguggcacugauaucuuccuccauccugggggcacagccugaguguuagcauugcagauggauacugacuugcccaaagucacauagugagucagugcuuggggcagggcaggaaguaggucuccuaacuccuagcccaggacaugcaauauuuuuuccacugacaugcacuauucuccugcuuccauuuuuuacaggggccuauagaaacucuccuuuugcuccgcuuccuccucuccuucacaaguaacguggccccuccucuccuccucuagauucuggccugugccuuggcagccuccauccuucgcaggcaucucauggucuggaaaguguuugccccuaagugaguagauuugcuugagaaguagaggugguggggagggagaaacuuggaacaaaguaugaagauccuaaacauccaggauggccaagguuuugccucuacagggaaaaggcaguagaccuacucuguugccugagauucuccgccuuucuuugcagguucauauuugaggcugugggcuucauugugagcagcgugggacuucuccugggcauagcuuuggugaugagaguggauggugcugugagcuccugguucaggcagcuauuucuggcccagcagagguagccuagucugugauuacuggcacuuggcuacagagagugcuugagaacaguguagccuggccuguacagguacuggaugaucugcaagacaggcucagccauacucuuacuaucaugcagccaggggccgcugacaucuaggacuucauuauucuauaauucaggaccacaguggaguaugaucccuaacuccugauuuggaugcaucugagggacaaggggggcggucuccgaaguggaauaaaauaggccgggcguggugacuugcaccuauaaucccagcacuuugggaggcagaggugggaggauugcuuggucccaggaguucaagaccagccuguggaacauaacaagaccccgucucuacuauuuaaaaaaaaguguaauaaaaugauaauauaauuaugugugucugagaugugggggagccccacuguucuauagggguugugaggaggaucagucucuccugccaccaggcacagaugagaucagucaucuuaggaaagccuggcugcaccugagaaccuuuaugaagugguuggaguugucugaauucacugccuccaccucuucccaaaucaauccuauuaucccaccgcuauuuuccuuugccaugcaacacauuuuguuaaguuccuguucuuugucugauaaagagagaagacugagaagacaagcccaggcaucaugcagcaccgacuuuaacugucugaagccccaaauagugcuaugcccccgcuccacugggccuuuucacuauagaacacccuuugcccuucccuucuguggaagccucccuuguuucccaaccugugccacucuuuau

SEQ ID NO: 13931 - RNA, 3649 nt, Homo sapiens
guuuuugaauaaaugaaugaggagcacccucagucccugaaaacccuuuaaguaugccagugcaggguaguaguuucucaugaaaguacuucuuucccacgaaaaaacccccaaacaccugccucaaacacacagccccacacuuagcaggaaggggacuucacuucccagccagcaguucagugaacauaugguuuaacacuuccacccuaucccacaguuucucuugaagacaaaaaugauaguuucacuuuacaagaaguucacucuuauucauggaggcaucaugcugacaggacuggauccaaggaaaaugcuagugacuuucccaacuucauuccccaaucaaagaggacaguuucugguuugccacuggugaguuuauuacacgacuaaaguucaaauaaaaaaauaaaaaccaaaaucuuggcagggaagcuagagccagaaucaggaaaaucugcuuccuuguucccagacucccuggccaagcccagcuccacuaacucaucuugacucgaucaaguuccucaucaagacuugcaucuguacccuggacaucucugcugcucccacuggagagugagucuggagucccuggcacuggggcuuuggugagggcuccauauacacccauggccugaggagaggaacagagagaauaccaugaggacacuugacagaggugcagcccagccuaccaauggcuaaacgggaaaagauggcaugggggccaguaaguugguuuuccuuucucccucucucaaaccugucuuguaagcucuggaguugauuuuaggaaucuugcaaaccaucagaguaaagugacucucagaauaccagcacaaguaucuaccaaaaaaagguaucucaagaacuuccauauuugcaggacugaguggagauguuucauucuuagauuccaucucuacaaagaaugaagggaggucuagggccaaggcacucugaagaccuuuaugguauguaaguguugaugacggugguggggucucaguuuggucccuggcaccagugcucuaugcuggguccucagagagcucuaaccugagccaccaugcuggugacaucgccaggguuggagggcaguaggauaguguuggaguccuuggccaguuuggagaacgcgcugacauacugcucggccacagucagugaagcugcugcaucuccauucugugaucacagggggauaaaaaucagagaucaccgauacggagaagaagggggggauggggaaugaagaaagcaguucacaauaaaaaggaccauguaaucuggcucaacagagcccacagaggcggaacucuccucaagcguagauaagagaaccccuuccacugucaauuccuguccccauucccacccaggggccucucacauguugugucagagcugcagccaggauucgaauagcuucagcuuuagccuuggccuucgccagaacugcacuggccucuccugcaagagaagggacagagcuugcuugacccaugaagucaaaguaccccaaagauccugccccagcaccaaucuucaaaggcccaugccuugcuccucccucagccucuacccucuccugaccugcugccugauuuaucuguucagccuuuucugcuucggaggccaggaucugggccuguuucuucccuucugccacauugauggccgacucucggguccccucagacucuagaacuguggcccguuuccgccgcucugccuccaccuggaagcccacaacaaucccaaucaacaagccaagggagacugauacagacaugcaacucuacccaucauaacaggagggaagucuggauccuccugguacuggagcacccugaggcccuuuucccaccccuccuuggcccccaccugcaucugcauagacucuuucacccgggguggcacauggauauccuugaucucauaacggaggcagcggauaccccagcagucagcagcuugguugauggcauccacaaugcuggcauucagggacucccguuccuggaaaaagagguguaagccccacagccucaaccuaccuaucaagggccuacacugagaagggccugggacugaucuugaccuucagaaaagauuaagagugucagguuugugucuucaaacccuaacucuggcucagaucugcuuacccggaagacuuuguccagagagaguuugccgagcucugaucucaugguuguuugagcuagcugggugacggcauacucaggguccuccacaccguagcuugccugagauggacacggauaguguaagaagcuugggcacaagauuuuagugaagagggcaacucaaaaggcuggauaaaguaggggacagguaccuuguaaggguccaugaugcgcagguaaaggacuccaucgauuugcagaguuacauugucuguagaaccaggagagaaaacggggaaagucaggccucuaggucccaaccaguucuuucuacuaagcucuggaucuacagcaaccacauccuaauagccucagagcacccaugucacccugaaccccucaccgagagucacagccgacugcucaggcacguugaugacaauuuccuugagacucugcacauaucggauccggucuaacacagggaugaggauguucaaacccuggaaagaggagucauggguccucagaaggcugggaacuauuggguugggaccuaagcuaguccuggaguauguagggagucaacacauggaacaugcccagaaaagcagcagcuccuaccaagaaauaaguccucagaaggcugaggugucacugguaagaaaacccaagagaacaggaaugcaagacuaggccccugaauggaggggagagucaugagaaucggagccagcagaauagccaucucuaugcagacugagagguagggcugagagugggcaggggagauucccaagaauggggccugugagaugcauaggaaaaggugguaacauggggaugauggucagcagccugggcccugucaggucuggccuacagagucgggagcuaacagugcgggcaggcccaaaggaaguccucccgacauugcaugucgugagggauuggucaucuggcuggcccagggugggcagaagagguuucucacaggcuccaggauccgguggaaucggcccauucgcuccaccacccaggccuccugcugcggcacgaacaguaccacgguguuucggggcaauccagaggaggcgcggcgcggagcgcggccagaagccaguagagagcccugaaggaaagaagagggugagcagagaucccaucuggccagacacgccgccccucgguccugaaggcaucuccauaaaccacgacccucaggauccucggagaaucacauggggaccaugaccucugaccccaguccucuccaaaaguuggaauuucgcucuuuuccagcggagaacccagguaaucucuguccugacccucuggaaagguugccucgcucucacccucagcaaaagggccccagugccccgcgccgcgcgcgccagcauuucccaccgccgcagcgaccuccggaaccaacgagacgagcggagcggucgcucccagaagccuacccgagccuuuccucuugcagu

SEQ ID NO: 13932 - RNA, 12686 nt, Homo sapiens
uggccggggugggaccucaggcgaccugcgaccaucacuuugucuccuccuuccuccuuuggggccgccaccgccaaucagagccagcggauccugguuggagugcgaccgcccgggugaggcgugagggagaaggggcggaaggaggaggggcucugagaugggagggggaucgugguggaagggucuuggcgcgacuucugccaggcuggaauccgagggggcggguccuggugaaaggcggagagaccgagaggaggcggggaucggggguggggccugggaaaagcugaggauccuggggaaaugcaaagaaaacgcgaaggaggugcgaggucagaagggggcggggcccgggcuacaggggaggagcucgagaaauuaaacgaggaaagggacaaguccacagaagguggaaggugggacaagggagagggugggcccgggcguugcgggggcggggcucagacugaaggggcgagguuugcaggcggaggcuacagcuagggcugcucaguaacugccccaaccacuaccacguccccaagugcaacgggacccacggaacuacagguguggggcagggugagcguggaagaagggacgcggaugggggugcgcuuugcagacgaucuggagacugcuguguguugagggaagauacgaagucgcgggagcaguuggggacucaaugugugggcaacaaggugcauucuccagaggccucuaugggggaagggcgggagcgcuuuguuguggggggguugcgagguacauugugagggggcugucucugucugaugugggggguuggaggagguacaugaggggcaggggacauggaggugcuuugaaggaaggggggcuguuuaauggagaaggaguguagcggugucggagggucugcgggcacuaucuaggggaagggguuguaggcccaacuugaggcaggagaacagaacccccaguacuuugacaaaguaacaguuuagggcauuguaguaacuacaggaagacacuuguguucuggguucuaagagcaaggguguugggguuaguggggugaagaggccaaucuauugcacuccugucugcucagcuuuuaacuccgccuucuggccugggcacucagagaggagucagacccugcuugucacuagggcuugugugaaugucuccucagucuauuuuggaucuguccagcugagacugggguuucuucccuaagcugaggucccgggggacccuucccccgcuggguuccugucaaccccccauccuaguuccuguuccucccagagccggccuuggucucugucuccccccucccccgcccugcccuuaugcucugggugugcucauuucccacuuccuuccuugccccagggccuggccuggcccuugcccaucuaggagcugugcccugcccgguacuuuguuaucaaugaccagagacccugguaaccagcggcagggcucagaccccacccccaccacuaccacccaggucucucgcauagauccccaagugacugguagccacauuuaaccacuugccacaaacagauuuuccccacccuuauccuucuggguagggaacgcuagggcuucugugggaggggggaaguggugaggaguauugagggucuucugucuguuuugagaggugggccacgacuguaagcugaacccaguaaggguugugagguuccagccacagcuaggggaggaagagggaguggcuccccacacuccaggcuuggaagcacuaucagaacaggcuaggaccuaguucucuugagggcuccucugcuucccugaggggauuugauggagugcuagaguucuuuuugccccugggcuggcugggagagggugggaaaggcuugaguuccacacaguggcuaaaugagugugacaguguugcuaaaaggggccccaagccagccuccucacacaaccacccaggagcugagagacuggcuggggaggggggugggucugcugaggacagacaaagcccugggguagggugggguaaaaaagggcaggcugaagccuuuugaggaggagcugauugcuauggcaacacugcuucccagacagucucucagagagggcgggccuagggcagacucuccagcuuccucaggacuggggcgguuugugugaguggguggggcaugaagagaaagggcaucaguuugcugugcugagacuggaggauauagccuuucugcuuugguacaggcagcagagcauucgaaugccuggagcuauccucugauauggagaugagugaacaacagucauuagaauuguagagcugcagaggcccucagcagucauuguuuauacaaacaccucauuuuacagguuuggaaauuuauggcuaaagagacugugauuccccagaugucacagugaaagggcagaagauaggauccagaucgccggauugcuguucacucagcccagggccuguuguuuucuucagucaauguuuauugaacauugccagggacuaauguuggcucugggaauaugagcaugaacgaaacaaaguugcugcucucauggagcuuccauucuauuaaggggagaaagaaauuguggagggggagggagaagucaaguagugauaaccgcuauauaaaaaaaaauaaagcaggauaaauuuagggcaggaagguaaggccucuuuauuuauuuauuuauuuauuuauuuauuuauuuauuuauuuauuuuugagacggagucucacucacucugucacccaggcuggagugcaguggugcgaucuuggcucacuacaaccuccgccuccuggguucaagugauucuccugccucagccuccugaguagcugggauuacaggugcgcgccaccacacucagcuaauuuuuguauuuuuaguagagacgggguuucaccauguuagucaggcuggucucgaacuccugagcuugugauccgcccacuuuggccucccaaagugcugggauuacaggcgugagccaccguaccuggugguaaguccucuugguuguacccugcugcuuucccaggguacacugaggccuggaacaucuuugauccuucacccugaacuauuguccucugaccuuuguagguaaccaaggccuggccuaugguaguggcagaaagauagaauaaggugggguugcuaagggauuauuuuuuuccuacaguguucuacgucucuguuuuccuaguaaguuuuuauuaaggcaaguaggcucuuacauugauacacuguaauuuugacaagggcauugaaaauuuccuuaacccuguuccuuacacuagggaaccggcaaggaagucagcccaagggaacuggguucuuauucagaguuuuccucuugaaaaggguggucuagggugagguaaggagaagggagcuuagagggacuguuacuugcuugugucucccaagucuaggacugagggacuagggggaagaggaaggagccucuuuuuacuaucuagugauauaaccucagggcccugggggguccacagcacaggcaaggcagaaacaaggaccuugggcucucuguggccucugaacuguagaagaauggacuuucccucuuuggcucugguguuugccuccugcuucugugaaggaccgggagaaaaagccuccuaagucccaaauuauccgacuugcugacaagugcagagggcaggguagacaggacuauugcuuuucuuaguuuaccucuagaguacccucuagaaagugucuuugaaugcucaauccuugcaaagguuuccauccuggucauuuaaagaauaggaggacaaggguuagggaugccgguucugcugccauuugauuugacugggucugaacugggcuggggcccagugacucagugggaggguggauaguuuugagggagcugugagucaugggguugagcuccaucacaagaguugggcucauuucccccauucugggcagaagcucuccuaucccacuucccuguaugcucugucuccuugaacaugggccugugaguagaaagagugcuggcaggcugaucucagaaagggaguucagaggcacaaagaauaaugcuggucccugagauuaaaauguaucccuaucuuaggaacccguggggcuccucuaaagaaggcaaaagaacaucaauuuaagaguaacagagggaaaaguaccacuucuuaacauggaaggagauagggucccaccucaggccuuuuucuucucuggcauggaggaagcuuccugggcuucacuaguucuccagcucugaagcuuugguuuggaagguggggaaagacaaaugggagugagguauuuggggucuggggucugguauagacagcaggcagacuuugaggguugucaaaccguaucuuuaaagcccucgggcuuccuauuaaccguccuggaaggaggaagggcgggggaguagggcggagggguaagauguggaaggccuacgccuuugaaaggguuaaauggcagggcaggguguugcuuuggacuccggcagcugucggguuaaggagaagggcggagcgaccuuggguaagccuacccccuuauggaccaauaggcgugugccucuuggagggggcgugccucgcacuugaggucgcggggaggcuggcuuccuauggaccaaugagcauggucgcuuuccagggagggcguagccugaggggggcguggcggccguggccgccgcggcgcgggugguggggcacugggcggggcgggcggccccaucagcugguaggaaauggccugugagucagaggggcaguggagucggcggcgcggagccggggcggccccggggagggaccgucgcagggaggggcgcggcagcggcuggggggcugcgggcgccagggcccgcuaguguugcacacgaagcugaacagcgaagagccuagcagagcagggcucagccugagccacccuuugucuggguugggggcccguggcagggaggaccggggaaccaaggggagggaccgggacgggacgggacggaagggcccggagcagcggccaccuccgcggagccaauuugggagcggggugagugugcuagagggaaagagcaaaucuccgaagcuccaguauaguauggggccugucccaggcuguggggaggagaggagugagaagggaccugggaggcugggcaggggguaagggaucguccagaagaaggaguccaggagucaggugagucugccuggcuuaguuuagagagucugcuaaggucugcucucuccccucugaagauagagggcucuaggcugggggccgagggguugguaagagagaagaagucgaccuuccuacccacaguggugguccgugggaacagccccccuagcuuguguggauguauguagggacaaaauagagagcagcuggcagcaguucucuuugcauaggaugaggguggaaagcacauggauaggaauucauccugucacucuccuugaucaugguagaaauggaaaucuuuaauacugaagggaaggggagaaugagccuugaagcugauaccuauaccaauacccaccucacccaccucccaggccucaaaagugucuaaagguacagacguauucugggacuuguuguuuuugcuggccuugcucccucagcauguugggagcuguaguccuugccagccacagccuggcacagcuguuugaugccagcugcugcccacccccugaacgaagagugaggcuuggccuacucugcccugccccccuccccugcaguccugccccaugagucagcuugaagccauggucuagagccagacuggcuggguggcaggggagugaauauagagcgucuuguugacagggugggaacugagagggcucugggguuaauaagcagaugccagguaugcuggggucaaguagggcaucaugucauccccuggcuuccccagggcaaggggucaagagggcaacugggaugaccuggaagugguggugcuagggaaaaggccccuccugaaucuguauggcuuggguggaggaaagaaggguagaaauuagugcagguuguaccuucugacaagguugguugcagguaggauagugcagguugcgauugguguucugcccuuuccagccaucccgcccaccacagggaaccaggauuuucuuagggaucccaauucuuaggagaauuuggugaaaugggauagugggguacaaugaugggaacuugguguaggagagcuuuucagucccuggguacaaaucucuccuuucugccugcuccccacccccaccucuguuccugauuuucccuuguacaauuaaucucucugcuucucucaucugggaaauuuuucucuccacucucaggacugcugcucagaugucugggacuugcauucuacuuuuuuugagcccugcugugugcuuaccccuguacuugggguuggauggaggggugggacacagaucuguccucaggaacucuauggucggucuagaagaugccuuacccacaggagugagcagaacuguuagugagcuuacaggaaguaguaacacugccauaggugaggucucagagaagggagagaugcuuauggucugggguggacagagcagacuuucuggaggagauggcauuugaccuauccaaggaggaaaagucuuggguaggcauucaaagggcacuucuugaaggggaaagagcaccgugaaugucagacagcaaaagagaaggcugacccugggggcagcuggcuuucaacuugacauuccccucacccuaguaugggcuggaauaguuagugaagaccaucuuaugcacccgugguuugggguuuugguguugggugugugagcacugggggaggggcguggagagguacucccuaguugcuuccagcugacugacugcugcggccuuaucucuaguuugcagggccuugcgggagggcccuggaaagugccuucuggcagugaccccuuccccuuccccuucuuguuuuuggucggauuuguugccucuuguuaaagagacaggcugcuggaggcaauuuggaguucagggcugaaaggccagcucugagcugacuugaaauuuguaccucugaggaccgcugaugggguauaacugugugggagaccucugcccuuagugcccuaggauggcacuugucccuuuggagauagacauauaagaaggaguugugcaauuugguggcuuugaguaagaaagcugaauucuuccccuggccgccucucagcugacacggucucuuggaucuugggggucucucaucccuuccuccauguagggcaggaguccucaaaugguggcccugacaaguaguuauucuaccucaacucacuugucacauccuuauuauacugagccaagaccugccucuuugacuccuuagguagcccaacucugccaucugugcccuggaccccaagccuacccuuucuguuccugaagagccucucacaugggagaaggauguccuggaguguacuauuagccuauaauuggugacaggccuuaccgcuggcuccagugauccuggcuuacgucuguucuucucuccucaggguccugcugagcucaggagcugcacggaaugguggcagucaccuugccagugcagcaggcauggaucagacugcaagcuaggggcacgaggcaucaguugggaagaggggacgcacagcuaggcuugaggccucuucaucgggguaaguaccagggagaagagggggaaguguguccaguaagaagccugagcuaaaccugucacccucucaggaguucugagaguggucucuauauuccauuaguccauccagggauuuguacacauucauccuugggaacccaucaaagucaccccuuuaggcaaggagagggucugaaacucagcuggaaggaagaagacucauugauuccccugaccaccuuuucuucucuucucuuacacagauguccccaggccccccagcccaggcccagcauaaaggccguguuggggggccccccugacccaaggggggcuucaugcgccacgugcaggcggagccgucuccauccucagagccggaggcuggcccuucacagccuccagucaggcagggggcccuccaggguggccugcucaugggcuacagcccagcagggggggcgacaucccccggggucuaccagguauccaucuuuuccccuccggcugguaccucugagccucauagggcccugaaacgacaagccccauccacugaggguccccgggagcugaagagaggcccugggcugggggccagagagggacuacccccugaagaaccaucuacuguggggcucuuaggcccagagggaccggggcugggacuagguguggccagccagcauuucucccaccguggccucuguguuguggaacagagaaguagugucaccucaucuuggacuucgggggccuggaguccccccugccccccaucaaaugcuuccugcaauacuuugcacaccagagacugggccuccccagauccagggggacaggggucccugggggaguccccagggccagccccuccaggccagcugcacacacuugacacugauuugcacagucuugcacaaauaggggguaagagcccaguggcuggggugggcaauggggguagccucuggccuagggaguccccuggcacugccaaugggcacagucccgagcacacacccccuggcccuggacccccaggccccugccccaccaagcgaaggcugcuuccugcuggagaagccccagaugucagcucugaggaagaggggccagccccucggaggcgccggggaucccugggccacccuacugcugccaacaguucugaugccaaagccacacccuucuggagccaccugcugccugggcccaaagagccuguuuugguaagccaauaaaggaccucauuuacucuuuuuuuacuuuuuuuuuuuuuuuuuuuuuuuugagaugggaucucacuccaucacugcuggagugcaguggcacaaucucagcugacugcaaccuccuccucccaggcucaagggauccuccaaccucagccucccaaguaucugggaccacaggcacaugacauugcacccagcuaauuuuugguauuuuugguagaaaugggguuucgccauguugcccaagcuggucucgaacuccugagcucaaaucaucgacccaccuuggccuucuaaaguguugugauuacaggcgcucaagccacugcgccuguccuucauguacucuuaaguggauauuuguguggguaaagguggaggccuggggggcaggguguuccuuugagaguuugugaugagcuucugccccaaaacauacauggccuucacccugugucuuuucccaaucauuucucuccguaggacccaacagacugcggucccauggggcggaggcugaaaggagcccgucgccugaagcuguaagugaccagcuuuuuccucuacccugucccugagaaugggggcagaagucuguacucuuuccagcauccgaguaggggaccccagggcagaagcccuacauaguggcagaggguggaguccaagggcauaagcaggaaucccagaauaccucaagccaacccccuguguuucccuuccucuaccaggagcccccuucgaagccuccggaaggggccaggccugcugagcccccccagugccuccccuguuccuaccccugcugucagccguacccugcugggcaacuuugagguagcucccguugggguuugugauugccgggguccugggagaggugggaugguggaauguggcuuggauggauaaggaaaagaauuggcaucucucucuucauguguuuucccuacccuaaucccaggaaucauugcugcgaggacguuuugcaccaucuggccacauugagggcuucacagcagaaauuggagcuagugggucauacugcccccagcacgucacgcugccugucacugucacauucuuugauguuucugagcaaaaugccccggcucccuuccugguaugccuugacuccaaccccaaagucagcucaucaagaggaugaggauuugggggcggggccagggggcaagagguauuucuuacuuauuccucaccuagaagugagucagggccaggugaggagaacucuacuguagggcaggggcagguucagggugagagcuuguggagagggacauguguuuagggcccaggguuuuccuaguccccaccuugacugauggcucccuggccuuccagggcaucguggaucugaaccccuuggggaggaaggguuacagcgugcccaaggugggcaccguccaaguggugaguuugcccugagggagugggaguggggagagaggaaagcagcccucaggcccuaccaaccuugacuguccugucccuagaccuuauuuaaccccaaccagacugugguaaagauguuccuugugaccuuugacuucucggacaugccugcugcccacaugaccuuccugcgccaucgccucuuuuuggugccugugggugaggagggaaaugcuaaccccacccaccgccuccucugcuacuugcugcaccucaggugaggagagggcccagggauggcuggggaggcccagguauccccucccugaagaggaucucuccuugcuucgauacuguccggauucuugcuuaguuuauuuuuaaauuuuuauguauguauguacauauauauguauguauucauuuauuuuuagagauggggucucgcuauguugcuuaggcuggucuccaacuccugggcucaagcaguccucccaccugggucucccaaagcacuggaauuacaggcaugagccacugaacccagccuggauucuuacguugaucacauuguccuccuccagguuccggagcucccgcucaggccgcuuaagccugcauggagauauccgccugcuuuuuucccgccggagccuggagcuggacacagggcuccccuacgaacugcaggcugugaccgaggccccucauaauccacguuauucaccuuugcccugauugccagcacucugaacccaugcgggcuaaugaccugcccauccugcuccaucuuagagaacauauauggagagacagcaagagacccuucaggcuugaauuaaagcccucaccaugcucacgcccaaauggauuauuuggguguuuaaagcuucugauucuuacuacacccugcccuacuucggguacuccaugugccuguccccucccuuggguuucccaggccagcuuagguaguagggaggaacuggagcuacccugagauuuucucaaguucccaggcaaguuaugccagcguugccucccuguccugggcaggggccacuuguuauuuuauuuauuuuuaauuuauaauuuauucaaauuggauugccuugguaaccucccacaccugauaauuggcaucacuccuccccgcuucccacucucagauauugcuccaaccucaggaguugaagaggcuuaugcggugggggcaggaggagaacugcuuucccucagcugagggaagaggggcuauuccagagggacugagucaguagccaaagacucagcuuccccuguccuuccccagucccuucacuuccccuacccucugaccuaucucugaaagccaaguuaugcguaugugugugugcacaagcuugucuuugugugguaugugugugugagugugcauguaugcacacacacagggguuaaccaccccucaccuagggcuccagacuccaguugucccucuccuccuaccugugucuccuuguuuugggguccugacugaagaagguguccagggggcagagucagggccaagcacuggggugccuccucucaccuggccagacucugacccaccuaccucagcuggggugaggggcaccccucaaacucagucaugugguuccaaacuaccccauuccccacuccagacucugacccagccucaguccuaacuccuggggcugggcugaggggaacaagcauuugcugaaacuugaaaaaacaaagcaaaucaaaaacaggaaaaaauuguaccugguacuuuuuuuuagaaaaaaagauuaaaaaagaaagaauaaauucuuguuuggaaacuugaacuaagcucuacuuuuguuguuguuguuguuguuggggagagggugugaagggggauggagggccuuccuggagcugggacucagcccuuucuaccagagaggcaacaggccugggcccaugaggucuuaggcuagucccugcugauuccuggggccugguuuuucuccuuucggagggguugguggguaaaguucagccguagaagcugaacucugaauuguagaucaggauucuaauacugguucuauuaaugacuuuagccccucagaacuucagugcccucauauguaaaauggaggugacuacggaggucucuugacuaccagagcauuagggaugugggcaaggugacaugcuccagacaagguugaacguugaggcuguuugcuggacuguauuuaagaccgggcauaacaaaccuugcuugg

SEQ ID NO: 13933 - RNA, 5207 nt, Homo sapiens
gugguagaggguugguuaaggaguuuccugaaggagguggccuuucaucugaguuucaaagaacagaagagauuagacagggaggacaguaaaauuuuuuuuuuuuuuugaaacagucucgcuuugucgcccaggcuggagugcaguggcgcgaucuuggcuuacuacaagcuuugccuccuggguucacgccauucuccugccucagccuccugaguagcugggacuacaggcggccgccaccacgcccggcuaauuuuuuuuuuuuuuuuuuuucaguagagacgggguuucacuauguuagcgacgauuuuugucuguuuguuuguuuuugagacagagucucacucugucgaucaggcuggagugcaguggcgcgaucucggcucacugcaaccucugccucccagguucaagugauucuccugccucagccuccugaguagcugagauuacaggugccugccaccaugcccagcuaauuuuuguauuuuuaguagagacgggguuucaccauguuggccaggcuggucucgaacuccugaccucaggugaucugcacaccucggccucccaaagugcugguauuagaggcaugagccacugcaccuggccaguaaaacuauuugugacacagcagcaagugcacaagcacugaccuaucagaguugaagguggcugaggcacucaagugggcuccuggggacucuguuaugccagggaauaccucuuuagauaagggaucaggaggucuggagggucccuaaggaagagcuaggguagcagggguacccuggagcuaggggccauggcuauaugccaacaggauuagaaauaucuuaauguauuuaauuaaccuacacaaccauauuggugggugccuacugaauauuagcccuagauauggaccugaaauggccuuauucucuuuuaguuuguuuaagccaauggagccuuacuagaaugugagcuacaaaacaguagagcuauucucuauucaaugcugcaucuguagggccuagaacagcaccugaaggacuggcggaggcuuaauaaauuguuaaaagggcagacuagccaggugugauggcgugugccuguagucccagcuacuugggaggcugaggcaggaggaucacuugaucccaggauuucugggcuguaguguaguauaccagucaggugucugcacuaaguucugcaucaaccugguugccuaaggaugguugaacugacccagguggaaauuggagcaggucaaaacucaaugcugaucaguaacagggucgcaccuguaaauagccaccgcccuccagccugggcaacacagugagaucccaucucuaaaauaaauuuuaaaaauaauuaauuagaaaaaaaaaccagccuguaaucccagcacuuugggaggccaaggcgggcagaucaccugaggucaggaguucaagacaagccuggccaacauggcaaaaccccaaucucuaccaaaaauacaaaaauuagcugggcgugguggcaggugccuguagucccagcuacccaggaggcugaggcaagagaaucgcuugaaccugggagguggagauugcagugggccgagaucgcgccacuucacuccagccuggguagcagagugcgacucugucucaaaaaaaaaaaaaaagaaagaaaagaaaagaaaaagaaaagaaaagaaaaaaacugggaggccuaagcccauucuugguguccucacacucuucugccccaucuccuugcacccagucuuccccugcaaucugugcuccauacuagcccucaagcccucaacgugaccuaguaugagaacuggauucugucacucuccugcucauaauauuuuaugccuucccuuugcccagaauaucauucucccuauuguuuuuaccaauggaacugguauuucuucaaggacaugaucaaauuugccuacuucuauauuaucuucuaaagcagaauucaucucucuucccucaauaugaugauauugacaggguuugcccucacucacuagauugugagcugcucagggcagguagcguuuuuuguuuuuguuuuuguuuuucuuuuuugagacagggucuugcucugucacccaggccagagugcaaugguacagucucagcucacugcagccucaaccgccucggcucaaaccaucaucccauuucagccuccugaguagcugggacuacaggcacaugccauuacaccuggcuaauuuuuuuguauuucuaguagagacaggguuuggccauguugcccgggcuggucucgaacuccuggacucaagcaauccacccaccucagccucccaaaaugagggaccgugucuuauucauuuccaugucccuaguccauagcccagugcuggaccuaugguaguacuaaauaaauauuuguugaaugcaauaguaaauagcauuucagggagcaagaacuagauuaacaaaggugguaaaagguuuggagaaaaaaauaauaguuuaauuuggcuagaguaugagggagaguaguaggagacaagauggaaaggucucuugggcaagguuuugaaggaaguuggaagucagaaguacacaaugugcauaucguggcaggcaguggggagccaaugaaggcuuuugagcaggagaguaauguguugaaaaauaaauauagguuaaaccuaucagagccccucugacacauacacuugcuuuucauucaagcucaaguuugucucccacauacccauuacuuaacucacccucgggcuccccuagcagccugcccuaccucuuuaccugcuuccugguggagucagggauguauacaugagcugcuuucccucucagccagaggacaugggggccccagcuccccugccuuuccccuucugugccuggagcugggaagcaggccaggguuagcugaggcuggcuggcaagcagcuggguggugccagggagagccugcauagugccagguggugccuuggguuccaagcugaguccauggccccgauaaccuucugccugugcacacaccugccccucacuccacccccauccuagcuuugguaugggggagagggcacagggccagacaaaccugugagacuuuggcuccaucucugcaaaagggcgcucugugagucagccugcuccccuccaggcuugcuccucccccacccagcucucguuuccaaugcacguacagcccguacacaccgugugcugggacaccccacagucagccgcauggcuccccugugccccagccccuggcucccucuguugaucccggccccugcuccaggccucacugugcaacugcugcugucacugcugcuucuggugccuguccauccccagagguugccccggaugcaggaggauucccccuugggaggaggcucuucuggggaagaugacccacugggcgaggaggaucugcccagugaagaggauucacccagagaggaggauccacccggagaggaggaucuaccuggagaggaggaucuaccuggagaggaggaucuaccugaaguuaagccuaaaucagaagaagagggcucccugaaguuagaggaucuaccuacuguugaggcuccuggagauccucaagaaccccagaauaaugcccacagggacaaagaagguaaguggucaucaaucuccaaauccagguuccaggagguucaugacuccccucccauaccccagccuaggcucuguucacucagggaaggaggggagacuguacuccccacagaagcccuuccagaggucccauaccaauauccccauccccacucucggagguagaaagggacagauguggagagaaaauaaaaagggugcaaaaggagagaggugagcuggaugagaugggagagaagggggaggcuggagaagagaaagggaugagaacugcagaugagagaaaaaaugugcagacagaggaaaaaaauagguggagaaggagagucagagaguuugaggggaagagaaaaggaaagcuugggaggugaaguggguaccagagacaagcaagaagagcugguagaagucaucucaucuuaggcuacaaugaggaaauugagaccuaggaagaagggacacagcagguagagaaacguggcuucuugacucccaagccaggaauuuggggaaagggguuggagaccauacaaggcagagggaugaguggggagaagaaagaagggagaaaggaaagaugguguacucacucauuugggacucaggacugaagugcccacucacuuuuuuuuuuuuuuuuuuugagacaaacuuucacuuuuguugcccaggcuggagugcaauggcgcgaucucggcucacugcaaccuccaccucccggguucaagugauucuccugccucagccucuagccaaguagcugcgauuacaggcaugcgccaccacgcccggcuaauuuuuguauuuuuaguagagacgggguuucgccauguuggucaggcuggucucgaacuccugaucucaggugauccaaccacccuggccucccaaagugcugggauuauaggcgugagccacagcgccuggccugaagcagccacucacuuuuacagacccuaagacaaugauugcaagcugguaggauugcuguuuggcccacccagcugcgguguugaguuugggugcggucuccugugcuuugcaccuggcccgcuuaaggcauuuguuacccguaaugcuccuguaaggcaucugcguuugugacaucguuuuggucgccaggaagggauuggggcucuaagcuugagcgguucauccuuuucauuuauacaggggaugaccagagucauuggcgcuauggaggugagacacccacccgcugcacagacccaaucugggaacccagcucuguggaucuccccuacagccgucccugaacacuggucccgggcgucccacccgccgcccaccgucccacccccucaccuuuucuacccggguucccuaaguuccugaccuaggcgucagacuuccucacuauacucucccaccccaggcgacccgcccuggccccggguguccccagccugcgcgggccgcuuccaguccccgguggauauccgcccccagcucgccgccuucugcccggcccugcgcccccuggaacuccugggcuuccagcucccgccgcucccagaacug

SEQ ID NO: 13934 - RNA, 7236 nt, Homo sapiens
cacaccgugugcugggacaccccacagucagccgcauggcuccccugugccccagccccuggcucccucuguugaucccggccccugcuccaggccucacugugcaacugcugcugucacugcugcuucuggugccuguccauccccagagguugccccggaugcaggaggauucccccuugggaggaggcucuucuggggaagaugacccacugggcgaggaggaucugcccagugaagaggauucacccagagaggaggauccacccggagaggaggaucuaccuggagaggaggaucuaccuggagaggaggaucuaccugaaguuaagccuaaaucagaagaagagggcucccugaaguuagaggaucuaccuacuguugaggcuccuggagauccucaagaaccccagaauaaugcccacagggacaaagaagguaaguggucaucaaucuccaaauccagguuccaggagguucaugacuccccucccauaccccagccuaggcucuguucacucagggaaggaggggagacuguacuccccacagaagcccuuccagaggucccauaccaauauccccauccccacucucggagguagaaagggacagauguggagagaaaauaaaaagggugcaaaaggagagaggugagcuggaugagaugggagagaagggggaggcuggagaagagaaagggaugagaacugcagaugagagaaaaaaugugcagacagaggaaaaaaauagguggagaaggagagucagagaguuugaggggaagagaaaaggaaagcuugggaggugaaguggguaccagagacaagcaagaagagcugguagaagucaucucaucuuaggcuacaaugaggaaauugagaccuaggaagaagggacacagcagguagagaaacguggcuucuugacucccaagccaggaauuuggggaaagggguuggagaccauacaaggcagagggaugaguggggagaagaaagaagggagaaaggaaagaugguguacucacucauuugggacucaggacugaagugcccacucacuuuuuuuuuuuuuuuuuuugagacaaacuuucacuuuuguugcccaggcuggagugcaauggcgcgaucucggcucacugcaaccuccaccucccggguucaagugauucuccugccucagccucuagccaaguagcugcgauuacaggcaugcgccaccacgcccggcuaauuuuuguauuuuuaguagagacgggguuucgccauguuggucaggcuggucucgaacuccugaucucaggugauccaaccacccuggccucccaaagugcugggauuauaggcgugagccacagcgccuggccugaagcagccacucacuuuuacagacccuaagacaaugauugcaagcugguaggauugcuguuuggcccacccagcugcgguguugaguuugggugcggucuccugugcuuugcaccuggcccgcuuaaggcauuuguuacccguaaugcuccuguaaggcaucugcguuugugacaucguuuuggucgccaggaagggauuggggcucuaagcuugagcgguucauccuuuucauuuauacaggggaugaccagagucauuggcgcuauggaggugagacacccacccgcugcacagacccaaucugggaacccagcucuguggaucuccccuacagccgucccugaacacuggucccgggcgucccacccgccgcccaccgucccacccccucaccuuuucuacccggguucccuaaguuccugaccuaggcgucagacuuccucacuauacucucccaccccaggcgacccgcccuggccccggguguccccagccugcgcgggccgcuuccaguccccgguggauauccgcccccagcucgccgccuucugcccggcccugcgcccccuggaacuccugggcuuccagcucccgccgcucccagaacugcgccugcgcaacaauggccacaguggugagggggucuccccgccgagacuuggggauggggcggggcgcagggaagggaaccgucgcggcagugccugcccggggguugggcuggcccuaccgggcggggccggcucacuugccucucccuacgcagugcaacugacccugccuccugggcuagagauggcucugggucccgggcgggaguaccgggcucugcagcugcaucugcacuggggggcugcaggucguccgggcucggagcacacuguggaaggccaccguuucccugccgaggugagcgcggagcuggccgagaaggggcaaaggagcggggcggagcggggccagagacguggcccucuccuacccucguguccuuuucagauccacgugguucaccucagcaccgccuuugccagaguugacgaggccuuggggcgcccgggaggccuggccguguuggccgccuuucuggagguaccagauccuggacacccccuacuccccgcuuucccaucccaugcuccucccggacucuaucguggagccagagaccccaucccagcaagcucacucaggccccuggcugacaaacucauucacgcacuguuuguucauuuaacacccacugugaaccaggcaccagcccccaacaaggauucugaagcuguagguccuugccucuaaggagcccacagccagugggggaggcugacaugacagacacauaggaaggacauaguaaagaugguggucacagaggaggugacacuuaaagccuucacugguagaaaagaaaaggagguguucauugcagaggaaacagaaugugcaaagacucagaauauggccuauuuagggaauggcuacauacaccaugauuagaggaggccaguaaagggaagggauggugagaugccugcuagguucacucacucacuuuuauuuauuuauuuauuuuuuugacagucucucugucgcccaggcuggagugcaguggugugaucuugggucacugcaacuuccgccucccggguucaagggauucuccugccucagcuuccugaguagcugggguuacaggugugugccaccaugcccagcuaauuuuuuuuuguauuuuuaguagacaggguuucaccauguuggucaggcuggucucaaacuccuggccucaagugauccgccugacucagccuaccaaagugcugauuacaagugugagccaccgugcccagccacacucacugauucuuuaaugccagccacacagcacaaaguucagagaaaugccuccaucauagcaugucaauauguucauacucuuagguucauaauguucuuaacauuagguucauaagcaaaauaagaaaaaagaauaauaaauaaaagaaguggcaugucaggaccucaccugaaaagccaaacacagaaucaugaaggugaaugcagaggugacaccaacacaaagguguauauaugguuuccuguggggaguauguacggaggcagcagugagugagacugcaaacgucagaagggcacgggucacugagagccuaguauccuaaguaaagugggcucucucccucucucuccagcuugucauugaaaaccaguccaccaagcuuguugguucgcacagcaagaguacauagaguuugaaauaauacauaggauuuuaagagggagacacugucucuaaaaaaaaaaacaacagcaacaacaaaaagcaacaaccauuacaauuuuauguucccucagcauucucagagcugaggaaugggagaggucuaugggaaccccccuucauguuccggccuucagccauggcccuggauacaugcacucaucugucuuacaaugucaucccccaggagggcccggaagaaaacagugccuaugagcaguugcugucucgcuuggaagaaaucgcugaggaaggucaguuuguuggucuggccacuaaucucuguggccuaguucauaaagaaucacccuuuggagcuucaggucugaggcuggagaugggcucccuccagugcaggagggauugaagcaugagccagcgcucaucuugauaauaaccaugaagcugacagacacaguuacccgcaaacggcugccuacagauugaaaaccaagcaaaaaccgccgggcacgguggcucacgccuguaaucccagcacuuugggaggccaaggcagguggaucacgaggucaagagaucaagaccauccuggccaacauggugaaaccccaucucuacuaaaaauacgaaaaaauagccaggcgugguggcgggugccuguaaucccagcuacucgggaggcugaggcaggagaauggcaugaacccgggaggcagaaguugcagugagccgagaucgugccacugcacuccagccugggcaacagagcgagacucuugucucaaaaaaaaaaaaaaaaaagaaaaccaagcaaaaaccaaaaugagacaaaaaaaacaagaccaaaaaaugguguuuggaauugucaaggucaagucuggagagcuaaacuuuuucugagaacuguuuaucuuuaauaagcaucaaauauuuuaacuuuguaaauacuuuuguuggaaaucguucucuucuuagucacucuugggucauuuuaaaucucacuuacucuacuagaccuuuuagguuucugcuagacuagguagaacucugccuuugcauuucuugugucuguuuuguauaguuaucaauauucauauuuauuuacaaguuauucagaucauuuuuucuuuucuuuucuuuuuuuuuuuuuuuacaucuuuaguagagacaggguuucaccauauuggccaggcugcucucaaacuccugaccuugugauccaccagccucggccucccaaagugcugggauucauuuuuucuuuuuaauuugcucugggcuuaaacuuguggcccagcacuuuaugaugguacacagaguuaagaguguagacucagacggucuuucuucuuuccuucucuuccuuccucccuucccucccaccuucccuucucuccuuccuuucuuucuuccucucuugcuuccucaggccucuuccaguugcuccaaagcccuguacuuuuuuuugaguuacgucuuaugggaagggccugcacuuagcgaagaaguggucucagaguugaguuaccuuggcuucugggaggugaaacuguaucccuauacccugaagcuuuaagggggugcaauguagaugagaccccaacauagauccucuucacaggcucagagacucaggucccaggacuggacauaucugcacuccugcccucugacuucagccgcuacuuccaauaugaggggucucugacuacaccgcccugugcccagggugucaucuggacuguguuuaaccagacagugaugcugagugcuaagcaggugggccugggguguguguggacacagugggugcgggggaaagaggauguaagaugagaugagaaacaggagaagaaagaaaucaaggcugggcucuguggcuuacgccuauaaucccaccacguugggaggcugaggugggagaaugguuugagcccaggaguucaagacaaggcggggcaacauagugugaccccaucucuaccaaaaaaaccccaacaaaaccaaaaauagccgggcauggugguaugcgccuagucccagcuacucaaggaggcugaggugggaagaucgcuugauuccaggaguuugagacugcagugagcuaugaucccaccacugccuaccaucuuuaggauacauuuauuuauuuauaaaagaaaucaagaggcuggauggggaauacaggagcuggaggguggagcccugaggugcugguugugagcuggccugggacccuuguuuccugucaugccaugaacccacccacacuguccacugaccucccuagcuccacacccucucugacacccuguggggaccuggugacucucggcuacagcugaacuuccgagcgacgcagccuuugaaugggcgagugauugaggccuccuucccugcuggaguggacagcaguccucgggcugcugagccagguacagcuuugucugguuuccccccagccaguagucccuuauccucccaugugugugccagugucugucauugguggucacagcccgccucucacaucuccuuuuucucuccaguccagcugaauuccugccuggcugcuggugagucugccccuccucuugguccugaugccaggagacuccucagcaccauucagccccagggcugcucaggaccgccucugcucccucuccuuuucugcagaacagaccccaaccccaauauuagagaggcagaucaugguggggauucccccauuguccccagaggcuaauugauuagaaugaagcuugagaaaucucccagcaucccucucgcaaaacaauccccccccuuuuuuuaaagauagggucucacucuguugcccaggcugggguguuguggcacgaucauagcucacugcagccucgaacuccuaggcucaggcaauccuuucaccuuagcuucucaaagcacugggacuguaggcaugagccacugugccuggccccaaacggcccuuuuacuuggcuuuuaggaagcaaaaacggugcuuaucuuaccccuucucguguauccacccucaucccuuggcuggccucuucuggagacugaggcacuaggggcugccugagaacucggggcaggggugguggagugcacugaggcagguguugaggaacucugcagaccccucuuccuucccaaagcagcccucucugcucuccaucgcaggugacauccuagcccugguuuuuggccuccuuuuugcugucaccagcgucgcguuccuugugcagaugagaaggcagcacagguauuacacugacccuuucuucaggcacaagcuucccccacccuuguggagucacuucaugcaaagcgcaugcaaaugagcugcuccugggccaguuuucugauuagccuuuccuguuguguacacacagaaggggaaccaaagggggugugagcuaccgcccagcagagguagccgagacuggagccuagaggcuggaucuuggagaaugugagaagccagccagaggcaucugagggggagccgguaacuguccuguccugcucauuaugccacuuccuuuuaacugccaagaaauuuuuuaaaauaaauauuuauaauaaaau

SEQ ID NO: 13935 - RNA, 35320 nt, Homo sapiens
ccggcggcuuuccauagcccucuccggacccgccucccaggcucaauucuccucagccuccaacgcagcgaaagugacgcaccccaccccguggcacugugggacuuggaguucccuccaacugagaagaggcuugggugcagcgccacgucccaggggcuaugcaaauguaggggacggcccugcugccgccucgcaccccgagggcggggguuccggggcuccggcuccgccuucuaccccaagcuagaaaaaggaagaguucuagccugaaagggaacucgggcgucguccuggcguccucuccggauugcgccgcacccucgcuuccugccagggaggggcugccgggcuuuggcggcucccgagcaucgagaacggggccagagcagcuuccugccugccccccgcgaccauagagcgcgggcccagggcgccgcccgcgggugggggacguucccaggacggaaguggccgagagagugucgaagggagggcgaggccggagcccgagggcgacccgagaagcggcggggcggcgggccggcgggcggggcgcagagccaggcagcgcagguaggccagaccgggccgggcgggggccuuaggguggggccgcggggccuggccccggggcgggcgggcccugccucucuugcguguccgguucggguccuauuaguuggagaggucagcguccagcgcaucucggcuugagcucggcgugaaguaggccgucuuggggaagacaggccuuuccugggagcaguccuaugucugggauaggcuuuggggagcgugaggagucggguggcagcggggcgcagggcggggacgggcuuugguguuagcugauagcgggcauguggguaggaaagcuuugggugaguuggggauuaggugggguccguuuaggaaucaagggucgcuauaggaguuaaaagcugggguuaaaacuuaagaguuagugugagucagguccguuuuagauagguaagguuuagauuacggucauuaucuuguuugcugggauggccaucauacgucauaauuugaguucagggucagguuaagggucaacaaacaacaggaaucagguuagagcuuguuugagggauuaaagaauguuggcauggucgguguuaaggauaaacagugaaagcgugaguuaggaaucaaauuauaaaugaacuuuaggcuuaggggucaacauuuaggguuaacaucaggggauuuggugcuaaaggcaaaacuuagaucaguuucagggaucagggauuggauaugagucugugcuaggaaagggaugaauguccaagccgguacugggaaucaggaaacaaauuagaggugggguuaauguuaggaauuuggggcagcuuuagggguugugguuugaggcuagcauaguugaccuugagcagauaaaauuuaagagguuggcaguagguaaaugcccuucuuuuguagggaaauccuuuauuccuauguaguuacaggggcuucuuuuuacccagagagauaaacuaauuucaggcuagcguucuggcuuuagcuagaauugcaggcaucugggauuccagcuucuuuauuccauucucuaagcccaaggcccuugcuguggccaccacaguuaggggacagagauucuggacuguguuguuuacagacaacauaggugggaaauagggacccaggauguacaaggccuagucacaaguuggggacugccuagggaagaaggagcugaugacuaugggggaagcuaaccaaggaaucacuguugccaugggagaagggaauaacugaauccccugaaaguuuagcccugcuucucccacuucacuuguucucuugguauuaagcccuccucuccaacucucaucccugacucugcauuucacacccauccugccuauccccuuacaaaauacuucccuugccuuuaacucucccaugcucaucuuaucauccguucccauccuuaguucuaccucccucaccaaccuuuaauccgcacauccuaccugaauuuacccucaucaaaaccugagcuuucccaucauuuuaaauuacucuccuaccauuuucacccagucauguaccuacauuccaccuggucaucugcugaauacccuacucccauccccugcugugugucacccccuggaucuaagccucuuuuaauuucuuggaccauuuguagauccccuucccccacuccccaacagaaaagaggaaacgagacccaaagaggaaacugggucuugcugaucccacgcccagccaggccacugaccacacccccacuucacucccagccugacccugccacugaccacagcacuauccucuacucagccugacccagccacuggcuguaccccaucccccaucccagcuccagcuuuacuuagacauugccaaugucccuucacuuucccacccccaccccagucugauuuagugacugaccacaggcccagcucuucucaaccuccuauagccugaccuggccucugaccucaccccaucauucccugacuuagccaccauccauguaaucauuccccuucccccaaccugaugcagugacuggucauauauguaucuuauguauauguauuuuuccaaacaccaucaucaccagcauucuuuuucuacacccugucuucucauccuuuuucuacacccugucuuccccauucccagccugaugcagucacuaacccaaccccaucugccccuaguggcuacuaaucauauacucauacccuuuuuccccacagccuaaccacaucccguaaccacagccucauccucacauucucugcccaaccugauccuuuccccucuucccaauucgucgccuaaacucaagcugccccagccgcuaaaguggcugcugaugauaggaagcugugggacucuaaccugucuaccuuaguaguuauuagguccugucauuucuaccuccccaaacuuguucugagugacaucuuccucaaugccauuccaacuccggcuucauuaccuuuaauuuguacuaauacaguguccuucuaacuaaucuccaagguaacugccagaguuauuuuucuaaaauccaguuccgguuaugucucuucucugcucaaagacucccuuggcuuccuuuuguccuccaauaaguaaaauuccucauaccccucuccagucuuccucugccuuuccauccuaacccugacuuccccaccacugcucccuugcagguaccccugugcuucaacagccugccugcucacuucccugaaugcuccuccacgauuuacugcuucuccaucuuugcuuaugcuauuucucugccuggagugaaaacuaccccugacacaucuccagcuggcuggcguaguggagaaagcuugggcuuugcagucagaaaccuggguucggauccuggcuucacaacuuauuauuuggagaaguauuugaacaaguauuuaacaucuuugagucuguuuucugaucuguaaaaauggaaauaaugacaccuacuguaaggauuaaaugaaauuauguauacaaugcaagugacauagucaauaaauggcagaucacuauuguuuuuuauuaucucuauuuuuuaaaauucuagcuucaaaugauacuuaucauggagacuuuuugguuccccuucccugaccuaaagggaucucucugagcacacaccuuuuggcucuuaccacauccugcccuccguugugauucuguacuuggcuuauucacucaucucguggacugggagcccuuugaacucaaaggcuaggucuuacugaucuugguccccagccacugaaaguuuggcccagggucuuccccacagcuggcccucaaggaaugcuugcugggugaauggagaaugucuacauaaugggaggagagacacugggugccgggugugcuuguuauggagguuaucugugcaaaagcugugugcauaggaugggcucccuaggagaagauaaugcagucgugaugggaucugugugggggcugugugauugagauaauguguguauagagagaguaagguagcuuugugggaaagagcucugccuaggcuggggugcaucuggggagaaugagugugcauuugaguauggaggggcuguaccgggggaaguucugugcagcccuucagcuagcugcccaguccagcucuaaaugagucuccagcagccugaggccggauaugucagucucacccacagcccucccccacugccagcgguugcggacucagaggccaaauuugguaacagacugaguguuacucccccaucccucuuauauucugacugucuuaagcucuuuccuuuuguuccugucuguaacucccuaucuuucugcaauuccccuuguggguaucugcucugacuauauucuccaaguaccccaacuuucuuagcuccaauacucuuacauuccauuccuugcugggauuugaccuccuguccuccauucccccccuccaauugcccaacuucuuuggaaugcaucgcaggaauguauugagggaggaggaguucccugggagggggacacggcaguggggaguugcuguuccaucaaacacaauggaaaagggagcaaaguucucaggccaaaggaggaaugagcuagcuucuacucauacuuguagcagccuuguucuuugccaccaccacccacaauucacugaucaguucuucgcguccacacacccucuuguagcugugugaauauccacucuggaccagcuggggaguaaggguaggcaugacucagcucccuuaucggggucucaccagaggcuuccgugcuugaggaggaagggggugucuaaguguccagaggaaauggggggagacaugcaguuucagcuuagugugaaggguccuuucaguccugcuucuuggcuccacagacuccuccagcuucucggauccaccagcccagcccucauucuuucauggucagcaaccccauagccaggucuguccagcugggacacaagcggauaguaauaagguugggcaaagugccccaggaguggggagggggcagagagcuggaacuggggagacugggaggguccucucuuauuggggaguaaagacagagagcugugguucuucucuuuugagacucuggacugcuuguaaggucagaaauggucuaucugccacuugguaccagaccgcugaucuagaccauuuucauaccugccuccugucucuuguuucuacuuagauuuucaauucuccucaucccaucucuccuaacuucuuuacccucuaccccuucuuaacuucccuggcuuucaaaugccuucuguauccuaacacccccaucucugcuuuccagccuuccccucucacccugcuuuuccccauuugaggcuuguaguuugccaggaggggaaugggcagcuuguauuugcccauucucuuaguuaagaggcacccaaucccuguaccaagcaggggcacaucagcagcagccgggcagacuuguccucuugcagccugugcgccaccugcugccuccagugccuccucuagccugcugagagggggugccaggaggguggaagaaggugggguaggacuaguauucugagcugcacugaaaauacagucaggggaagugggugagacagagcagaauucgagacagacuugcugaagaggagaaagcaugggaggaguugcaggacugaguauuaacuugaugacuuggaacaagcaaggacugaguuacagggacuggguccuuucucuggccugucuugaaaauguuuccuggccucccagagucuauuuccccuucuccaaaacacaagaguugaccagauaacuucugagauagaucccuuugaguuagagaaucacauuucuagcuugacugccugggaagcccaguacagggcuaggcuccuucagaaggcccccgcaucucagguuagaaaaaagcuggggcaagagcggaccccugaauggcuugagcaaccaguauuuggucucccugccaggcuagcuagaguuuguuugcaggcuucaagagccuuagggaauuauaacaucuucauuuugcagagaaggcagcuaaagccaugagaaggaaggucacguggugagaagagagcucugaaaaucccggacagggaagagccagcaggacacagcaggagacaaagagagaaaaauacugaaccaggcaaaaaugaaaagaaggcaggaguagggcugagaaaggugaucagggacaaggggcaagagagauacuuggaugaaaguagggagguacaaauuccagugguggggcagggcaguguccucagguagcacugcauuucagaccugcuauuguaccuugcagaccagcuucuccuuucccucagaugucuuaaauuguuaggacuuggccgggcgugguggcucacgccuguaaucccagcacuuggggaggccaagguggaucacgaggucaggagaucgagaccauccuggcuaacauggugaaaccccgucucuacuaaaaauacaaaaaauuagccaggcauggcagcgggcgccuguagucccagcuacuggggaggcugagacaggagaauggcgugaauccaggaggcggagcuugcagcgagcugagaucgcaccacuguacucuagccugggcaacagaacgaaacucugucucaaaaaaaaaaauugucaggacucauucuuuugauguaaauaauuuuucacucuuuaaaauuauuaaauacaaugaaaacaaccuuauuaccaucuacuuuggugagucccuuucaaaaacacucuucccuuggacuccaccaucuggggggccucuucucccaccagaagaguguauucuaaugcccugaugccaugggucagguauagccaggcuggagaaaagaagcugccaccaugguugcacuuucacugaagaucagcauugggaauguggugaagacgaugcaguuugagccgucuaccaugguguacgacgccugccgcaucauucgugagcggaucccagaggccccagcugguccucgugagucugacucccccgguggcuggagugggagucuucagucccuucuuguucccaggcucucggccuugagaguugaccccuuuguccccuaagacuacucaccccucaggucuguguuccaugguucccucguucuuuaggcccaaggucaugggagaaauagucaggggcaacaugguacaagcuguucagccacauuggggucuucauaagccuaaagugauccauccucucuuuuagccagcgacuuugggcucuuucugucagaugaugaccccaaaaaggguauauggcuggaggcugggaaagcuuuggacuacuacaugcuccgaaaugggguaaguauccuuucaucaaggaccaccacauccccuuccaucagcuucucccuguuccaccuccuguuuucagcacccacaucuguugucucuuagcccuccccaugcuuucuuccuauuaacagacagucauaauucccugcuuuugaacgaaccaccauagucuuccuuucagugcuccacucucuccccucgggcuguguaaagaggaaauaauaccccuagcucagaguaggccccugucucuucuuccugcccuaacaggacacuauggaguacaggaagaaacagagaccccugaagauccguaugcuggauggaacugugaagacgaucaugguggaugacucuaagacugucacugacaugcucaugaccaucugugcccgcauugguaaggggcccuaguacaguugaaagccugggccagaaagccucaacucucucaaaaggcauggaugcaguaccugggaagcuaacaagccaucuccuuccucaggcaucaccaaucaugaugaauauucauugguucgagagcugauggaagagaaaaaggaggaaauaacagggaccuuaagaaaggacaagacauugcugcgagaugaaaagaagauggagaaacuaaagcagaaauugcacacagaugaugaguguaagcagaacuagaaaaaagagggcuuuugaaaugggaagggugggaaggggcuucagcaucugcuucugccaggcacuguuuuacacccuggggauacaucagugagaaaacaaaguccuacacucaugggacuuacauuuaagugaggggagguaggaaaugcagaaauaaacagagaccagacagcacaggggccauggggguuuggcacugaggggacugucuguaucccagugaacuggcuggaccauggucggacacugagggagcaggguguagaggagcacgagacgcugcugcugcggaggaaguucuuuuacucagaccagaauguggauucccgggacccuguacagcugaaccuccuguaugugcagguaugcagaggacuuggcugggguggggcaggaauagggagggcucggaagcacagugugcguguccuugcacccacacacaacauucgccuccuugcccugugcucuccaggcacgagaugacauccugaauggcucccacccugucuccuuugacaaggccugugaguuugcuggcuuccaaugccagauccaguuugggccccacaaugagcagaagcacaaggcuggcuuccuugagugagugacccacauccuauacccugucagggcccaggacucccugccauugugaccccagugggccugucuccauuccaagccugccccccacuauuucuucuuccgagguaccaggguuugaccaacauagcuacccuuuuaguugccaucauccauugucucuucucugccucuggaauaugaauguaguucaguaucucugccccuacccccaucucugaagcaagcaugucacucuuuuuugagauuaucugaagaauuuugcugcaguagccagagggaaaccggguaaaauuuucccuauagggaacauggguuaaaagucucacaagccucaucugcugguguuucuuggaaugcagaguuuggcguggcuuucucagcuuccuaagugcauguucauccuucuagaaagcucuuucuccucuugguucccugaaauggugcucuagacccacuuucccucagggacugagccucuaacuuaauuuuccucagucccuuucccuacagggagagacacaggucacauuaagaauucauacuggccaggcucgguggcucacaccuguaaucccagcacuuugggaggccagggcgggcagaucaccugaggucgggaguucgagaccagccugaccaacguggagaaaccauguaucucuacuaaaaauacaaaauuagccaggcgugguggcacaugccuguaaucccagcuacucgggaggcugaggcaggagaaucacuugaaccugggagguggagguuuuggugagcugagaucgugccauugcacuccagccugggcaacaagagugaaacuccaucucaaaaaaaaaaaagaagaguuuacacgaagucaccucuauuucagaagauaaucuagacucuauucccucagagucuuuuuucuccccaaagauaacacuguccuagguauuuccucauacccccaggcccacaguucauggcccacauguccccugaugcugucuaccacaugcugacccucccuuuucugguguagccugaaggacuuccugcccaaggaguaugugaagcagaagggagagcguaagaucuuccaggugaauguggguaggggaaaguauuugggaugaccgcggagcuuugcugcuuaaucuuacugacuaaauggcccccugccuccuccccgucuccccuaacuuggcuuucacccaccgggcuguuaucccaccucaccucugccaagaaagcagacagcuugggcuuuuagucucagcuccaucccugcuuuugcugugcaauucaguucaauauucuuguaaucuuuuauuuaccucugauuugggauaacaguacuugccccguguaggacugauaggaucaaaugagguagcauaaucugaaauuacugugaaagaguauagucuuuguccacuauaagguguuacccccacucugaauacucagcccagaaggccuucucuuugcccuucuacuuccaaacucucuguucauaucuccagaaugucugcaaguuccuugacuguaucccuugacucaucgcuucugcauagcccuuaucagccuccaucccguuacccucucguucucauaucuuguacuccucaaccuuuccaguguccccauaauucucucucguuagaguuagcauccaaccuuaauuccuuagcugugauaugaaacucuuugcuaaauucuuccccauuuuaugcacaggcacacaagaauugugggcagaugagugagauugaggccaagguccgcuacgugaagcuagcccguucucucaagacuuacggugucuccuucuuccuggugaagguagguuaugggcccuuuucacugcccuccuuguuucccacucuugcccuuuucugucucugaaagucucuggccuugcccucagucacaucucccaccauucccuaagauucccauucucuuccuugcucugaccucaugaaaaccugccugucaucagcccuacaccaccacuucccucccuacccugcauuuucccuuguccguuagcccucccggccaccucaacauccccuauggcugcaagcugaucugaucauucaccucucauuugaccucugaccuguaacaccaacaccaaccucugccucauaggaaaaaaugaaagggaagaacaagcuagugcccaggcuucugggcaucaccaaggagugugugaugcgaguggaugagaagaccaaggaagugauccaggaguggaaccucaccaacaucaaacgcugggcugcgucucccaaaagcuucacccugguaagucuggggacuauaacaagaaagugcuuugggaguuucauuaaaggggcagcugcagaggucucuucccucucuugggguaaguauacugaguauuacuccagaaaaaaaggagguuagaguagauggagaaucuuccucugggagagugugaggcuuaaaugaaacggaugauggacuuauucuuuaaaaucagcagaacaaaaaucucaucagcaagcugagaucacaggaauucuuguagguguggugaaaggaaaaaugugauaaccucccuguuucagcagcagcuauauacagugaauuuuugacuuuauauuauaggguuaugaauugaaaacugauaucaacuugauaaaguacccuaaugacacaaauacaaauuauaggaaaugcuguuuuuucccuuuuggauacuacagccaaccuuaaaguguggccauuuuaugccaaauauuauauccucucaauuuuaucaucagaguaaaaauaagagacuuccuaaaugauauguauuugaaacuguguaguguagaggccacuccucagaaguaaaaaauuucccuccaaggagaaaauaaagaggagguucaagaaaggugggcaucuuccaagagggccguugccacgggaaggcaucucaucagcucaaccuugggccucccauccuagccauuuccauccuggauagauuugagcuuucccucugagucccccacuugucacccuaggauuuuggagauuaccaagauggcuauuacucaguacagacaacugaaggggagcagauugcacagcucauugccggcuacaucgauaucauccugaagaaggugagcacugccugcccuagccuucuccuuaucgccucuugcccucuccacaagccaguccuuuagaaaugggcacucagauugcuugaaccugggaggcggagguugcaaugagccgagaucuugccucugcacuccagccugggugacagagcccuuucuugucaaaaaaaaaaaaaaaagaaaaagaaauggacacucagcuucuggaaaauggcugguuauggaaagaagaggcugccuuuucuccacuucccucuucuuuaacuaucccaacucuuguuccuuuuuccuuccuacagaaaaaaagcaaggaucacuuugggcuggaaggagaugaggagucuacuaugcuggaggacucagugucccccaaaaaguacgaagggaguugggcugaucccauuucccagggguagagaaggcaaggccugacucuaaggacucuugggagguggggaguccuuagaaugguucuuuaacuaguugcaggcuguagugagaccucacacaccugcaaagguaguguaaccgggugggacggguagagaugaggaguccucugugagcucaauaguucaccccucuacaggucaacaguccugcagcagcaauacaaccggguggggaaaguggagcauggcucuguggcccugccugccaucaugcgcucuggagccucugguccugagaauuuccaggugggcagcaugcccccugcccagcagcagauuaccagcggccagaugcaccgaggacacaugccuccucugguaagugucccacuuccaccacggugccagggcccuucucucacccucagcugggccgagccaggaguuaggcagucuuuucccaggucccuauuuguauucucucccuagacccugguucucuuuuaccuucucuuuucuccaaacauccauuccagucccuguuucuccccacuugucuuuagacuucagcccagcaggcacucacuggaaccauuaacuccagcaugcaggccgugcaggcugcccaggccacccuggaugacuuugacacucugccgccucuuggccaggaugcuguaaguaugggauggaggagaggccggugguacugaagcugagacuccaagggauagggaugaggugaaccaaaccagggcagauccugaaggcuuuuccucucucuuucaggccucuaaggccuggcguaaaaacaagauggaugaaucaaagcaugagauccacucucagguagaugccaucacagcugguacugcgucuguggugaaccugacagcagguaggccggaugcuagcuuccgggugugugauggggagagggggugcaagugugcacaggcaugcaugugacuggcuucaugugugacugugccuugacucacuguggaagggacugugugugugcgucuuucuguggacaugugugugacuaacugggugugacuuugcucccuccccagcccuucgucuggccugcccugucucucauguuccucuuucuccuuuuccccuuaggggacccugcugagacagacuauaccgcagugggcugugcagucaccacaaucuccuccaaccugacggagaugucccguggggugaagcugcuggcugccuugcuggaggacgaaggcggcaguggucggccccuguugcaggcagcaaagggccuugcgggagcagugucagaacugcugcgcagugcccaaccagccagugcugaggucaggggccacagguuuggguuaggguggagacaggguucaagcccaaggagaaggggcaguccaagccacaggauggaagccugggucccgugggccugugauaugcacaggcaugugggcagggauugggcagcuucugacugguguucacucuccacagccccgucagaaccugcugcaagcagcugggaacgugggccaggccaguggggagcuguugcaacaaauuggggaaagugauacugacccccacuuccagguuggugacuuacccaaccccccagaaccccagaaucuaggaaguaacuucugcucgugaauccaguuccuaguccuggcuucugugaauugaccccuaaaaaccaaucugaaccucuauuuccaggggaugauacuaguaacuucugaucucucuuuuagggguuagaauucagaaccccugaauccaaacuuaaccugcuaguuuacucuuggcccucauuuauucuuuagccccuugucaucuuuucucucucuuccccguacauagcccuugccccaauuugaggaccccccacaaugcuauagaccaugccacccugagaauaguguuccucuagcucucccccuucccgcuccaugccaauuuccucagcugacuuuucacccuggauuucccaugcagauaugugcauccagaggggcugggguucgaucuccccccgauuccccuacgguaacagccucuggccugggccuucccagcuuuguccucucugagccgcauacacucguuucuguacuucuuccucagccuccugggggaccagaacuuggugggagaugaggaggccuggcgaagccaggcuuugggaaaugggaucagguaggguaguacagggacuugcucccaagacuccaggaugaccacuuccaauccaagaucaagaaguggaguaaagaagcuggggguggagggaucccaggagauaccuccuaccuccucuccccaccccauuguaacagcgccaccacauugucuccccgucaucaucgaguguauccgccucaugugugucuccauuugguguaggcuguauuuucucuugguguggguuuguuccucgguggggguucuguccugcugggugcucagggcaguagcucgggguagguucugguugcuucugcguacacucuccuuugauuggaucagugggaauaaugaagcagcuuacgccucugagaagugucugugaaucccaagcccaaucucaggucaugcuaacugcuguuuucucacaggaugcgcuaaugcagcucgccaaagcuguggcaagugcugcagcugcccugguccucaaggccaagaguguggcccagcggacagaggacucgggacuucagacccaaguuauugcugcagcaacacagugugcccuauccacuucccaacuaguggccuguacuaaggugagccccaaagguugcucuaguccgugcugagggguaauacuaccacacacacgugagccuuucauuuuauuucuuuggcucuggaggccuccucacccaucccaguuacugcuaugagcagcauacucuaccuccuuucccuugccuacgucucugacauucacuuuaccuacaggugguggcaccuacaaucagcucaccugucugccaagagcaacugguggaggcuggacgacugguagccaaagccguggagggcugugugucugccucccaggcagcuacagaggaugggcaacuguugcgagggguaggagcagcagccacagcugucacccaggcccuaaaugagcugcugcagcaugugaaagcccaugccacaggggcugggccugcuggccguuaugaccaggcuacugacaccauccuaaccgucacugagaacaucuuuagcuccaugggugaugcugguaagacacgcacccccaggaaaacaaaaaacccuaccaggguucccuaagcccacuggacaucauccccuugcggaccuaaccacuucaccccaaggaacucagcacagugugggcuugccagccacacaaccauaggcucaucauuaaagcucucugaacccucugcuuccccuucuguaaaaggaauauuaaguccucuaccuucccuggagcauuuaaagaauauaccaaaguacgcacaaaaauauauagaaagugacaugaaagugguauagccuucccuacuauaccccugaccccaaaaguuuucagagagugucucaucuucucaaggcuacuggcugaaaauacccauuggagacuguccuucucccguaagaacccacuggagaaucuuuuucuccaagauccuaaacccagaaaaaaaauagccccaaagaaaugaugcaagagcuuuugccagucucuuuuucugucccuaaagcccccaucuaccuugucuacaccacuuuuccccaccuuuguccccaccccugacaccucagugucucuggcuuccucgccugacugugcccuaugcucucaggggagauggugcgacaggcccgcauccuggcccaagccacaucugaccuggucaaugccaucaaggcugaugcugagggggaaagugaucuggagaacucccgcaagcucuuaagugcugccaagauccuagcugaugccacagccaagaugguagaggcugccaagguacaaagccuucugugcacacucccagacuggacccuagagggaaguagagcaguccagauggucacccucaucugaugagggagacccaggaaaagcagaaaacacaagaggacaaauauaggagcacucaggaaaugaaugagccccaaggcugugggugagccaugacccaggcuuuuuuuuuuuuuuuuuuuuuaaagauguggucucacuguguugcccaggcuggucucaaacucuuggacucaagugauccucccaccuuggccucccgaaguguuaggauugcaggcaugagccaccacaccuggccuaaaauuauuuuuuaauugacauaauuuuacauauucaugagguacauagugacauuucaauacauguauaguaaucagaucagaguaauuaacauauccaucauuuauccaaauauuuaucauuucuuuguguugggaacauucaguauccucccccuagcuauuuggaacuauauaauagucuuaacuuuagucauccuacagugguguagaacgcuagaacuuacuccuaucuagcuauaauuuuguguccuuuaauaaaucucucccauuccucuguaguaggcaaccagauccuuuuucuuuaaguccaaggucuuaaguccaaggccuauuuuuaccuucuuugcugcuacccugccugggauuccuuuccuuccuggucuccccugugaauacacauaggcauucagucucuggggccucugcugccagcaggacacugagacaccagcaugcagagaaccaucagaaagaagcccagaugauuccuaggcccccuggacucuggggcuuuucaguuggcaggaguaagcagguccccugcuuugguauuccugagaugccugcucuaaacugaguccuccuuuguccaggaagcccuacucaccucacucgugugguauuccccaaggaggggaagacaaaacaauuccaccuuaagaaaggauuucagcauccagugggaauccuagcccccugagguuucccauugaccuucaugagucagcuccucucaaaggugauugccuuuugguggggcuaguuagagaugacuucaggaaaauacaugaauuuuaaacugagucuagaggagugagagaggagcuucuuuaggauccacaggagagcugggugaugacugucuuuccaccucucccucagggagcagcugcccacccugacagugaggagcagcagcagcggcugcgggaggcagcugaggggcugcgcauggccaccaaugcagcugcgcagaaugccaucaagaaaaagcuggugcagcgccuggaggugaggcugggaguuucaccaggagcaagagagagugugggugcugugggaggaaugaacugaaagggaggugcggagaguaaguuaauacguccuugaggcauaaccugggcaagguaggccagggacugggcugggcaugggaauccaugggcuuggucugacuacucuugucuucacagcaugcagccaagcaggcugcagccucagccacacagaccaucgcugcagcucagcacgcagccucuacccccaaggccucugccggcccccagccccugcuggugcagagcugcaagguaagacucuaggaaggaugugggaguggaagagggagacuugugggucucuuaugacauuuucaccuacaggcaguggcagagcagauuccacugcuggugcagggcguccgaggaagccaagcccagccugacagccccagcgcucagcuugcccucauugcugccagccagagcuuccugcaggcaaggcacccccucugcacuucucugaccugaccuucccaccuuucuaagcuuccaucucccacaguuugaaucucugccaagagccucuuucccaauaccaagccccaguguucccuacauccugaccaucaucaguccuuguacccaagcccagagggaggauggcacacuucauccaccugccuauuccccaacagccaggugggaagaugguggcagcugcaaaggccucagugccaacgauucaggaccaggcuucagccaugcagcugagucagugugccaagaaccugggcaccgcgcuggcugaacuccggacggcugcccagaagguauggaagcugguucuggcuuuggaagaugaggcuggaguccugugaugagaggaaaucugugcagaauaacccaauacgcagauaauuguguaaucagaggcauuggugagacacagcaggaccuucuacacccaaaaccccuuucuuaucauaggcucaggaagcauguggaccuuuggagauggauucugcacugagugugguacagaaucuagagaaagaucuacaggaagugaaggcagcagcucgagauggcaagcuuaaacccuuaccuggggagacaguaaguauguuuaagaccucauucuuacucaaauccuaaagucuuccuucaccuccgugccccagagcugcucaaaaccuuuccuuccuuccuuuuucuuuuuucucuuucucucuuuuauuuuucuuuucuuucuucuuccuuccuuuuuucuuucucuuucucucuccuuccuucuuucuuccuuccuuucuuuucuuccuuuccucuccucuuucuuuucuuuucucuuuucuuuucuuuuccguucuuuuauuucuuuuucuuucuugauggagucucgcucugucaccuaaacuguagugcaguugugcaaucucagcucacugcaaccucugccuccuggguucaagccauucuccugccucagccuccugaguagcugggauuacaggcaugcaccaccacgccuggcuaauuuuuguauuuuuaguagagaugggguuucgccauguugcccaggcuggucuugaacuccugaccucaggugauccaccugccucagccucccaacgugcuaggauuauaggugggagccaucgcacccagcccaaaacauuuauuuaaauugccaccuguccccaaguaccuucucagguuccuucuccucaccuucuccuuucucaagcccaauucuucccccuucauccuuagauggagaaguguacccaggaccugggcaacagcaccaaagccgugagcucagccaucgcccagcuacugggagagguugcccagggcaaugagaauuaugcagguaugugggcagagagccaggcauggggcauauugugagggagguaggaaaaugggagcuggaugagggaugggacugacagacgaaaccacuggaaucagggccuggcaaugaaagcaccuucccuucccucuuucuccucaucucccaagguauugcagcucgggauguggcaggugggcugcggucacuggcccaggccgcuaggggagucgcugcacugacgucagauccugcagugcaggccauuguacuugauacggccagugaugugcuggacaaggccagcagccucauugaggaggcgaaaaaggcagcuggccauccaggggacccugagagccagcagcggcuugcccaggucagauacugggaaagggccacucccucucccccagguuccuucauaaggcccacccugauugaggccaaagcuucugagccucguccacacucacagagugaugucuucuugggucugcucuugacagccccucuguggauuccacccuuauguucucuuagucuuuuuuuuuuuuuuuuuuuugagacagaguuuugcucuuacugcccaggcuggagugcaauggcgcaauuucggcucagugcagucuccgccuccuggguucaagugauucuccugccucagacucccuaguagcugggacuacaggcaugcgccaccacacccagcuaauuuuugaauuuuguuuuaguagagacagggcuucaccauguuggccaggauggucucgaucucuugaccucgugaucugccccccucggccucccauagugcugggauuacaggcgugagccacugugcccggcccucuuggucuuguagaagugucucaguuggauucagucaugggcugagcuaaacaccaaguuuggggaaguuuaauuacugucacuugaaacccuaaccucagccuguucaccuacaacgcccccuuucuuuuuucacuuucagaggcaguagagcuagucaucucccaugucgcgugaauggaggcgaucucucaaauucuuuucacuugggcaacccugucuccuuucucaccccagguggcuaaagcagugacccaggcucugaaccgcugugucagcugccuaccuggccagcgcgauguggauaaugcccugagggcaguuggagaugccagcaagcgacuccugagugacucgguaggaggacgguagggggugggggaacguaggagucaaagaaugccaggccucuccuuccucccucucgguuguccuuugacccugacuucccagaucuguccccuuucauuacucccaggcuaugugcccaccuuuucagcccuccuuuaccagacuucucccugcaucauuccccacucuucugucugacuuccccucucaccuugcagcuuccuccuagcacugggacauuucaagaagcucagagccgguugaaugaagcugcugcugggcugaaucaggcagccacagaacuggugcaggccucucggggaaccccucaggaccuggcucgagccucaggccgauuuggacaggacuucagcaccuuccuggaagcugguguggagauggcaggccaggcuccgguaugaagaggcagagggucugguugaaugguucccacuaaggguuagauaggaggcaguugagugaccaguccugacuugcuccuggcucccuucccuccccagucucuagcacuacuugagugucugggaaagaagaucccuuuuagagacagauaagaaaggacaggacaaugcauugaccuugucaccuucaacagagccaggaggaccgagcccaaguuguguccaacuugaagggcaucuccaugucuucaagcaaacuucuucuggcugccaaggcccuguccacggacccugcugccccuaaccucaagagucagcuggcugcagcugccagguaaguaguugcugagaagcccagcccuggacugugugagagagacuggggagcaggcaguucaugagagcuucuuggcuuaggaaugguuauaggcaaaagauaaauacuuacauaggacccaggaaugaugaccuauucaccuuuucacucaacuuucugucacucccagggcaguaacugacagcaucaaucagcucaucacuaugugcacccagcaggcacccggccagaaggagugugauaacgcccugcgggaauuggagguagacacauggcaggcugauggcauugagguugagggaaguguucugguuuugggccugagggaggugucuuggaucucacuuugcccucccccuacacagacgguccgggaacuccuggagaacccaguccagcccaucaaugacauguccuacuuugguugccuggacaguguaauggagaacucaaaggucagcacagccaggaacucggaggagagagggcaguaggauggagcuaaccagaugcugcccugggguucugaggacaugcucugacuccccugauguccucuguuccucaggugcugggcgaggccaugacuggcaucucccaaaaugccaagaacggaaaccugccagaguuuggagaugccauuuccacagccucaaaggcacuuuguggcuucaccgaggcagcugcacagguuauuuuccugagauggguucuuugaauggccccuacuuucuuuaccccauuuucucucagccugacauaccuguagauaaaucaagaaguuuauguuugcaaagccaacucuauggaaucuggguuguccuccuccugaaguggagacacuugucagcaauuacugaacaccagcaguucugauuucuguaauuccugaacccugguacuuugguuaggauuacacugcccaaccgugaggccuuuuccagcuggcuuucucaaaauauacuaauuagcuuauacaaacuauuuuuucauguuauuacuacuuucuuuuuuuuuuuuuuuuuuuuugagacagcguuucgcucugucgcccaggcugaagugcaauggcgugaucuaggcucacugcaagcuccgccucccggguucacgcuagucuccugccucagccuuccaaguagcugggacuacaggcgcucaccaccacacccggcuaauuuuuuguauuuuuuuuuuuuuuuuuaguaaagacaggguuucaccauguuagccaggauggucucgauauccugacucgugauccaccugccucggccucccaaagugcuggaauuacaggcgugagccaccgcgccuggccuguaaucacuacuuucuuuuuuuuuuuuuuuuuuuuuuuuuuuugagaccgaguuucgcucugucgcccaggcuggagugcaguggcgcgaucuagacucacugcaagcuccgccucccggguucacgccauucuccugccucagccucccguguagcugggacuacaggcgcgcgccaccaugcccggcuaauuuuuguauuuuuaguagagacgggguuucaccguguuagccaggauggucucgaucuccugaccucgugauccgcccgucucgaccucccaaagugcugggauuacaggcgugagccaccgcgcccggccaaucacuacuuucuuaaaauaguacuagugacaaaauuuccaguuacuugaguuaucacuuaacuuugccuuuucccacauuaucaaguauaaaacuaccuauuagcuguaaaguauuuugcuuuaguauaugaauccuuaaaacaaacuggcaucauaagaguucacuucagacuauuuucccugaaagccuaccauccuagcccuccaucuccaccaccucccugugcccugucagaauaggcgccuugcucuagauggcuuguuugauuuuguuuuuuuguuuuuuugguuuuuuguuuguuuguuuuuugagacggagucucgcucugucgccaggcuggagugcagaggcauaaucucggcucacugcaaccuccgccucccggguucaagugauucuccuaccucagccucccgaguagcugggacuacaggcgccugccaccacacccgucugauuuuuguauuuuuaguagagacaggguuucacuaaaccucuuuguuguuuguuugguuuuuuuccccccaccuucugaaaaugcauagaggaaaaagcaaagcuacuguguauugauugaaguaugaaucaaacauuaggauguucuuuccaucauaaaaauggcuuuuuaaccccucccuuccuuuccaaauaucugacgcauggaggugcuauaaaugugaauuagccuaauaaccuucaucaguuuugaacugucuuuaaaagaggcuuugcuugugugcacaaagguguguauuuauauauggcucucaaacguuuuacugcuacuuacaguaagccauacuuuucacucuaagacccaacauacacaaacauaucuaaauagagauuggauaaaaacccuugcuauguaguuuuccuuuuuauuaacuuuuuuaaucuucugaaaugcuugaauauacuuaaugaaaacaggagaguauuuuuuuucuucuuuauaguguaaccauuguuugcuaauguaucuccacucauggagaacucuggaaaauaagcccuauucucuaaacuuaccucugcucucuuuugucccuacuaucacuauucauuucccaccugcaaucuuuauuccucacccccacccccuuuucucuucccaggcugcauaucugguuggugucucugaccccaauagccaagcuggacagcaagggcuaguggagcccacacaguuugcccgugcaaaccaggcaauucagauggccugccagaguuugggagagccuggcuguacccaggcccagguaacucaagggaacagggaccacaggcgagucugggaaagggcagaccgaccccguggaguagagggaggugaggcaugugggaaagagggcagggacccaucucugaccuugcacacacagcuucuuuuuggguaacugucuuuuucugccaugggucucaucauuuaucaguuacugcuaaauucacaacuucucuguagauguucgagcuuacucucccacaugcccucuuaugguuucuccauuaguaugucuuuccucucccaugcccaguucaucuuuggguaucucugucuccuagaucuugacuuuucaggugacucuguuauuccuguuuugacuccucaggguauugcucuccauccccugacccuaaaauggcuccuccuuggguauguacaccuccuuccugcccucaucguggcucuuccaugugucuccucaggugcucucugcagccaccauuguggcuaaacacaccucugcacuguguaacagcugucgccuggcuucugcccguaccaccaauccuacugccaagcgccaguuuguacagucagccaaggagguggccaacagcacagcuaaucuugucaagaccaucaagguucccauugcuugaauucccagccucucccugaccuguccuaucuucucccccgagucccccaguuauucucugaagccuucuaccaaauccccucugccugagcccaagcucuuucuauucagacugaccaccuagccucuccccaaauccuguaagucccaggaaggagaccuggacuucacuuccuauacccccuaugacugcaucccaaguccugagagccucucugucacuucuaggcgcuagauggggccuucacagaggagaaccgugcccagugccgagcagcaacagccccucugcuggaggcuguggacaaucugagugccuuugcguccaacccugaguucuccagcauuccugcccagaucagcccugaggugaggcgaugugaagggggaacugaugggccagcuuaucaccucaucuuccagggacuccugagacuuaccuuccugccuccccucuccccagggucgggcugccauggagcccauugugaucucugccaagacaauguuagagagugccgggggacucauccagacagcccgggcccucgcagucaauccccgggaccccccgagcuggucggugcuggccggccacucccguacugucucagacuccaucaagaagcuaauuacaagcaugagguauugagggauggggaaccaguguggcuggggggcauacauuguggcagaauggaggaugggcacuugagugcaaugagaugggaugguguugggaggauacaggggaaggauaggcuggccuugcaguaggggauguucuugguguuggagcccaugaugugucugcagggacaaggcuccagggcagcuggagugugaaacggccauugcagcucugaacaguugucuacgggaccuagaccaggcuucccucgcugcagucagccagcagcuugcuccccgugagggaaucucucaagaggugagagggagaggguuauauggaaagaugugucuaggaagagaaauaucagacucaaagaagcugggggaucaaggaguggcuucuuagggacaucaaaggcugggaugugcgaaggaggguuaggguauuugguauggacagaagagcaguucuuuguagccagaggguccuauugcaggucaccaucagggcuaauguccacuuccuccccaggccuugcacacucagaugcucacugcaguccaagagaucucccaucucauugagccgcuggccaaugcugcccgggcugaagccucccagcugggacacaagguaccuauggagacucaugggaagucccagggaguagggugagagagaggggaccugaccccuaguccaaccccuugccucaggugucccagauggcgcaguacuuugagccgcucacccuggcugcagugggugcugccuccaagacccugagccacccgcagcagauggcacuccuggaccagacuaaaacauuggcagagucugcccugcaguugcuauacacugccaaggaggcuggugguaacccaaagguauugaggguugggagggaggagcuguuacuagcaggaggcuggagaaacaggaacaacagagcuccucuccucuccccacagcaagcagcucacacccaggaagcccuggaggaggcugugcagaugaugaccgaggccguagaggaccugacaacaacccucaacgaggcagccagugcugcuggggucguggguggcaugguggacuccaucacccaggccaucaaccagguuagagucuuggggugccuuuggacacugaggcuacccugggccagagccuccaagcacaguggcagagacccuaacagucuuucccuuucccuauccuccccccucagcuagaugaaggaccaaugggugaaccagaagguuccuucguggauuaccaaacaacuauggugcggacagccaaggccauugcagugaccguucaggagauggugaguuugggcgagucccagaggacugcccucggagagcugacuuuggauauaacuucacucguuccauuaucaccagguuaccaagucaaacaccagcccagaggagcugggcccucuugcuaaccagcugaccagugacuauggccgucuggccucggaggccaagccugcagcgguggcugcugaaaaugaagagguaaacguggaggcaacucugcccugcccccugccccuuguuccugaugugucagugucuagggcugucccacccccacccucucuggucuuucauagaaaggggaacagccucagggccacucugcugaagacuagugaggcucuggguagggacagaggaucaaagccuucagucacagguacaaaggaaacagcucagaaucuggagccuucccgggccugccuuucuggcuucugccgacccucaucugggccuacagcugcuucucuguugugcugccaguccauguucuuguucuuucuuguugcaaacucaugaagcucuuccuuaccuaagccucuagcuuuccaagaaagcaaguaauuggaucuuagcaggacacauguaaugcccauccuuaaaacccuccauaaccccauacaggccacaugguaauccacggcccucugauucccacauucaagcauaaagugcuccuccccuucuccccacugugcuuaacacaauccucaccacuuagugccugcgugcuacuauuuucuguguguaggaggugaccuucugccuaaaggauaugcaaccggaaacguccuugugcugggaaccuucucucucugcuucuuuagucuacaaugcauguuuuuuucuauguccuuagugacuuuuccaagcacagugaagguacccugagugccccuuguaaaauccaucugucuuucccuuggcucacagauagguucccauaucaaacaccggguacaggagcugggccauggcugugccgcucuggucaccaaggcaggcgcccugcagugcagccccagugaugccuacaccaagaaggagcucauagagugugcccggagagucucugagaaggugacggugcucaucccugcagauggugggacugccuccaaacucuguagccuuugccauccuccuccagcccucucagcccucuccuguugucacuucucccaggcaugggcaaccuuuccauuucacauggcaccuuccacagucaccaugugacauucccuacccaggucucccacguccuggcugcgcuccaggcugggaaucguggcacccaggccugcaucacagcagccagcgcugugucugguaucauugcugaccucgacaccaccaucauguucgccacugcuggcacgcucaaucgugaggguacugaaacuuucgcugaccaccgguaagacaggaacugggccuaagggaggcagacaggucggggcacggggcuggaagaggcaggauagcauucgcuggaauggggaagaccuggaccaggcaccuuggacgggcuggagcggguaggggagaucugacuaagcugggcccucccucagggagggcauccugaagacugcgaaggugcugguggaggacaccaagguccuggugcaaaacgcagcugggagccaggagaaguuggcgcaggcugcccaguccuccguggcgaccaucacccgccucgcugauguggucaagcugggugcagccagccugggagcugaggacccugagacccagguagugaccugaugccccuaauuccggcuggaaucacuuccugucccgcuucuuccucccauagaccagagccaacgcuuucccacacaggugguacuaaucaacgcagugaaagauguagccaaagcccugggagaccucaucagugcaacgaaggcugcagcuggcaaaguuggagaugacccugcuguguggcagcuaaagaacucugccaagguuggagagaaugagagcaacaucaggaggggcacuggauuaacauacuuccuccuguuccuuaaaaucauuccucuucacuccucugauaccuccaggugauggugaccaaugugacaucauugcuuaagacaguaaaagccguggaagaugaggccaccaaaggcacucgggcccuggaggcaaccacagaacacauacggcaggagcuggcggugagugagagucuggggcaucagugacuagggucagagagagggauccugaaagccugugaaccugugccacacauauacucacagcuggagucacacacagucuucucucucaucuaucgccagacuuuuuuuuugagaagggucuugcucuguagccauccuccuccagccuucucagcccucuccucuugucauuucucccaggugugggugaccuuuccauuucacauggcaucuuccucagucaccaugugacuuccccuaccccagcucucccacacccuccuucuggagugcaguggcgugaucucagcucacuacaaccuccaccucccagguucaagugcuucucaugccucagccuccugagucacugggaauacaggugcauaccaugcuggcuaguuuuuguauuuuuaguagagaugggguuucaccauguugaccaggcuggucucgaacuccuggccucaagugauccacccgccuuggccucccaaagugcugggauuacacucaugagccacugugccagugagcuacauucaugucuguccccuacccacuuguuuauuccuuagcaugugacaacuguauuuuuucaccacccucccacuuucuccagucacuaguggccucuucuuaguugcuacauucaguggccacuucuuggccuucauccucuuugaauauuucgaaagcaucugacuguguuaacaagccucucuuugaaauucuuucuucugcugggcaugguggcucacgccagcacuuugggaggccagcggguguaaucccagcacuuugggaggcugaggcggguggaucacaaggucgggaguucgagaccagccuggccaauauggugaaaccccgucucuacuaaaaauacaaaaauuagcugggcgugguggcacgcgccuguagucccagcugcuugggaggcuaaggcaggagaaucgcuggaacccgggaggcagagguugcagugagccaagauggcgccacugcacuccagccugggcaacagagugagacuccaucucaaaaaaaaacaaaaaagaaaaaaaaugaaauucuuucuucccuuggccuagauacuggcuuuucucuuguuucucgaacgucauugaaucaccuuuaacuuaguaaauguggaggccuucccaggguuguacaaauagucuuccuucucucuucucuucuuuggcaaguuuaaccacuuucauuauuauucuguaagaagcagacauccaguucugaguugaguuauuuucaacugccuguuugacaucaccaccuagaugcagugccuccgaaccaugacaugguccuccuaauggugggaacacccuugcagucaugaagauuccaccucagucaucuuugacuucaccaucuuagccaccauauccaggcuguugccacguccuuucauuccuccucccugguucccuguccgcacucugguucacacuuccauacucucccgcaauuuggcuguggcaccaguuuucucccuggucucccugcuucuggucccugccacucuccucucucccuacucaucuuucuaauuucuaaaugcaucuuucuaagguucuguuuucacuuuuacuugaagauguccaaguuggaacucuugacuuucugccucccauaccugguccuuuccuggucuucccccaucucaguaaauggcaccucuuaguaacucaguuccuaaagccagaaaccuagcuucaauauauuagacuucucucuuucucucauuccccacaucuaaguuuugcuagugccccuuccaaauacagcucauuuuuucuuuuuaucuccuaccacuaccacacuguccaaaccaucaucaguccuuaacuggauuuaugcaguagucucuauccagucaccaugcuucaacacuugcccccuccaauccuccuuuguacacaguagcuaaaauuauguuuuuaaaauauaaauuagagucuggacaugcuggcugaugccuguaaaaucccagcgcuuuggaagacugagaugggaggaucacuugagugaguucaagacuagucuggacaacauagcaagauccugucucuacaaaaaauuuaaagauuagcugggcaagguggcccaugccugucccaguuacucaugagucugaaggcaggaggaucccuugagcccagggguucaagucugcagugaacuaugaucacuccagugcacuccagccugggugacagagcaagaaauauauauauauuagauuaugucacuucacuacuuaaaacccauuagugauggcucugcuugcuucuccagucucauccuacucucuuccuuucugugccccaucccccugcaccaucaguucugagaacaugccaagcucuuaucugcugcaggcucuuccacucaguucucuccagcuuuuugaacacugugcuccuuccaguucaucaggcuucagccucaaugucaccuccucagagagcccuucccugaccaccuauuugaaguaguucucaucacagcacugucucuauucucucauaauccaaaucacaguccucaguuuugcugcuuguuuauuuauuuauuaccuguguccaaaaccagaauguaagcuccaugagaacagggagcaucccuagccccuugcauagaaucugccaccuagcugaucuuuaauaaauguuugcagauugaacccguacaucaaaauauuuuaugacuuucacauauuauguaaaaguccaaguuccucggugugauauucaaguccccaauaaccuuuucuucaccauuccuauauuccagaacauuccuugauacuuuccgaugugacaucuugguuguucauguccuaccauuuaccuaaaaugcccuccuaucaucuguauaucuuuuauggccuagcucugccucucaccccuucaaggcuucucucuauuuugggaaugaaaacccagccaaaagccacuuuuguaauuacuuuugugauuucaaacaaacaaacaaacuccccaguugcuucagucagaaacaauaaccaacugccuuguuacauucacugugaugugugaaugucugcaccaaaucacaugcacacagaguucuacgcugucucauagucucagccacuguaaaaucuuucuucuucuucugcccccacagguuuucuguuccccagagccaccugccaagaccucuaccccagaagacuucauccgaaugaccaaggguaucaccauggcaaccgccaaggccguugcugcuggcaauuccugucgccaggaagaugucauugccacagccaaucugagccgccgugcuauugcagauaugcuucgggcuugcaagguagaaauccuugaggcauuuccgugaggcagcuuugggccagaacauagugggagagaaacuguagggaucugcggggccuaaagcuaacauauuacucuggggacaggaagcagcuuaccacccagaaguggccccugaugugcggcuucgagcccugcacuauggccgggagugugccaauggcuaccuggaacugcuggaccauguacugcugguaagggagggcguugcuuguuccucauaccagccucccugaauacacagcccucuuccugcaggccucgcacccugcugucuguuuugcucagaucuccucccuaccccacccucuacuucccaaaucuguucuccuuuccaagucucccuuucucccaggccccauccuucuuaucaucuuugguucucccagucaccucuuccucuuccucuuuuucuuuucuccucccuucccaccugaccacccccuucucuacuuucgucgucuccucuuucaucucaucauucuccuugcuccuugucagccggugagugacacagccccacugucucuaucacgugugaggugugaugcaugauguguacuuggauaggcagcguggaguuugagggcuaugguguggagugcucuagggauaggggugagggggccauggucugcccuauuucauagaucaggguagacccuaagaugugaugcucuuuguccccugcccgcuucuugcccagacccugcagaagccaagcccagaacugaagcagcaguugacaggacauucaaagcguguggcugguuccgucacugagcucauccaggcugcugaagccaugaagggugaggggugaccagggacagggacggauggaaaacccuuaucauggugugaucucugcuuccuggcuggacagcucugugcuagccucugaccauaguccccacagaugccagggccugaugauacuaaccaugcucccuggugcuuuugaccuccccacucugccuuagccucuuuccucuuccuucaucccaccaggaacagaauggguagacccagaggaccccacagucauugcugagaaugagcuccugggagcugcagccgccauugaggcugcagccaaaaagcuagagcagcugaagccccgggccaaacccaaggucaguccugcucccuuccucuuccacccucaccauggcaguguccccaccuucaucucugacuuuacaucucuuucugcaaccuucgcuuauugcaggaggcagaugaguccuugaacuuugaggagcagauacuagaagcugccaaguccauugcagcagccaccagugcacugguaaaggcugcgucggcugcccagagagaacuaguggcccaagggaaggugagugcuuaaauacccagaagaauggggacagguuggcacuuugauguccacauccacauccauagccagcgagucuuugaagugaggaaaaugcaggucuaaguaggcucuucuccuuccuacaggugggugccauuccagccaaugcacuggacgaugggcaguggucccagggccucauuucugcuguaagugugcaauaccacuaggucucucucaguuugagagacuugagaaggcuggaguggggauggaccagggcaaggggcauauuuuuaagcaaacucucccugcuuuaggcccggaugguggcugcggccaccaacaaucugugugaggcagccaaugcagcuguacaaggccaugccagccaggagaagcucaucucaucagccaagcagguagcugccuccacagcccagcuccuuguggccugcaaggucaaggcugaccaggacucggaggcaaugaaacgacuucaggugagaacccugacccaucccauugucccuugggcuauacugcuucaaacugucacucccgagauguauguuucuaugagagaauugagguacugucucaacugggaccguaccugaguucucaaccuaggccacuuucucucugcccaggcugcuggcaacgcagugaagcgagccucagauaaucuggugaaagcagcacagaaggcugcagccuuugaagagcaggagaaugagacagugguggugaaagagaagaugguuggcggcauugcccaggugagcuucaccccagaugcugagggacgcugucaggagggcagucauguugccugcgcuggucccaacuacccuaugccccugcugugcauccucacugaacuaaguccccgaucuccacccucagaucaucgcagcacaggaagaaaugcuucggaaggaacgagagcuggaagaggcgcggaagaaacuggcccagauccggcagcagcaguacaaguuucugccuucagagcuucgagaugagcacuaaagaagccucuucuauuuaaugcagacccggcccagagacugugcgugccacuaccaaagccuucugggcugucggggcccaaccugcccaaccccagcacuccccaaagugccugccaaaccccagggccuggccccgcccagucccgcaguacauccccuguccccuccccaaccccaagugccuucaugcccuagggccccccaagugccugccccuccccagaguauuaacgcuccaagaguauuauuaacgcugcuguaccucgaucugaaucugccggggccccagcccacuccacccugccagcagcuuccggccaguccccacagccucaucagcucucuucaccguuuuuugauacuaucuucccccacccccagcuacccauaggggcugcagaguuauaagccccaaacaggucaugcuccaauaaaaaugauucuaccuacaaccucug

SEQ ID NO: 13936 - RNA, 12857 nt, Homo sapiens
ggaagcgcccggcaggccagaccggaaagggcucgggucaucccggcgcccagggucaccuucccacgggcuggcaccugggcgcgggcgcugccccggagccggccggcgggaccuggcgcccaauccugggggacccggugccguggcccaggggccgggccgaggucccgggggcggugccuugcgggcccgucccggggcggugccuggugggcuggccccgcggcuccuccccucucugcgggcccagucgcccuuuggccgggcgagcuaaucgucggcucaaugacgacgaggcccgacccuucccguccaggaccuacagagacaaccgaaggagagcccaaggcggcuucuuugcugucgccgcccccacugaagcaagagcuccccggcuccacugaaacaccagcucauuuaagcuuuccccaacgcccggcccuccgggacgauaccuaacaacgaccggcgcccgcaucuggaauaggcuggcgagauacuuaguauccgagggcucgggacuuggcgccaucgaggucauggggacccaggauccagggaacaugggaaccggcgucccagccucggagcagauaagcugugccaaagaggauccacaaguuuauugcccugaagagacuggcggcaccaaggaugugcagguuacagacuguaagagucccgaagacagccgacccccaaaagagacggacugcugcaauccggaggacucugggcagcugaugguuuccuaugaggguaaagcuaugggcuaccaggugccucccuuuggcuggcgcaucugucuggcucaugaguuuacagagaagaggaaacccuuucaagcuaacaacgucucccuaagcaacaugauaaagcauauaggcaugggcuugaggugaguagaccccauugccuagaaugccuuuggcuucacuuuguuccagcucaaaacuucuagcagaggugggaaagggcaagaaagcaguugggcuucuugucugagugaagcggucccuaucccuggcauauuuuaggccugugguuuuggaccgugagaccaggucacaucucuuugcaacacccuucccucccaguguuuugucuuuucagaaggaaaggguaggaacauuuggucaugcaaucagccuuucccauucaggcucuucucacauacugguuuccaaugacuucccuuugggauuagcuauacuuuguggcaagguaggaaaggauaaucuggcugcugugauacuaacacaauguuguuuuauuugggggugggggggucucaaccccuuauuucccacaagcagcuggggcauucucuguaccucauuagacacacuguuagagucccaacacuacugcuucuuucuucaagcuuuagcuccagggaguagguaagaagagccucccugcccucaccucugaagugaugagaaggugcugucauucuguucugggauagagagcucuugauauuaagucauuuaucagagaggcacugccauagauguagaacccaucuagauccccacugaguucaaagacuagugaugaggagccagacccauuaacaggaacagguggaugugaggacagaaagcaucacccugaggucauccugacucagucuacacaauacacacagaacuguggagggaggcauaaagcuugggaaacccugcccuuacaguuucuagaguaggagacccuucauuuccccagucagugcuguggggcugugauggggagaucaguuaucuaacccuagcccuggggagugggaagggccugaugcugccugcacaucuggcuuuguuggugccuguggguagccuguagcagagaagaaucaucccuccaggcugcuucuggaaucaauucaguccaaguuugaccccaaaaguuuuugcaucaaaauaggaucuaguguacauagagaaguacacugaguugcaugugguaggaacaaugagaucaagaaaagaugggcauccuagccucuuagcccuuaaauaugaacugagucauagaggccugaagcugugcucaacccccuggacccuggcuccccauuccaggauagagugggggguacugauacaaggcuuuuggaauaggaugaguuccuaugaggagaaagcacaggugagacaagaauucuaagugauaacucuugaguugagguugaaauuguggagaaggccaaauaggucaggaauggccagcuaccauauuaagggaguaagagagcuccuaagauggagcugaacugugggcacucugaccaggagcucuagcaagacagaauucucugggucuuaccuucguaagaacucaauuucaauuguucucccuuccagccagaguccacucauucaauaaauauuuauugagugcuuguuccaugccagauaguccuuuguucugucuguccucauagauugcaguuacucucccugguugcccuaauccucggccacacccucccucuaccaguccuuucuggucucuaguuucaaaguccgguuuucucuaagcuggcagagaggauucucugccuuccugucaucccauccuuugucuucccucuucuuuccaccccuagaaugugcugucccuuuuuauuuuauuauuauuuuuuuuuugagacagucuugcucuugucacccaggcuggaguacaauggugcaaucucagcucagugcaaccuccgucuccuggguucaagcgauucuccugccucagccuccugaguagcugggauugcaggugccugccaccacagcuggcuaauguuuuuguauuuuuaguagagacgggguuucaccacauuggccaggcuggucuugaacuccugaccucacgugauccgcccaccucggccucucaaagugcugggauuacaggugugagccaccgugccuggccgcugucccuauucauuaaucacauuucuucuccucugcuccagucuguuaucucucuugugccccaucauuuguauguucauucaucuguaaaauuggcaaauaugcauugacugcagaccauauguccuacccugugcuuggaccugaggguaauauucagcuagucuuugucauugucccuuuccccaaggaacuuaaaaguaugucagccucacaugaggaacauugaaauaacaaggcaaugucugauuaggaauugagauaacaguuuguauauaugaguaauaaucauaccuguacuuuauggcuuucuuaucuauuaugucauuugaucuuucaaccauuucauuagauagcuagagcaggugguauccccauuuuguagaugaggaaacugggacuuagggguuacuuacccaauuauuugguuagaaguggugugacugaacaguaggcauaauguggcaguaggcaggagaguggaaaugggaaagagucuggcagggcaggggcuacuuagugaggacccaucuggaaugagaauuuguaggaaauaagauuagaagauaggcugggacagaugucagagccuugaaaacagaaucguuugccuauugaaaacagccucaaucauuugccucuuggauauagggcuguaccaagcccaggaaaauguugggauuuuuugaaggcuuuaccaagagcaaaaucagaaagcuucacaguuuaaauguugaauuuaaaaaaaaaaaaaaaaaaggcuugagaggaaauguccagaaauaaauauaaacacugauugucuaugggugagauuauuuuuuucccccuuucaccuuucauaauuagaaagaaaaaugaucauuuuaaaaagaagaaaggccagaagcgguagcucacgccucuaaucccagcacuuugggaggccgaggcgggcggaucaccugaggucaggaguucaagaccagccuggcuaacauggugaaaccccaucucuacuaaaaacacaaaaaaaugugccaggcaugguggcgggcaccuguaaucccagcuacuugggaggcugaggcagaagaauuucuugaacuugggaggcggaguuugcagugagccaagaccgagccacugcacuccagccuggacaacaaggaacgaaacucugucucaaaaaaaaaauaauaaauaauaaaaauaaagauaagaaaguuauucccagcagccuaugccuguuuuggagguaggggauugggggcggaggcuguaggccaggaaaccauaaaugguccuuucagcacgucagacagaagcuccugauguuggaaauaaagcaguggugguggugcuagagagguaaggagagaucagaaagccccuucugaggagaacaaaggagagaaacaaagccacuccuucacuucagcuggggugacugggaagaugaagggaccuugaacuguauagaaaucaagaggaagaaagguuugaaagcagauguccuugggacauuuaaugggaggucacagagagaggcaggugacucagccugugaacagcugcccaccugcccccuuccacucacauugccucuugcuccucagguaccugcaguggugguaccggaagacccauguggaaaagaagacaccuuucaucgacaugaucaauucuguaccccuaagacagauuuauggugagccccaccccaucucugcucugcucagagaaggccuagccuccaggucuaccacaguuaggaagagacuuccagcuuaugcaaauugcacuguuccauccccuagguuuucagaggaaccaggcuuuauagucuagaaaguuagaaaugggcuuauuuuccucucccaauaccccacuaaccacccugauuucucuagguugucccuuggguggcaucgggggaggcacuauuacccguggcuggagaggccaguucugucguuggcagcuuaacccuggaauguaucagcaccggacagucaucgcugaccaaguaagagccaggagguggagaggccaggacaauaccuccccaggccaagaaggaaggaccucuuggcuaguguagaagguagcaguuagaugugaauaagauucaaucuaauaaguacucucgggaugcuuccugugugcccagcccugagcuaggauauaccguaggaauaagacacacacaagcacacauuccuugaaagaguaaacagaucuggcauuucucuaguaaaugccuccugucuaccucacugccccaacccaacuagcugaggcagcccccaaccacagagaaugcagagaauucccaaaucacuuaaccugccugaaagaacauuuuguaggacuggaagggaaaagaaaacccaaagucuauaaacucaugggaaaaaaagacacguaguacaagguuccucacccugauugaggaaccuucaccaaaguucagcuccucugcugaucacuccccuggaggucuccuggcuuagggucuaaaaagcuccuucucucccaggcuuagaucucuagccuucuucccucuucugaagcuucacuuuuuuccuuuugcuccugcaucacaucugggccuuaaauugccagaaguauguguccugccucucaucaucucucucuaguugaccgccccuuuagaguugccuaggaaguuccucuuucuuggcuccagcauucagccucaucuucaaaggaaaaaugacuagcaaaucuuuaguccaauuaaugacaauacccuuccugguucacguuuaccagcccugcccaugucccaagaucccucucugccucaucccuuagguauccugaggggaauggcuuccagaauugugacucuacaauuaaaguaauuauugcaugcuuaacaugugcuagacacugugcuaggcucuuuguauacuguuuaauauuaaaaacaauccuacaagggaaguaccacuauuaugcucauuuugcagaugaggacacuaagauccagagagguuuaguaacaugcgcaaggucacaagguugguaaauggaaagguugggauucagaaccauuucuuucuggggugaagagcuuguggucuuaaccauuauguaccauuccaacaaaaugaaaaauuauuuuauacaguugucccucaguauccaugggggguugggcccaggaccugcuauccgaggaugcucaagucuuugauuugaaauggcuuauaguauuugcaaauaaccauugcacauccuccuauauacuuuaaaucaucuguagauuacuuauaauaccucauacauuguuacauaaacccuuguugugccguacaguaaauaaaguguguacauauucgguacagacacaacuuuuuuuccacauauuuuagauuugguugguugaauccacugauguggaacucacagauauggagagcccacuguauacaauaaaaauauuugacauaguuugaaccagggaaagggauauuaaucccucauagcuccuacccuccaagagcuaaaacuuuuuuugagaaaauaagacuuaggggaaauggagacugugagaccacaucagugcuaaaaggagagggguggauaguauacuguggaaaaagggacggugcugcagauuucgcucauucccuccacauacaugccaacucugaagaagggugcaucagugaauuaaaaaaugucccuacccucagaagaauccauacagcagucagggacacagaauggucagucaauacauuauaacauaauacaccaaaugcuagaauagaaggggaggggggcacacauaaugacucacugcuggaagaaguagaggaggaagagauggcuuuugaccuaggcuuugaaggaugagagguuucaccagauagcgaacaagcaugagcacaggcauggaggagagaauguagugugcucaaggaacagugaguguuuuuauaugaacagacuauaggugcuugaacaggugaugagucugaugggcagggagaggccagcucaagaagggccuugaaagccaggcaagaguugagacuuuagccugagggccauggggagucacugaaacauccuaaccaaggacugacauaucuugauuugccugugagaaagaucacucugcuacccagaugaaaagggccacagaaaaagcaggagauugggcuuaagugaggugcuaacaccaccguaguggagaagggagagaaagcuugggagauagauggauggggagguagcaggacuuggugauucacugagccugggggaugacuugaagcugauggugcagugguaacaguugcaggcucugaaaggggaggagcugauuugaggagagggaagacuuagucuguggucccugugguuuaccccguuccagccuaucugcccucuuaaguucacagugugccugcgucgggaagggcagacuguguaccagcaaguccugucccuggagcgcccaaguguccuccgcagcuggaacuggggccuguguggguacuuugcuuucuaccaugcccucuauccccgagccuggacugucuaucagcuuccuggccagaaugucacccucaccugccgucagaucacacccaucuugccccaugacuaccaggugaggcccccacaucuguaucuuccauugcccucccuuccccaggaccugccucugcuagaaacugcauggccugcgaggcgcgguagcucacgccuguaaucccaacacuuugggaggccaaggcaggcggaucaugagaucaggagaucgagaccauccuggcuaacacgugaaaccccauaucuacuaaaaauacaaaaaaaaaaauuagcugggcguuguggcaggcaccuguagucccagcuacucgggaggcugaggcaggauaauggugugaacccgggaggcggagcuugcagugagccgagauugcgccaccgcaccccccaaaaaaaaaaaaaaagaaacugcauggccugugaaagggagguuggagccaugaacaucacacuggcuucccagaaccaccgcccaacugguucuggucuucuauauucccugcuaggcagcuugccugggaauauggggagaugcaaguggacaaaagaagaguacacuggggaguauuugagucagguccucugugugcccaggacugauccuagcagaguggggucaggaggcgcucuacugggaccgucugagucuaaucuucugcccccaggacagcagccugccuguaggagucuuugugugggauguggaaaaugaaggggacgaagcucuagauguguccaucauguucuccaugcggaauggacugggugguggagacgaugccccaggggguuuguggaaugagcccuucugucuggagcguagcggggaaacuguccgggggcugcuccugcaucauccaacccuuccaaaccccuacacgauggcuguggcugcacgagucacgguaaggaaagagccugcccuauaccuuagccccugaaccccaccuccaccccagcauggucucuucauccacccucaucauacuccuguaagccccugggccugggagguuaagaguaaguaagaggagcuggggagcuagccgggacccaguguacucguggagccugcccucacagucccugaccccuucacaggcagcuaccacgguaacccacaucacagccuuugacccugacagcacggggcagcagguguggcaggaucuacuucaggauggacagcuggacucucccacuggugauggggggucugacugggagauggugggaagagagguugucccugucuugggaccaggggugggaggccugguaauaaguaggccuuguuuccauguuagggaucccuaucccuggggcugaaggggcuccuguccugaauucucuuguguuucucucaggccaaagcaccccuacgcagaaaggaguaggcauugcuggagcuguguguguuuccagcaaguugcgaccucgaggccagugccgccuggaguuuucacuggcuugggacaugcccaggaucauguuuggagcuaaaggccaaguccacuacaggugaggggaccaagaaaguguaaggauccagagugcuggggcucugaccuggggcuuguguucauccuuccccuucccaccccaggcgguauacaagguucuuuggccaggauggagaugcagcaccugcccucagccacuaugcacugugccgauacgcagagugggaagagaggaucucagcuuggcagagcccgguauuggaugacaggugccaguggggcccauuucuugccuuucuccugggcacucacuccaaaugggacuccucgauuuacucuccacccaccaaagucaguagacuugcacugggauucauuugaugaucccacucugcugaacccccaaauccuuuccaucuugggagguacauguuccuuaaaccauuuccuccuccucgcuucccagaucacugccugccugguacaaaucugcgcuguucaaugaacuauacuuccuggcugauggaggcacaguguggcuggaaguucuugaggacucccuaccagaggagcugggcagaaacaugugucaccuccgccccacccuacgggacuacggucgauuuggcuaccuugaggguacaggaugcuggugggcugggauauggcaggccauccccaagucaggaugauggauuugccuaccccaggguauugguuaggaugaggggguguuggguguggacuaguaacaaugccccaccucuaaaucuagaggacaagcuacagagggguuugaaggggaagcaggaauucuggcaacagugugucucauucauuccuccaggccaggaguaccgcauguacaacacauaugauguccacuuuuaugcuuccuuugcccucaucaugcucuggcccaaacuugagcucagccuacaguaugacaugggugaggaucccuuuugugccgcuucugcccucuuggcuccccauacccccgaacuucuguggucccucagauugucucuucuuucccuucccuucauacguaucugcaugcugcuuacugguuccccacugcagucacacacauagcugugugccccuccucaggcaugcccauucccugccucccuucugugucucucccccagcucuggccacucucagggaggaccugacacggcgacgguaccugaugaguggggugauggcaccugugaaaaggaggaacgucaucccccaugauauuggggacccagguaaaaguccaccccaaggucagcuucccucccucaacuuuugcacccucuacccuauccaccaaugcaagugacccaaguccccuccucucccacagaugaugaaccauggcuccgcgucaaugcauauuuaauccaugauacugcugauuggaaggaccugaaccugaaguuugugcugcagguuuaucgggacuauuaccucacgggugaucaaaacuuccugaaggacauguggccugugugucuaguaagggaugcacaugcaguggccagugugccagggguaugguuggugucugggaagagccuagcugguuguugccuuuccucgguaccuaggucuucaacaucuuggucccucucuaggcugugauggaaucugaaaugaaguuugacaaggaccaugauggacucauugaaaauggaggcuaugcagaccagaccuaugauggaugggugaccacaggccccagguuagcggguagggguuuccaggaggccugaggugagaaacugggcaacaagggauuguagggcucaagaaagaaugacucauugucuauuacacggcaugggagcagcuggagcugccagucugacccccaaacccaugucccugaucagugcuuacuguggagggcuguggcuggcagcuguggcugugaugguccagauggcugcucuguguggggcacaggacauccaggauaaguuuucuucuauccucagccggggccaagaagccuaugagagacugcuguggaauggugaguucggggagccuaaguagucuuaaggcagcugagaggacaccaggagccuuauuuuucucuuccucgacuccaggccgcuauuacaacuaugacagcagcucucggccucagucucguaguguuaugucugaccagugugcuggacagugguuccugaaggccuguggccuaggagaaggagacacugaggugagagaggaggaggagcagccagagagaaaaauggguuuucccuggaggugggaaguaaguauaugagaccauguuccugcccuugccccuccagguguuuccuacccaacaugugguccgugcucuccaaacuaucuuugagcugaacguccaggccuuugcaggaggggccaugggggcugugaaugggaugcagccccauggugucccugauaaauccagugugcagucugaugaagucuggguggguguggucuacgggcuggcagcuaccaugauccaagagguaaugcacuccuuuucccaucucuccaccaucuguauccuggcccagaaaacuuccucaaccaccaaauuucuucaaggcauaacccaaugccaucuuguccgucuauaaagccucccauuuuucccugguaugcauuccagcuccugccuucaggcuucugucugugggucauaguuaucuccuccacuugcugggagcuccuugaaggcaaagacucuacugccuccaucuauccaguggaaguggcucuucagagggugccaaguuaguauguaugacugucaucucucccaacagggccugacuugggagggcuuccagacagcugaaggcugcuaccguaccgugugggagcgccugggucuggccuuccagaccccagaggcauacugccagcagcgaguguuccgcucacuggccuacaugcggccacugagcauaugggccaugcagcuagcccugcaacagcagcagcacaaaaaggccuccuggccaaaagucaaacagggcacaggacuaaggacagggccuauguuuggaccaaaggaagccauggcaaaccugagcccagagugagccgucugaacugugggagggaagugcuaacagcccagccuccagccuggccuuuccuccuuccccucugaaccuccugcaacccugagccaucaggacaaucauaccccuucccuucucuccacccaauugugccaguaaauggggguugagggugaccuaggcagcauuagaaucacuuauuuauuucuuuccucaccuguucccugacugcgugaaauguucagggaggucaguugauuuccccagguacauucauggugugacagacacauggguacaaauaaaagacccagaaagccauuaagugugguguguuugagcccucagucguccugacagggcacaggagcugcggccagcccuugcccaccgcuuuuuauuuggacacagauggggagccccccaggcuccugcugagaccccccacauauccucauaucuagccugaguaucuguccugcaaaaugacagaggggcuaccaguaggaagccauccucccuuccuugugagauuugccugcagggggaggaugggaccucggcagagaggcucugagaagaggucagggaauggccacuccaggggaggcucugcacugggagccugaggcauguaaugcagcaggcaggaaguguugccaggggccuggaguacacagucugagccguccaaccacuggugugugcugucuuucggcacuucugacugcagggcaggcagcuccagcugguaaggguccucacuggggagggcacgaagcuggcgggacaacacu

SEQ ID NO: 13937 - RNA, 606 nt, Homo sapiens
aggacuggaagggaaaagaaaacccaaagucuauaaacucaugggaaaaaaagacacguaguacaagguuccucacccugauugaggaaccuucaccaaaguucagcuccucugcugaucacuccccuggaggucuccuggcuuagggucuaaaaagcuccuucucucccaggcuuagaucucuagccuucuucccucuucugaagcuucacuuuuuuccuuuugcuccugcaucacaucugggccuuaaauugccagaaguauguguccugccucucaucaucucucucuaguugaccgccccuuuagaguugccuaggaaguuccucuuucuuggcuccagcauucagccucaucuucaaaggaaaaaugacuagcaaaucuuuaguccaauuaaugacaauacccuuccugguucacguuuaccagcccugcccaugucccaagaucccucucugccucaucccuuagguauccugaggggaauggcuuccagaauugugacucuacaauuaaaguaauuauugcaugcuuaacaugugcuagacacugugcuaggcucuuuguauacuguuuaauauuaaaaacaauccuacaagggaagua

SEQ ID NO: 13938 - RNA, 8886 nt, Homo sapiens
aggcaccgcccccgggaccucggcccggccccugggccacggcaccgggucccccaggauugggcgccaggucccgccggccggcuccggggcagcgcccgcgcccaggugccagcccgugggaaggugacccugggcgccgggaugacccgagcccuuuccggucuggccugccgggcgcuuccggccggaagggacuccgcggagggugggggaccgaagggaagucccgccucuaccgcccagcggacgccgccgccgccgccgccgccgcguaccuagccaggucccugaggggcgggcagaugaggccuaggggugccgaucccuagugucgacuaugcgaggugacuagcggcggugaucuugggcugggacguggaacuuugaggaaagggggagcggaggccaguuugggaacuccgcgggggugcccagggagaagaacccgucgcacaggggcuggggucuagggcccagagcgauguccucccccugggcaguacugagucuucagucgccucccucccacccgccuaccccuccuauauccaggagcucccucgggcaccacggugcugaccaccccuguccucagcccucagcccuaggugcucaccgcaacgccccucccugucaaggugcugaccuccgccccgccuuguuuccuucuagaucugauuccggagcugccaugauugaagugguagcagagcucagccgggguccuguauuuuuggcuggggaggcgcuggaguguguagugaccgucaccaacccccuuccgcccacggccacuucugcauccagguggggaugcuggcacugaaggugguggcccuucugggaagaagccagauuaucucuggggcugaggcagagcucagguuguccuguagcgacaccaccuccucuugcucacugugcugucauuguaggagagggcucuuuaacagaagauguggaugacauagcuguacgcuuuccuuccccucccccguuccccuuuuuacgcacagucugcuacucuuuauuuaaugguuucucuuugggauuguggauuuccugaucacuaggacagccaucuaaccuuguugguuaagauggugugauagggagcuugggaaagcauuugugaggucaggaacuaccucugaugccuccuuuuccuuuucccacagugaggcccuggccugggccagugcccaaauccacugccaguuccaugccagugagagucgaguagcacugccuccuccugacucuagucagccagauguccagcccgacagccagacugucuuucugccacaccgagguuagagaggggcauuugccugggagagggggggugcggaggguguguguggaggcauugucacccaugggugaaguuguuaauuguucuuguucuuauagucccugucaugcuggggauguuggggagcaugacuauugcuuuagggguagaagacuauucccauuucacagcagggacggagggccuggcagccuuucacuaucuccacuugccgugcuagucuuguucaguacuggacaaugggucauuaaauuagucauuuuuaccuuuuucaggugagaggggccaguguauccuuucuacuccaccgaaaauucuauucugugaccugaggcuugauccuggagaguccaaaucaugugagugauuguccccaucccugaauugccuucuaagucuccuggagggaggacuccucuggugccucuggcuguccugacaacuacuucccaaccagacuccuacagugaagugcugcccauagagggaccacccuccuuucggggucagucagucaaguacgucuacaaacugaccauuggcugccagcgugucaacuccccuaucacuuuacucagagucccucugaggguucuugugcugacugguaagcaagggcuccuggagggaagggcuggggaagggcgaugccaaagcagaaauugucuuagagggcuugcaagagggacugcagggaaacuuccuggucucagugacagugcuagggaguugggaagggagggaggguucuggagauagagauguaaaccucagcccuggcaccccuuaccuuuagccaucucauguuagaaucuaaaacccuaaccucuacucucaucuccguucccucucagcauuaccucuccacucauucuuucucuaggccuucaggauguccgguuuccccaggaugaggcuguagccccauccaguccauucuuggaggaggaugaaggugggaagaaagauucauggcuagcugagcuggcuggggaacgccuaauggcugccacauccugccgcagccuccgugagaauucuuucagaauuguccuaccccauccuuccccucauuguuuucccaucucagagacagucuccuaaccaccacacacuucuguggauccacugauaccugacaccuccaauuuuaaagaaaagccccaucuuuuggccuguggugcccaguccuagacguuauccaguauguagacuccaggcuuauaguguccuauucuccccagaucuauacaauaucagugauggccgagggaaaguugggacguuuggcaucuucaaaucuguguacagacuuggcgaggacgugguggggaccuuaaacuuaggggaaggaaccguagcuuguuugcagguaagaagggagcagagcuucuuaccugcuggggugcugggguugaagggcuaggguggaaggccuguauaaagagggguggcauguagaaggggauaguggggucauccagggucccuuuguaaaacagcuugagguugggcuguccucucaccuacagacagcacuuccuguuagcacacaccugucucuugcucccaguuuucagucagcuuacagaccgaggagcguguacagccugaguaccagcggcgacguggggcaggggguguccccucugugucacaugugacucacgcccggcaccaggaauccugccuacauacaacuagaaccagcuucucccucccaaucccucucagcuccaccccaggcuucuguacagccauuggugagacccucacuguuacuggagaagggagagggggacaguaaaaugcugugcuaagggaggguguaauggauccugauuccuuauacacacucccagacauacccacgucuagccucugacccggaacaguuucucagaccuucaaccucuuccuguuucuuagaugcacugaccccuaaacuccuaacagcuugauagaacuccuuccccacaccuaccuacuaggacccugugauacacugauuuuugauuacuucaugcuaccuagacuugacugccucacucuuagguuauuagguacuuaauacugcuaucuucagcucacaucugugguaguacccauugcuucagaaaaacccuuaaucacagcucccugcccugugacuuuucccugucuuccugaacacagauuguuuucuucucauucacuaacuauauccugucauuggcuuuuacuccugcuagcuucugaugcuucuaccuuaaucuuuuucuuccauaguguccuugaaguggagauugcauuuugaauuuguaacgucccgagaaccaggauugguacuccuacccccuguggaacagcccgaaccuaccaccuggacaggaccugagcaaguaccuguagacaccuucagcugggaccugcccaucaaggugcugccuacuagccccacccuggccucauaugcugccccaggccccagcaccagcaccauaaccaucugaaacuggcccacccuggugcuaguuccuuccggauacugagaacucagcaccuggacucuaaugggacccacuuuuuccaccugggguccaaugucguggacagugagagucgggcuuucagcuauagcauuaauuuauuuguucagaauacauuggcagcugcuagugguuucccuggaaguggcagcagcagugagcagucagcagauggaugaucaguugaguuuagcuggaguggggagcaggagccccaggaacagggguguuggcugagccccauucugggucaggcccucccccuuugcagggcagccgagggucagauuuuugcaccaaggagaacuggcagguuccugccuccugacguaccucacacccagccgggaagucgaugggaugcugggaccuggggaaccaaggauaggggaaggagucagcacagugaaaggcugccuuuaucccugcccacauguucccucucucacaguuuuccccccacagagccccuuucaguggccccuugguccuccuaacuaagcugucaccuaccauaugugggccuuuuuguuuuauaacaggaguauuuucucuccagguccaccccaaccuccccugauuuauagccugaagccuuaucuuucacacuaguguuggucccuucagguuuggcccaucuuguauugcucuucuguucauucuuacaucacagcaaucuagucacucccuggucaucccucagucacucauaucagagucauucucucuggccaucuuuggucacucacgugucacagcagcccacgccaacaggaugcagacaggugcaauggaaacaguccuugcggagccaagacucacccaggguaaaauauuuccccucauagugacagggggcuagggaagaacgggaaauguuaguagguguaggagugcugaugagaggcagaggcucuucuggucugggguggagacaguaaguacgcacuauccccguauuuaguuugucuuuccuguuucacagcuggaggaagccuggguauuuugacacgggaucaucuguaaggccccauccucccugugcccucucugcugcuccuccauuccuaacgcuucaccccacuuuaccuugagcuuggaaguagcacuugcuguagacuccugggugcuggaggaguagagacaucaccaagcagaugaucccccagccuccuaggauccccuuggccuguccagcccagagcauccuuagggccauugcugcugcacagcccucucagacccuucuuggccucugcucagcuacucuggucuugacuccuugacuuugcuuugcguugcuccuugagucuuaguuucugucuuucuccccugggcuccugucucacacuaucucccugcccucugcucucacaggcuggggauguuuauaaagugaggacccuggcccccugcugaguagagcuggaaaaguuguaacucuguuuccugaggugagggcaugaaaacaagaggucuagcuuuaacaagcugugagagcugauucaugccccggcacagcuagagggagggagguggccauggagggggcacuggacugggcacuuccccagcaaggaggcaggaggggcgagggcccccaggugguccccagaucucuucccugaccuggagagaaggaagcauuccaccuucccccuuucucccccacugccaccaccagggguguguaugcugggaucccugccuggaccggagggaggcauuuccuggggaugguuaauccugugccccagccaaacccaggagcugcaauagggugcgacggccagaagcuccaggagagugagcaggcaccuggaguggagacuguguuucccucagauccuagggcaggguuucccuaauguauccaagaaauagggcugccccucagagaugguggggagggucucuuuuccucaggcauuccagaggugaacuguccauugcuuaucaccuucaaacauacagcagaugugggaucaccccacaucuggggaugguucuuuccccuuucaaagaggagcaucucuaagugcccugaugggaugaaucacuccagguucacagagguguccucucuuuccucccauauauaauggagugagguuuuuaggaauuuaucauuuggcauccucugaguuucccacagguucuggaggagcccaggauggauuauugagagcaugggcuguagagacagucuucuuggauucagauccugacuccacuuagcuauguaaccuggucagauuacuucaccucucugagccuguuuccucaucuauaaauuggggauaguaaugccaacucauugggcuguuaugaggauuacugagauaaugcgugcagugcucuuaucaccaucucuggugcguaagcgucaggaaauagcaguugcugugauuggggcuaaagcucugaggcaaaaugggcgacauuauuuucuuugaaugacauuaagcaguuugugcauagcugagggcuucuauuggggauggcugucuccuggcauagaccucugcaccuuucacacucauacuccuugucagcaguccccaaccuuuuugguaccagggaccgguuuuguggaaaacaauuuuuccaccaguggauggagggggauagcagcggggagaugauuuugggaugaaacuguuucaucucagaucaucaggcauuagauucucauaaggagugugcaaucuagaucccuugcaugcggaguucacagugggguuugcacuccugugagaaucuaaugccucugcugaucugccaggaggaggagcucaggcgguaaugcucacucgccugccgcccaccuccugcuuugugcucccgcuuccuaacaggccacagacugguacuggccuguggccugggggauggagaccccuaauccaugucaccuuucccaccucuuucaaaaacagguaccuccaggaacauuuugguuuuggcccuuguauugacuucugaaugucuaguuugagaaacuguucccaauaagccuucuucccccagaucugcacccucgccucuacccuaggacaagauguccuuuucucaucauccugccaggcuaacuuuaagucuccugcuuuuucucacuuggauuuggauccauuucuuccuauuuccgcucaugugaacucuccaguucuccuuucucaccacucuccugcuagccaucucuuuggcacuaaaggcccuggucaaauuggauuucuuucauuuuuccacacuucaaagacccauguucuagguauucuccauagggauagucucuuuggcauuuauuugguuuuucuacguuuucagucccauuuacuccaagacucacucccugccaccuagugcaucagauacagcuacuucuggcugacuuuucaagggggaccacccuaccugucaucucuucacuguucagaaaugacugugucagugcaccucaaacucccuugcuguccuuuuccaaggagacagcuaagguggauggagaugcagaauggaccucacguucgcccuagucaggacugauacccuuuccguuucagaggauugccaagaaaaaacucacaguugaggcagggugcucugaggucggcugcggugugggaggcacggccugggccugcucucugggcuggagcagguggauucgaaggccugucuagcacgagggcccaaaggucuugucaguggccaguagcucugccgccuuucccagagaggggguccaggggacauccuggaaggcugggcccugggccaccuucugcucuugcaagcuagagccagcccaauagggggcggaugugaguggggagcuggggcgcaugaaggugggggugaugccgaaggggaagggaucgccaguggggauuggugcgugugcggaaacggggacagaagugaagguucaucgccuauaacgaagaugagguaggcauauaggggcuucuggaaagcuagaggcugggcugagccaggaguccucucccagaaguuggggggcggugcagaggugugggucgagcccgcaugcgugccugcuggggagggggugaguggugaggaccaggcccgcuggguccugggggcgcgguggcuggcgcgcaggucccggagggggcggcuggcgcgcacuacacgcuugggaacaaggaaaacauccgccggaggcccggccgggcggcgcuccagccucggggcaggugcgcggagaggaagugagagcauuccggcccccccaccccaaccccggccgcuggcccucuggugagucacagccgacccccgccgccggagggagaggggagcugcgggccagagccccggagggucuggaggagccaggaggguuucugggagcagagggucacuuagugggcuucugucguggugucgcuacgggcgcgaaacggacacugaacacagucugacuguauggaggcagguggggagggauccccugggagaacuuggcgggccgagagcagaccccagggcaaggaggggcccccgagggggaaaccgggagucgggcagguggcguaacccagaaagggaaggagagccggauugauuggggugagagaggaaggaagcacgccaaguuaggccugggagaacugagggaccugaggagggaggagggagaccaacacagggugggaaggcggaaauggccaaaccccaggcaucaggucuguccagaggcugacguagacagugaagggugaaggguagguuuuaggaguagggggaguuaugauuauuugguuacauuuugggauuauuuggucucacagguagaagggagccugcuggucucuguguaacggauggcuuaaaagcaagguugucugcgucuuggauuacugucugccauucagccuuugccaaaaaauuuggcacugaucugcacauuuuuauagucauuuaaaauuguaugacucugucaaaugauuuaaguaauuuugguggauuuuuaaaaauaaaaaaauaaaaauagaaaaguugcacaau

SEQ ID NO: 13939 - RNA, 8886 nt, Homo sapiens
auugugcaacuuuucuauuuuuauuuuuuuauuuuuaaaaauccaccaaaauuacuuaaaucauuugacagagucauacaauuuuaaaugacuauaaaaaugugcagaucagugccaaauuuuuuggcaaaggcugaauggcagacaguaauccaagacgcagacaaccuugcuuuuaagccauccguuacacagagaccagcaggcucccuucuaccugugagaccaaauaaucccaaaauguaaccaaauaaucauaacucccccuacuccuaaaaccuacccuucacccuucacugucuacgucagccucuggacagaccugaugccugggguuuggccauuuccgccuucccacccuguguuggucucccuccucccuccucaggucccucaguucucccaggccuaacuuggcgugcuuccuuccucucucaccccaaucaauccggcucuccuucccuuucuggguuacgccaccugcccgacucccgguuucccccucgggggccccuccuugcccuggggucugcucucggcccgccaaguucucccaggggaucccuccccaccugccuccauacagucagacuguguucaguguccguuucgcgcccguagcgacaccacgacagaagcccacuaagugacccucugcucccagaaacccuccuggcuccuccagacccuccggggcucuggcccgcagcuccccucucccuccggcggcgggggucggcugugacucaccagagggccagcggccgggguuggggugggggggccggaaugcucucacuuccucuccgcgcaccugccccgaggcuggagcgccgcccggccgggccuccggcggauguuuuccuuguucccaagcguguagugcgcgccagccgcccccuccgggaccugcgcgccagccaccgcgcccccaggacccagcgggccugguccucaccacucacccccuccccagcaggcacgcaugcgggcucgacccacaccucugcaccgccccccaacuucugggagaggacuccuggcucagcccagccucuagcuuuccagaagccccuauaugccuaccucaucuucguuauaggcgaugaaccuucacuucuguccccguuuccgcacacgcaccaauccccacuggcgaucccuuccccuucggcaucacccccaccuucaugcgccccagcuccccacucacauccgcccccuauugggcuggcucuagcuugcaagagcagaagguggcccagggcccagccuuccaggauguccccuggacccccucucugggaaaggcggcagagcuacuggccacugacaagaccuuugggcccucgugcuagacaggccuucgaauccaccugcuccagcccagagagcaggcccaggccgugccucccacaccgcagccgaccucagagcacccugccucaacugugaguuuuuucuuggcaauccucugaaacggaaaggguaucaguccugacuagggcgaacgugagguccauucugcaucuccauccaccuuagcugucuccuuggaaaaggacagcaagggaguuugaggugcacugacacagucauuucugaacagugaagagaugacagguaggguggucccccuugaaaagucagccagaaguagcuguaucugaugcacuagguggcagggagugagucuuggaguaaaugggacugaaaacguagaaaaaccaaauaaaugccaaagagacuaucccuauggagaauaccuagaacaugggucuuugaaguguggaaaaaugaaagaaauccaauuugaccagggccuuuagugccaaagagauggcuagcaggagaguggugagaaaggagaacuggagaguucacaugagcggaaauaggaagaaauggauccaaauccaagugagaaaaagcaggagacuuaaaguuagccuggcaggaugaugagaaaaggacaucuuguccuaggguagaggcgagggugcagaucugggggaagaaggcuuauugggaacaguuucucaaacuagacauucagaagucaauacaagggccaaaaccaaaauguuccuggagguaccuguuuuugaaagaggugggaaaggugacauggauuaggggucuccaucccccaggccacaggccaguaccagucuguggccuguuaggaagcgggagcacaaagcaggaggugggcggcaggcgagugagcauuaccgccugagcuccuccuccuggcagaucagcagaggcauuagauucucacaggagugcaaaccccacugugaacuccgcaugcaagggaucuagauugcacacuccuuaugagaaucuaaugccugaugaucugagaugaaacaguuucaucccaaaaucaucuccccgcugcuaucccccuccauccacugguggaaaaauuguuuuccacaaaaccggucccugguaccaaaaagguuggggacugcugacaaggaguaugagugugaaaggugcagaggucuaugccaggagacagccauccccaauagaagcccucagcuaugcacaaacugcuuaaugucauucaaagaaaauaaugucgcccauuuugccucagagcuuuagccccaaucacagcaacugcuauuuccugacgcuuacgcaccagagauggugauaagagcacugcacgcauuaucucaguaauccucauaacagcccaaugaguuggcauuacuauccccaauuuauagaugaggaaacaggcucagagaggugaaguaaucugaccagguuacauagcuaaguggagucaggaucugaauccaagaagacugucucuacagcccaugcucucaauaauccauccugggcuccuccagaaccugugggaaacucagaggaugccaaaugauaaauuccuaaaaaccucacuccauuauauaugggaggaaagagaggacaccucugugaaccuggagugauucaucccaucagggcacuuagagaugcuccucuuugaaaggggaaagaaccauccccagauguggggugaucccacaucugcuguauguuugaaggugauaagcaauggacaguucaccucuggaaugccugaggaaaagagacccuccccaccaucucugaggggcagcccuauuucuuggauacauuagggaaacccugcccuaggaucugagggaaacacagucuccacuccaggugccugcucacucuccuggagcuucuggccgucgcacccuauugcagcuccuggguuuggcuggggcacaggauuaaccauccccaggaaaugccucccuccgguccaggcagggaucccagcauacacaccccuggugguggcagugggggagaaagggggaagguggaaugcuuccuucucuccaggucagggaagagaucuggggaccaccugggggcccucgccccuccugccuccuugcuggggaagugcccaguccagugcccccuccauggccaccucccucccucuagcugugccggggcaugaaucagcucucacagcuuguuaaagcuagaccucuuguuuucaugcccucaccucaggaaacagaguuacaacuuuuccagcucuacucagcagggggccaggguccucacuuuauaaacauccccagccugugagagcagagggcagggagauagugugagacaggagcccaggggagaaagacagaaacuaagacucaaggagcaacgcaaagcaaagucaaggagucaagaccagaguagcugagcagaggccaagaagggucugagagggcugugcagcagcaauggcccuaaggaugcucugggcuggacaggccaaggggauccuaggaggcugggggaucaucugcuuggugaugucucuacuccuccagcacccaggagucuacagcaagugcuacuuccaagcucaagguaaaguggggugaagcguuaggaauggaggagcagcagagagggcacagggaggauggggccuuacagaugaucccgugucaaaauacccaggcuuccuccagcugugaaacaggaaagacaaacuaaauacggggauagugcguacuuacugucuccaccccagaccagaagagccucugccucucaucagcacuccuacaccuacuaacauuucccguucuucccuagcccccugucacuaugaggggaaauauuuuacccugggugagucuuggcuccgcaaggacuguuuccauugcaccugucugcauccuguuggcgugggcugcugugacacgugagugaccaaagauggccagagagaaugacucugauaugagugacugagggaugaccagggagugacuagauugcugugauguaagaaugaacagaagagcaauacaagaugggccaaaccugaagggaccaacacuagugugaaagauaaggcuucaggcuauaaaucaggggagguugggguggaccuggagagaaaauacuccuguuauaaaacaaaaaggcccacauaugguaggugacagcuuaguuaggaggaccaaggggccacugaaaggggcucuguggggggaaaacugugagagagggaacaugugggcagggauaaaggcagccuuucacugugcugacuccuuccccuauccuugguuccccaggucccagcaucccaucgacuucccggcugggugugagguacgucaggaggcaggaaccugccaguucuccuuggugcaaaaaucugacccucggcugcccugcaaagggggagggccugacccagaauggggcucagccaacaccccuguuccuggggcuccugcuccccacuccagcuaaacucaacugaucauccaucugcugacugcucacugcugcugccacuuccagggaaaccacuagcagcugccaauguauucugaacaaauaaauuaaugcuauagcugaaagcccgacucucacuguccacgacauuggaccccagguggaaaaagugggucccauuagaguccaggugcugaguucucaguauccggaaggaacuagcaccagggugggccaguuucagaugguuauggugcuggugcuggggccuggggcagcauaugaggccaggguggggcuaguaggcagcaccuugaugggcaggucccagcugaaggugucuacagguacuugcucagguccuguccaggugguagguucgggcuguuccacaggggguaggaguaccaauccugguucucgggacguuacaaauucaaaaugcaaucuccacuucaaggacacuauggaagaaaaagauuaagguagaagcaucagaagcuagcaggaguaaaagccaaugacaggauauaguuagugaaugagaagaaaacaaucuguguucaggaagacagggaaaagucacagggcagggagcugugauuaaggguuuuucugaagcaauggguacuaccacagaugugagcugaagauagcaguauuaaguaccuaauaaccuaagagugaggcagucaagucuagguagcaugaaguaaucaaaaaucaguguaucacaggguccuaguagguagguguggggaaggaguucuaucaagcuguuaggaguuuaggggucagugcaucuaagaaacaggaagagguugaaggucugagaaacuguuccgggucagaggcuagacguggguaugucugggaguguguauaaggaaucaggauccauuacacccucccuuagcacagcauuuuacugucccccucucccuucuccaguaacagugagggucucaccaauggcuguacagaagccugggguggagcugagagggauugggagggagaagcugguucuaguuguauguaggcaggauuccuggugccgggcgugagucacaugugacacagaggggacacccccugccccacgucgccgcugguacucaggcuguacacgcuccucggucuguaagcugacugaaaacugggagcaagagacaggugugugcuaacaggaagugcugucuguaggugagaggacagcccaaccucaagcuguuuuacaaagggacccuggaugaccccacuauccccuucuacaugccaccccucuuuauacaggccuuccacccuagcccuucaaccccagcaccccagcagguaagaagcucugcucccuucuuaccugcaaacaagcuacgguuccuuccccuaaguuuaagguccccaccacguccucgccaagucuguacacagauuugaagaugccaaacgucccaacuuucccucggccaucacugauauuguauagaucuggggagaauaggacacuauaagccuggagucuacauacuggauaacgucuaggacugggcaccacaggccaaaagauggggcuuuucuuuaaaauuggaggugucagguaucaguggauccacagaaguguguggugguuaggagacugucucugagaugggaaaacaaugaggggaaggaugggguaggacaauucugaaagaauucucacggaggcugcggcaggauguggcagccauuaggcguuccccagccagcucagcuagccaugaaucuuucuucccaccuucauccuccuccaagaauggacuggauggggcuacagccucauccuggggaaaccggacauccugaaggccuagagaaagaaugaguggagagguaaugcugagagggaacggagaugagaguagagguuaggguuuuagauucuaacaugagauggcuaaagguaaggggugccagggcugagguuuacaucucuaucuccagaacccucccucccuucccaacucccuagcacugucacugagaccaggaaguuucccugcagucccucuugcaagcccucuaagacaauuucugcuuuggcaucgcccuuccccagcccuucccuccaggagcccuugcuuaccagucagcacaagaacccucagagggacucugaguaaagugauaggggaguugacacgcuggcagccaauggucaguuuguagacguacuugacugacugaccccgaaaggaggguggucccucuaugggcagcacuucacuguaggagucugguugggaaguaguugucaggacagccagaggcaccagaggaguccucccuccaggagacuuagaaggcaauucagggauggggacaaucacucacaugauuuggacucuccaggaucaagccucaggucacagaauagaauuuucgguggaguagaaaggauacacuggccccucucaccugaaaaagguaaaaaugacuaauuuaaugacccauuguccaguacugaacaagacuagcacggcaaguggagauagugaaaggcugccaggcccuccgucccugcugugaaaugggaauagucuucuaccccuaaagcaauagucaugcuccccaacauccccagcaugacagggacuauaagaacaagaacaauuaacaacuucacccaugggugacaaugccuccacacacacccuccgcacccccccucucccaggcaaaugccccucucuaaccucgguguggcagaaagacagucuggcugucgggcuggacaucuggcugacuagagucaggaggaggcagugcuacucgacucucacuggcauggaacuggcaguggauuugggcacuggcccaggccagggccucacugugggaaaaggaaaaggaggcaucagagguaguuccugaccucacaaaugcuuucccaagcucccuaucacaccaucuuaaccaacaagguuagauggcuguccuagugaucaggaaauccacaaucccaaagagaaaccauuaaauaaagaguagcagacugugcguaaaaaggggaacgggggaggggaaggaaagcguacagcuaugucauccacaucuucuguuaaagagcccucuccuacaaugacagcacagugagcaagaggagguggugucgcuacaggacaaccugagcucugccucagccccagagauaaucuggcuucuucccagaagggccaccaccuucagugccagcauccccaccuggaugcagaaguggccgugggcggaaggggguuggugacggucacuacacacuccagcgccuccccagccaaaaauacaggaccccggcugagcucugcuaccacuucaaucauggcagcuccggaaucagaucuagaaggaaacaaggcggggcggaggucagcaccuugacagggaggggcguugcggugagcaccuagggcugagggcugaggacagggguggucagcaccguggugcccgagggagcuccuggauauaggagggguaggcgggugggagggaggcgacugaagacucaguacugcccagggggaggacaucgcucugggcccuagaccccagccccugugcgacggguucuucucccugggcacccccgcggaguucccaaacuggccuccgcucccccuuuccucaaaguuccacgucccagcccaagaucaccgccgcuagucaccucgcauagucgacacuagggaucggcaccccuaggccucaucugcccgccccucagggaccuggcuagguacgcggcggcggcggcggcggcggcguccgcugggcgguagaggcgggacuucccuucggucccccacccuccgcggagucccuuccggccggaagcgcccggcaggccagaccggaaagggcucgggucaucccggcgcccagggucaccuucccacgggcuggcaccugggcgcgggcgcugccccggagccggccggcgggaccuggcgcccaauccugggggacccggugccguggcccaggggccgggccgaggucccgggggcggugccu

SEQ ID NO: 13940 - RNA, 1385 nt, Homo sapiens
cuauagcauuaauuuauuuguucagaauacauuggcagcugcuagugguuucccuggaaguggcagcagcagugagcagucagcagauggaugaucaguugaguuuagcuggaguggggagcaggagccccaggaacagggguguuggcugagccccauucugggucaggcccucccccuuugcagggcagccgagggucagauuuuugcaccaaggagaacuggcagguuccugccuccugacguaccucacacccagccgggaagucgaugggaugcugggaccuggggaaccaaggauaggggaaggagucagcacagugaaaggcugccuuuaucccugcccacauguucccucucucacaguuuuccccccacagagccccuuucaguggccccuugguccuccuaacuaagcugucaccuaccauaugugggccuuuuuguuuuauaacaggaguauuuucucuccagguccaccccaaccuccccugauuuauagccugaagccuuaucuuucacacuaguguuggucccuucagguuuggcccaucuuguauugcucuucuguucauucuuacaucacagcaaucuagucacucccuggucaucccucagucacucauaucagagucauucucucuggccaucuuuggucacucacgugucacagcagcccacgccaacaggaugcagacaggugcaauggaaacaguccuugcggagccaagacucacccaggguaaaauauuuccccucauagugacagggggcuagggaagaacgggaaauguuaguagguguaggagugcugaugagaggcagaggcucuucuggucugggguggagacaguaaguacgcacuauccccguauuuaguuugucuuuccuguuucacagcuggaggaagccuggguauuuugacacgggaucaucuguaaggccccauccucccugugcccucucugcugcuccuccauuccuaacgcuucaccccacuuuaccuugagcuuggaaguagcacuugcuguagacuccugggugcuggaggaguagagacaucaccaagcagaugaucccccagccuccuaggauccccuuggccuguccagcccagagcauccuuagggccauugcugcugcacagcccucucagacccuucuuggccucugcucagcuacucuggucuugacuccuugacuuugcuuugcguugcuccuugagucuuaguuucugucuuucuccccugggcuccugucucacacuaucucccugcccucugcucucacaggcuggggauguuuauaaagugaggacccuggcccccugcugaguagagcuggaaaaguuguaacucuguuuccugaggugagggcaugaaaac

SEQ ID NO: 13941 - RNA, 1385 nt, Homo sapiens
guuuucaugcccucaccucaggaaacagaguuacaacuuuuccagcucuacucagcagggggccaggguccucacuuuauaaacauccccagccugugagagcagagggcagggagauagugugagacaggagcccaggggagaaagacagaaacuaagacucaaggagcaacgcaaagcaaagucaaggagucaagaccagaguagcugagcagaggccaagaagggucugagagggcugugcagcagcaauggcccuaaggaugcucugggcuggacaggccaaggggauccuaggaggcugggggaucaucugcuuggugaugucucuacuccuccagcacccaggagucuacagcaagugcuacuuccaagcucaagguaaaguggggugaagcguuaggaauggaggagcagcagagagggcacagggaggauggggccuuacagaugaucccgugucaaaauacccaggcuuccuccagcugugaaacaggaaagacaaacuaaauacggggauagugcguacuuacugucuccaccccagaccagaagagccucugccucucaucagcacuccuacaccuacuaacauuucccguucuucccuagcccccugucacuaugaggggaaauauuuuacccugggugagucuuggcuccgcaaggacuguuuccauugcaccugucugcauccuguuggcgugggcugcugugacacgugagugaccaaagauggccagagagaaugacucugauaugagugacugagggaugaccagggagugacuagauugcugugauguaagaaugaacagaagagcaauacaagaugggccaaaccugaagggaccaacacuagugugaaagauaaggcuucaggcuauaaaucaggggagguugggguggaccuggagagaaaauacuccuguuauaaaacaaaaaggcccacauaugguaggugacagcuuaguuaggaggaccaaggggccacugaaaggggcucuguggggggaaaacugugagagagggaacaugugggcagggauaaaggcagccuuucacugugcugacuccuuccccuauccuugguuccccaggucccagcaucccaucgacuucccggcugggugugagguacgucaggaggcaggaaccugccaguucuccuuggugcaaaaaucugacccucggcugcccugcaaagggggagggccugacccagaauggggcucagccaacaccccuguuccuggggcuccugcuccccacuccagcuaaacucaacugaucauccaucugcugacugcucacugcugcugccacuuccagggaaaccacuagcagcugccaauguauucugaacaaauaaauuaaugcuauag

SEQ ID NO: 13942 - RNA, 18498 nt, Homo sapiens
ggccgggccgaggcgaccugacccggacgagcggcgcgcgcggggcccaggcggggggcgggaggaagcgccgggcagcgccggccgccagggcccaggagaagcggagcagagaggagcggggacacgggcggggccgccguagcuccggaugggaccagcgcccgggcccguuaguccaagcaggagcuccgggagaauccuucacagggagauuuaccccugccuuccccugcccuccggcccaggccucgcuucgcuccccgccugcccaugaucccaguccuuccgcggcgcgggcacccucccaccuuacccccuugguccuauguggcgcagcgcccuccugcccucccggcccuuucagcugugagguucccccaggccguuucuuuguaccacccgccccccacccccaccccaucccagucccagauccccuuuuccuucucagcuuuagauuuaucaggcuucuucaccucgcacuguccccauccuggccgcaggcccccucggucccucccucccccugccaccccguucucaguccucaguccuugcccuaggcugguagcccacuccuugcccgccccccgccuuccucccaucucccccuccucuccccggcccccagcaccuucugcaucccagccuaccuagccuacuccuccucuuccuggcccucuuccccaggcuccaggcuggggggugcucgcgucuccccuguaggccagagcagccccaaguucugggggcgguggggcugcugcuuuauccccauggcgcugccaucacuucugcuguugguggcagcccuggcagguggggugcguccucccggggcgcggaaccugacgcuggcgguggugcugccagaacacaaccugagcuaugccugggccuggccacgggugggacccgcuguggcacuagcuguggaggcucugggccgggcacugcccguggaccugcgguuugucagcuccgaacuggaaggcgccugcucugaguaccuggcaccgcugagcgcuguggaccucaagcuguaccaugaccccgaccugcuguuaggucccgguugcguguacccugcugccucuguggcccgcuuugccucccacuggcgccuuccccugcugacugcgggugcuguggccucugguuuuucggcuaagaaugaccauuaucguacccugguucgcacuggccccucugcucccaagcugggugaguuuguggugacacuacacgggcacuucaauuggacugcccgugcugccuugcuguaccuggaugcucgcacagaugaccggccucacuacuucaccaucgagggcgucuuugaggcccugcagggcagcaaccucagugugcagcaccagguguaugcccgagagccagggggccccgagcaggccacccacuucauccgggccaacgggcgcagugaguguggccugggcuauuuuagggucaugggaggagggucgcugugucccuaaagcucagcacuggggaacuguagauggagauaggcauugagcagcuguauguggugguugggaucaagaagcacacguggacagagcaccugugagagggccaaggcuucaucaugggagcuugugaacacccuaggcagaugcaaacaaggaagaagagagcaugaggggugaagccuuguaucaagguggaaugugaaaaugaggggauauuaaguuucgggagcaauguuugugcccuagaguagugaaugugauugauagccacucugaaaugugcccugucugugaucagagcuaccacccagacugggcgccaagaccccuuggugguguaaaaauaaugagggcuccaugaacggacucagggcucagcagauuugggaaagacagauaaagcucauacugagaaaucugugcugucugugccuuugagcccagggaagggcagggaagagucagggagcaggccgguuggguggggagcagcaagggaggcucugggaaagggaggggcuugagagugacagcucccuuccucuggggucuggacaggcucugacuucugccagaugguccauauggccccaggguacuuaugguggacuccaagaggggugggcuggggagcaucugcuuugggguugauagguuagggcacucucuuucuugcugaagagggacaucccagugauucagagagggggcugugugggggaccuggauaccuucucagggugcuccucugucauguaccugcucccaguuguguauaucugcggcccucuggagaugcugcaugagauccugcuucaggcccagagggagaaucugaccaauggggauuaugucuucuuuuaccuggaugucuuuggggagagucuccgugcaggccccacacgugcuacaggccggcccuggcaggacaaucgcacccgggaacaggcccaggcccucagagaggccuuucagguaucauuugagccaaaucugaaggaggagggggaagaggugcuucgcuggaaauucucucucacaagacccuaaagaaacccuaggaaccaggcaggaauugugagccacaggaguaaaaugaacagaggcauucugagucuagugucacccuuucuuacuucucuacuuuugugacucuuagugugcuugcugccaagacugacuuuggcugccuccaaaauccuaaaacacugacuuuccuaagugccaguaguaggcuauauugugggggagaaaaguucaggaagagaucugauccuagcccuugggugggcuuccacccuuuauggagaggugaggcaucguucugguacagucagacaaaguuugagaaaggauaugauuauguguccuggaacagacacuaagaacuuuaguggcucagaggaggaagagucagugugggcuguguuuagggaaggcuuuuacacaggaagugagaccguauugugacuuuaaugauagaugucauauucauagucagagugggagaggagauccaagcauccugagcaaagagaaaaagauaggaaugggcguguuugagagaccaagaagauacugacccgacaagaaugagggguucacuuaaaggagauacaggaaauaaaguugcaaagguagaaucagauuaaggagagcucuaagucuuaaggcacuaggacuugaauuugggguccuugacuuuuuguguguguguguguguguguggagauaauuauacaguagugacagaauucaggauuagaagagggggagaccuggggcagugagaccaacuguaacagauuagaagggggugaggugauauagcuugaacuagugugaugauagcaggaauggaaagaaacgcauuucagauuucagaaaauuuguggggaauguuggcaugacucuguucauuucacuccugcucaaaacuuucagugacuuguguucuagagaauaaaauccugacuccuuauugugacauuuaagaccuucugcagucuguucucaaaccacuuuuucagucuuaccuccugguacccucaugcugagaacugcagccuaccaggccucugaguucccccaaccccagggccuuccugccccugugccuuuauguucuuuuuccuuuugucuggaaugcucuuccuucccucaucccaaauaucugccucucaaaaucauacccaugaaucuucccgauucccccgccacuuuuuuacuaaccgugcauauaaguguuucccguguauuuauccauaucccuccuuuuuuccaagaaggauuggagguggcuuaugggauaaccuuaaaguccuuuaaacucugggauuauuugguucgaaguagcuguguauaagggcuggaccuggguggccauucuucuccaauaagguuuuauguggcugugauuauauauuugguugcgacugacgagugugugucugacugagaaugacauagcuguuugcaugccugagaaugagucugugacugucacacuugaauaugggcaguggcagggcagguuuuguuuaugccauaauguuuuccuaaaacaaucuucucaccuuugucuggguaaugcuuccauauucuuuaagacucauaccaguuauuuuccuuucuaggaaaugaucccagaaucccuaagugggacugaauuuccuacucuuuugcuuaacuccaucuaccauagaacuaaccauauuauucagucuguguuugauuuauuugaaggcugacucauuucauuaguauuuacugagcaccuaucauguccagucacugugcuagguacugguauacaagggagagcauaacagacuuuguuccugccuuuuuggaguuuacauuugguaggaugggcaggcaauaaauaaguaagcaaauaaauacaaauguaggaacauauugugauguguuacuaaaacauaaagaggaaaggaauagaguguuaugaaaagagaagaacaaggggauuguacuucagcugguguggacugcagaagaucugugacccucucagaugggagcacuccauaaccuuccugguuauauccuuuuucuuuuugagacagcucuguugcccaaguuggagagcaguggugugaucacagcugcucacugcagucuugaccucccaggcugaagcaauccucccacuucagccucccgaguugcugggacuacaggcauaugacaccaugcccagauaauuuuuuauuuuuuauagagauggggucuuaucauguugcccaggcuggucucgaacuccugggcucaaaugaucuucuugccuuggccucucaaagugcugggauuacaggcaugagccacugcgccuugcuggcuguauucuauuuguggaagaaaagccucacuuucuucugugagcauuauugcccagccaagaguccccagcauuaaggguagcuagaggagggaucuagucauccaauaaucaguuauaucaauuaacucucaguucucccccucacugugggcauuauucagacagagaaauaaagagggaaucuuugcugcaacacaagagaagggaacuaggcaccaggaauaugcugaugggaaggucaaggcuuuggguagguggggcugaggggugauaaggugccccgccccccaccuuccaauggggaagcaggggagagucugagggaaguugggcaguuagcuacagccaagcaaggaugaaagagcacagagccuuucucccagagacacuggcccucugaggucccagaccaggccagccuggaaaagguggcaauagaggaaaggaggccuugacacagaugcccacagcuuuuccaggaggguaucaugcucaaggaaaggccuuagcucaugccguaucgauacuggcuacuagggagagagcucugaaaucaaguauguugauaugauuuuucucucccauuuagccacuagcugcuccagggcagggaucaugcucaucuucauauuccauaugucuagcauguaguagguguuuaacacauauuugcugaauugaauuagggguguguuggggagagggggauaggaugaggaauucaccuagacaggaguagagcuggcaaguaauguaaacuaggugaucaaccaggauagggaagaaaagauugaguggaacuaaauaagcaaugaccaggcucugaggauccagaagcccaggcuggucaauggaggacuacaggguuagaaacccaggcagaggucacaaccuacaugaccagcaugagauuggguuacacacagggagcaccagcggcaagaauggaagaaagcacuaaaccaagggcuuggagaucacuugucucauuaggccacuguugaccacucuccaguuggccagggcaagucucagugggcggguccacagauagaggcaggugccuccugagggugcacauuuccuaggugugcuccuggcacccacccaccacugcacccauuuguggcggacuuugcuuguuuuuuccaccugggguccacugugaaaugggacacaauuauccuccuucacuuucucucaaaccccugagcaagcacagaaacuguuugagguuggguuuuuuuuuuugguuugguuuuucauuuuuguuuuuugguacuacaacuacaacuaguaaccacagcaaaaacaguucuagcauagcaguuuagggggaccauggggucaaaacuauuuaaaaauaauacaaagaucuuaucugcuuugucacgcuuguucuuuugugauuguguagggaaguuuuccagagguuacauggcaugaugaugucaucacuuggacagcuauggaaggugugcuuguguguucuugcguuuucaaaauuuaucaguuuuaauuucuaagauggucaauauugauagauauaguccacauaaacaaacuuuauuugggguccuuaauaauuuuuaagaguauaaagcgauugugagaccaaaaguuugauaacugcuagccuaacaaacuagccaaacuuaguguugagaauuaguguuuaaaauguguuaaaaaccuaucaucagccuuuauugaaauauaaauuguguugaaccugaucuuuucucgcccuuuuccugacuuuuuacauugcuugucaacaauauucuaccucuuuauuuuauucuuggaacaggugcuacugaaugaacuauuucaacccuuuccucaauucccuucucuuuuuaaaaaaauuuuaccugagacugggagaauguuagaaguguguaaucaggcagcuaaaugcucuaguaagaauaaugauaucuugaggcaagcugcagucuaauauaauauaaugaaugcauauuagaaaucgacuuuauuauuuccuaucucuaaugaauugauacauaauaggccauaugugaugugucuagugcagcguaucucuaugguccacauguacuuucuaugacaagaauaaacaaaacugggagaaaugaccggauuuuaaauuaucauuucacaaagucauguuucauaaaauauauugaacugaagucuuuccuugaaguugugaugccaguuuccuguuggagcagaaguuggucucagugacuauguggccugaggcagggccugagacugggagguccagcagcucaggaaggggaaaugugugagacuaaugggagccaagcaggcacuuuggugagagacagagaugcugacucaugcgccagugagaugugugcaugucugagaucacaugugucauuugcuuaccugugaaaugugugugggcaugugacuguguguuugucccugugacacaucuauuacucaguaagcaggacagugcuguuugugguagguguuccacacauuaaauggaugagcacacagcuuuucacagguggaaucacugucucaaaguauuucccucaguugucauagggccugaaaucucucuaauucacugggcggagacacuguguucaaguggccgaaaugacaauguuaguauuuuacugaugacauuaacagugauuaacaucucagagaggagcuguuaguggguguuguccuugaucauaagcagauacccagaaagcaugggacagaggagccgugugagcugugguggccuggcaggaaccuggaugcuggaagggagcucuggaagauguugggcugggcuuuggggaugggguugacuauuauuugccaguuuccaccuucccagaaccaguccuaucuaccuuucaggaggagugccacucccucuucccagauguaugcaacacaacacacacacacacacacacacacacacgcacacacacacgcagagagagagagguuaguagcccuuucaaagccuucagacucaccuguguauauuuuauaucauguauauuuuaccaaguuucccuguccugcaucuucucuucccauaaugccuaucuugaauccuguucacucuuccccauaugcugcugguacagacuguauuggugaucacguaccgagaacccccaaauccugaguaucaggaauuccagaaucgucugcugauaagagcccgggaagacuuugguguggagcugggcccuucccugguaaguagaucucucccuuccugagagucaggucaagcuuuggggaagggcuucucucccaaacucagcaucaagucuuggcuguggagcaagcccaacuuuggggggucuccgcuucuguccaggauuuuuccuucugcccuauggaguaguuaggaagggauggcacuuuaggaauaagagggaagaaagcaaaccagaagagagaauagguagaagggagaccccagagagaggggaaggggccuugcaggacauuuggagaguacugcugaaguugccacccccagaugaaccucaucgcuggcugcuucuaugaugggauccugcuauaugcugaaguccugaaugagacaauacaggaaggaggcacccgggaggauggacuucgaauuguggaaaagaugcagggacgaagauaucacgguaaugaagaggggucaaugggggucugagggcugaugucaggaauagagugggcugaagaagaaacagaugucaggaucaccacagcuuuaguggggguuagugaauauggcagaguugcccacaccucaagaucggggaaggguagacucugagggagccguaggcaugagugagugggagaggagcccaggguagaccucaaagaaaggacacucuuuucugucuuagguguaacugggcugguugucauggacaagaacaaugaccgagagacugacuuuguccucugggccaugggagaccuggauucuggggacuuucaggugauggaggaggaggcagggaagagaguguggcccugcaaaauccagcuuucaaggguucagucggggcagaaccaaaacuacuagaugagggauuuguuuucucugcuggcacugcauccuggcugggugguaggcuggggagaaaagcagcgaaacagcuggggucuggggaggaggcuggugggagcaggccugugggcccagcuuuuugcuuccuuacagccugcagcccacuacucgggagcugagaagcagauuugguggacgggacggccuauucccugggugaagggggcuccucccucggacaauccccccugugccuuugacuuggacgacccauccugugauaaaagugggugugugcagggacugggagcagcuuuccucccuuugcuuuccauucauggccuccacccucacugacccuccacucuuaacugugcuucugccuuuacgucugcaucccucccuccucauuucuuccuacucccaaggagucugucuaugcaccuaugcaccccguucuccauucugccaaguccgcacacagucuuccucagggucucuauuuccccuucagcuccacuuucaacccuggcaauuguggcucugggcacaggaaucaccuucaucauguuugguguuuccagcuuccuaauuuuccggugaguucuggguuucuugcugaccuacucccugcccccauugccacacaaccucuggcugaagccagguggucccuauaaugugggauaggguaguagguuucuuaauuugcugguugucucuuagauccaacagcgucuuccucucuagccuuucucuuuaguugucgcuuagccuagguguuuguuccacuuuugguccuagacuggauauacuaacuaguguuuuucagugggguuaagaucaaaggugaauuuuccauuggucuucuuuuaggaaagaacuuucacccccagucucuguguuuguuagugagcauagggcaugugccagauaugccgagaaugcagccuuaucuuccagcccugucucucagguguaacaguugcagcuucaggagcugcagggaagccccugcaacccugcuguuggcuuggggguggcaggauucggcuugccagucaacugaggugugcaguccuuacagaaagcugaugcuggagaaggagcuggcuagcauguuguggcguauucgcugggaagaacugcaguuuggcaacucagagcguuaucacaaaggugcaggcagucgccucacacugucgcuggugagcccuugucucagcuguuccucugccucccucugaguuccugucccuucuuacccuggaucucucccagcacauuggcuuguaaugauagccccugcacuaccaccaucaucuaauguuccuuucauccuuccgccuccauguugcccuuggccccagcggggauccaguuacggcucgcucaugacagcccaugggaaauaccagaucuuugccaacaccggucacuucaaggugaacagucauuugcuuguucugguccccaccauuucauccugucucauccccaucugccaccucugccccugaaccucugucccucauacccgacucucugugcccagcugagcuccugggugcuuccacugcucucuagcauuuccuuguacccagaacuucugauauucacuuuccuuuccccuuucacucccaccaucagggaaauguugucgccaucaaacaugugaauaagaagcgcauugagcugacccggcagguucuguuugaacucaaacauguauguaacagaggauggacucuaacauguauguaauggaggaguggggaaaacuaugaaauaguaaaauuggcuagaugggcaagggguugauuuauaaaugauuuuaaaaucguagauacaacuaagagaaagguccucuuauguagugguaaguuucuguaucuaauuuuuaacucuuucaauuuucuuauccuucccauuguuuuuuucugccagaugagagauguucaguucaaccaucucacucgcuucauuggcgccugcauagacccucccaacauuugcauugucacugaauacuguccucgugggaguuuacaggugagggauagguguaggagauuauggcaggggugggaaggauagacccaaaguuauacugacucuaugcugggugauagcuggugggaccaggacagacagucuauuccaugucacuuaccaggauauucuagaaaaugacagcaucaacuuggacuggauguuucguuauucacucauuaaugaccuuguuaaggugagucuuccccacuccuuaaaaguucauccacuuuaaaucacuuccacuguucuuugauugugguuuuucuccuucuaguccucugaaguccuguucucucaucuccccuuauucccauggucugguaauaauggguaaacaaggagucuggggcuuauaacugggacagugaguuuuaccugccacaaggaguccugugccuguagagaguuucuaucuuucugucuuaaauaucucaggucucuuuccaucaucucuuuuaccucuaagaacucauaaaaugaguggagucucugaacauauuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuguauuuuuaguagagacgggguuucaccguuuuagccgggauggucucgaucucuugaccucgugauccgcccgccucggccucccaaagugcugggauuacaggcgugagccaccgcgcccggccugaacauauuuaucucuuguuuuuccucucauuauuuuacucuccgaacauauuuaucuccuguuuuuccucucauuauuuuacucucugaccaauauuuggcaugucugcccuuuuguucagaaaacugaaauuuaaaaaaggaacauuuacuaguagaacuaagagaaaccaaggaagauuguacuaaaaaccuuugguacucuucuguuauacuagguuuuagcuauguucaaaugacucagaggcccauggauuuguggagcauaaaauagaaucuugcaugaguuggacagguuuucugaaauaagucucauagccaaugagcaucccaguggaucaccccacacuguaucugaaacuagcuuugguuuucugcugaauucucaugaaguuauuuaaaaaguauuuuuuugugugugaaaauuugcuaucaaaugagagauaaaaauauuaguaaagccaaugucaugcucaacuagaggugugaugauaaacauaagacacgacucuugagagaacagugauuugguggaaaagugauuuacaacaaagccagaagccuaauccugugauuguugaaggcauccuuugcacaguuuccacacaaguaaauucacaacuucagagauucccaaaaguuuuguugauaccaaaauaaauaaaaaggaagaauucauagagauuagaguuaugaauuaaguccagagcuaaacauuuagacagaaauguuuuuuguuagcauauugaaccuuguauccucuuucugucucaccugaacugacuuggguggcuccuaggguuucauuuuuggggagcaucauuaagacuuuuuuuuuuuuuuuucugagacagggucuuauucugucacccaggcuagaguguaguggcuaggucacugcucacugcagcuucgaccuccugggcucaagugauucucccaucuuagccuccugaguagcugggaccacagcgugugcugcagugcccggcucauuuuuauauuuuugguagaggugggguuucgccauguugcugaggcuggucuugaacugcugggcucaagcaaucugccagccuuggccucccaaagugcugggauuacaggcaugagccacugagcccggccuuuaagacugucuuucagcuccucggaggcaaagguuuuucccucucuggacccacagagccagcaguuuuaggcuucugcacuggcuuagcagauuuuguccauuuuccagguuuaugauguucugcacuuucucucugauccagcauucccucuaguagaucuuguuccuccucuaccccgacuugcccaccucccucuaguagaucuuauuccuccucuaccccgaccugcccaccucccucuaguagaucuuguucuuccucuaccccgaccugcccaccucccucuaguagaucuuguuccuccucuaccccgaccugcccaccucccucuaguagaucuuguuccuccucuaccccgaccugcccaccucccucuaguagaucuuguuccuccucuaccccgaccugcccaccucccucuaguagaucuuguuccuccucuaccccgaccugcccaccucccucuaguagaucuuguuccuccucuaccccgacuugcccaccuacgccugguuaugcauuaaaguuuacaacuggucuuccuugguauauccagcuacucuugauaccugggucucaagucaugucuuccuaauuaguagccagguaucugaggccaccauggguguuauaucauuuuggucuucacccaaguucuguucucuucacuaaucaagaagauugacugcccucuccaggguagucauuuguagcuccacuuaucccucuuuuuaagcauuuucccugucccugguggcugggugccuguguccugcuuaugauaccaggaacagaugacucuucuguucuuccugcuuccuuggguggaaacugcaaaggaugccuuccaaaaucagcuuauuauuuuuguggacccaagaucuguagacagcuagccagugcccaucucauggagagaggguauucuaagccagauaugauccaaucccaugacuugaucuguacccugcagggcauggccuuucuccacaacagcauuauuucaucgcaugggagucucaaguccuccaacugugugguggauagucguuuugugcucaaaaucacagacuauggccuggccagcuuccgaucaacugcugaaccugaugacagccaugcccucuaugccagugaggcccacccccacaacccacuuuuuauauugcuccucuuuccaccuagggauggugggagagggagguggagugacaguaauauagggaugagcccaggugggcuugggggugccccauuucgggggaccuggccagccgguuuccucuuuucagagaagcuguggacugccccagaacugcucagugggaaccccuugccaaccacaggcaugcagaaggcugacgucuauagcuuugggaucauccugcaggagauagcacuucgcagugguccuuucuacuuggagggccuggaccucagccccaaagguaagagucaauccacuacccacagccucuucuuccugggggaacucuguucuucauccaaaccuuugaucacccucagagauuguccagaagguacgaaauggucagcggccauauuuccggccaagcauugaccggacccaacugaaugaagagcuaguuuugcugauggagcgauguugggcucaggacccagcugagcggccagacuuuggacagauuaagggcuucauucggcgcuuuaacaagugagagggcauuauggggcaggggcuucccagggauagaagacucauuaguccuagugcaugaaguggggcaggugggaccagaggguggguuggauaggaaguccugggaaucuucagaaucuuagagcaagugccuuauccuggccucccucuagggaggguggcaccagcauauuggacaaccuccugcugcgcauggaacaguaugccaauaacuuggagaagcugguggaggaacgcacacaggccuaucuggaggaaaaacgcaaggcugaagcucugcucuaccaaauccuaccccagugagacuuugucccccuuccuguauuuucuuuugggauucugcucuguugggcucugccucaucaggcaccugagaacucgccuccccacccucagaacccugcuggccacagggagcaccccugcuuauagauuauuugcugucauucugucuccacaucagcuaugcugccuucuuacuggcugcccaucccuucuucuuaagacccugcucuaccacacccuugcuucagcaaguguauguaaaacagucccaacuugagacagcucccaugcacagggauuccccucaaacccccccgccacuugugugccuuaccuugcauuagacuguaaugucuucccagccacuuuccucccucccaccugaaaagccuagcuuucuuguuacagcucaucucugcugcagccacauacacuuucccucucucuuccacuccugcucucuuggaguuuggcucauacggcacccuugcuuccuaguucaguggcagagcaguuaaaacggggagagacuguacaggcugaggccuuugacaguguuaccaucuacuucagugacauuguuggcuucacagcauugucagcagagagcacccccaugcaggugagagccaugggugagagguggcgggugggguuggguggguagggaccuggggaagccucauugauaauaggaaagaugaguuuguucuagaguucccacaucuuuugauggcuuguggguuaagaauucuuagaaaauugggcacaagucucagggccucugcuuuucuaucccuuuuagguagugacacuucuuaaugaccuguauaccugcuuugaugccauaauugacaacuuugaugucuacaaggugagagcuggggccgcuguucaauagaagacccuuuaauagagacccgcuuugaaacucagucucccugaaccccacacaccuuacccaccccaugaucaguuuucccuccaggguacucagcauccuggugcuggaguguacuucguagacagauguagcuccagcacuauaauuguacacuccagucgaauuucuugugaauccuuugacuucccuaaucagaaccaucaugagauuuagcuccuaucuuccuggaguauaaauacagccuauccaacauuucucuccaguccucuccagacauggaagaaucauauaggauguggguccagacugauuuaguggggugagggaaaauauauuuuaaaaaguaaaacuuuuuguugaaguuauugaguuggauuuauuguccuugggaguaaaaaucaucuggauuugaauauuggcuuguugcuaacuguguggccuuagguaagucacagaaucucccugagccucaguuguuuuaucuguaagaugggaauaauagauucguuguauggaaaguaccuaacauuguuuggcauguggcagacuacuauuuagggauaacuacuuuaucccuaaauacuuaguguguauuuccuaaaaacuucacuguguauuuccuuaaaacaauggcauuuauucucuuacauagcuuuggcacaauuaccaaaaucaaaugccugcuuuccuccucucugacaguuugggcugucagguccauuucacugggccugcuuuaccuccucaccagccucuguccucuugaguuaccguuuucuugcuucccauuuccugauggcagagccuauuuguccauguccugcugcagacaggguguucauucauuccgcaaauguuuacugaguauucaccaggugcuggguggagaaagaagacuuaaagauucccuagacaucuccucuccccuagacucaggaccauggcacuuauuuucuagucaauauucuggucuccagcaugucaggaugauuaaugauggugucaagcuugucucccucuacuuuuucccauccccauggauauaaauagaggugaccuuuuaaucccccucucaaucagguggagacgauuggggaugcuuacauggugguaucuggccucccaggccgaaauggucaacgccaugcaccagaaauugcucguauggcccuagcauuacuagaugcaguuucuuccuuucgcauccgccaccgaccccaugaccagcugaggcuacgcauagggguccauacugguaaggcugacucucacuccagcccuagucuccaccuuucccagacucucccaaccuguuucuucucaaagggccagucugugcugggguuguuggccugaagaugccccguuauugucuuuuuggagacacagugaacacugcuucucgaauggagucuaauggucaagguaagacauuagcccucaaccccacuguuggccucaauuuaucuugcccuuuucuucuuuucauaaucccuccaauuucuuaaucugagagaccacaguuccuuagugucgcauccucgggcauauuuugguucuaauagauaugcauugggagguugggcauauuuugguccuaauagauaugcauugggagcuucccagggaugguuggucgggcacggugcuauacaguaucaccaauuauuugauugccuuuucuuugauuccucauuccaccauccuccccauuccacccaccccagcgcugaagauccaugucuccucuaccaccaaggaugcccuagaugagcuaggaugcuuccagcuagagcuucggggggauguggaaaugaaggugauggcaggccauggggaggggggcauggaaagggagggugaaagugauuaugggaaucauagggaaagagagggagacaaagggacuaacaucgaagcaucugaaucauguccacucucccacuuccagggaaaaggaaagaugcgaacauacuggcucuuaggagagcggaaaggaccuccuggacuccuguaaacccccauucuuuccaagucagauagucuucugcugcugguaccugggugggcaauggccaccaugucugcacacaccagaaauggacauuuucauaugcaauggaaaacagccacaaaaaaaccuaccuuauauggaaguuguagcccucugcagcucagcccuguacauauaccugucccucucuggcuugguccccuuccucccuacuuucuguaaauaucuguaucuaaaccagaauauuuuggucaaauauaaaacaauaauaaaaaaaguucugaugucauagugugggauaggggcaaucccaaggaaagguuaugggguaugcacacagugacucacagaaucacuaaauuagcagucuugggaugagagagaacccuuuauguaaagccucuucaaguacagugagaauuaacuuccucccgaccucucuagugcagacagaaauagauuccauauuccauaccccacuucccuccucaccccucagaaaggagucauucuccccccuccaccacccagccuuccuccgggacagggaagggaagauauuucucccaauugguagggguaauucucagguucauagggcaaaaguuuccccagagacaaggguacugguguugagaagcugcaguucuuccggaaugguguguccaauguccugauguuacug

SEQ ID NO: 13943 - RNA, 2100 nt, Homo sapiens
cgcgcccggaguccccacccacggccggccgcggagccgagugcugacccgggugagagguucccgcggcucagggaagauggcggcagccguggugcuggcugcuggguugcgcgcggcgcgcagagccguggcggccacgggggugcgcggggggcaggugagaaguggcgcgggagcgaguaggggguccugcgggcuccgaagccauccggggccagggggucccgaaggcgcgcagagccgcgcagagcuccugccuguggccucugccccuccgaggcacaagcuccggggcuguguggugaggucgaacugguggcuccggagaacgagcuggugcugauucccgcccugcgcaggccggggcgccgaggucgggacagggucagugcagcggcugccgccuucuuuccacugccugcagcccagcuggcccgaugcccccugcaggaaaugagcuuucucuucuuggagccagugcucugcccuccucaggcuucuggccuccuaaugagcacuaguguuaaccucucuucugcacuugccagaagcggcucggaggucagagaauucauuccgucccguucucccccaacgugaugcaaugacaucagccuucucugaaucccuuacccgaaguucccuggggcuaggggagcagaggucacuuagcugaacucuuaccuccacucauucaagggacaagaguuaaaauucacagagucacaugugacacccagaugaggggucaacuagugucaaacagggcgauugcauuaaaacuuaaauaaaacaggcgacaaggcuuaaagaucagaaaacaaguaacggaaauaaguggaaauguacuaacaaggugagaguggaaagagauucaagccaucgcaagagauuauggaaaccaucccuuuauuuuauauuagaagcugagagaaggaauuuaucugagguaauucagugguaugguaagguaggaacugagaccaaaauccccagucucucauucuagauccuuucccuaaacagugcuauauuucguggacacaugagcaggaaucaauugcacugcugaauccugauaauaauaccgccuguuaucuaaccagguccagcaccuucuggcccuacccuuugcugcuggugcucugaaauucaggaacuuuccuccugggugggaacgaugaauagguuauuagaaggacgaaauuaacaacuaucagagcccagcuucugccagcucccuccuuugaauauggucgauccaccuucagguccgaggagcugcaggugugacugaugggaaugaaguggccaaggcccagcaggcaacuccugggggagcagccccaaccaucuucucccggauccuggacaagagccucccagcugacauucucuaugaggaccagcagguggggugcucuuaggaccuauccccuuaggaauguuguagauaccauccaaccuguugaaguaacguggccucuggccugucacuucccccagugucuuguguuccgugauguggccccucaggcuccugugcacuuccuggucauuccuaagaagcccauuccucggauuagccaggcugaagaagaagaccagcaggugggaagaacagggccaggguuuggcugggaggagccccuggacccagcuagaggucuugcucccuaugaaugaagccaccuaugucccuccgcucucucuauagcuucuaggacaccuacuccuuguggccaagcagacagcaaaggcugagggccugggagauggauaccgacuuggugagugacuuuuggcccuuggucccucaccuaugaauucucauuccuacuucucaauaugaucuucauucuucgaccucugccaugauccugacucccuaaccccaagcucaauuucagugaucaacgaugggaagcugggugcacaaucuguguaucaucugcacauucauguacuugggggccggcagcuccaguggccuccagguugaaccugccaacugauuaaaggacaccagacucuggaugcuuggauggaaagggaaaaauggacccugugaugcuaauaaaacuguucucccuuaau

SEQ ID NO: 13944 - RNA, 941 nt, Homo sapiens
cucaccuggaggcccgacuccugccccacaccuuccuggcggccuccuucaccuccuuguuccucaggcuguagauggugggguucagcauggucgugaccauggcauagaggacugugaagaccucaucagagaugugggcuuccuuacucuugggcuucaaguacaugaagaugauggugccguagaaaagcagcacuacagccaggugugccaagcagguggagaaggcuuugcagcaccuggcggccgagggcacccucaggaugguggccaggaugagcaaguaggacaggcagaugaaugccagggguacaggcagcagcaggauggagcccgccagcaggaagucuucgcugaccgacguguugccgcaugccagcuucagcacugccaggaucuugcaggugaagugacugaccacgugguggccacagaagggcagccucauggagaugaccaucucagucaccgacuugaggaggcagaggacccaggcagcucccaucagcagcacgcagagccgguggcucaugagcacgugguaccugaguggcuggcagauggccagguagcggucauaggccgugauggccaguagcaggcacuccguggagcccguggacaggcucagacacaucuggauggcacagacagcaaaggagauggucuuccgggaugacaggagguggaccagcaucagaggcacaaaggugggcguguagcagauguccaggguagagagguugcccaggaagaaguacacgggcgugugcagguggauaucuagcacgcucaccgccaugauggcuguguuccccaggagggucaccagguacauggcugagcacagagggaagagcagaugcuccagggcuggguagccagaaaauccuuucagaaagaacucggacaccucuguucuguugagcggcuccaug

SEQ ID NO: 13945 - RNA, 494 nt, Homo sapiens
gggucaccaccccauagaaaagggaaaugaguuugucugcaaggucuugcuugucugcccccagcggguccuuagacuugggcuucccauacaugaagaggauggucccauagaagaugaccacgacugugaggugggcagagcagguggagaaggccuuuuuccuccccucagcugaggggauccucaggaugguggcaaugaugaagacauaggagaaagagaugaacagaaccgggacccccaggaagaucacauuggucacucccauacugaucacauugacagagauaucagcacaggccaacuucaggacagccagaaucucacaggugaagugguugaugauguugucuccacagaagggcagccucauugcaagggaugucugcaccauggaagcagugcuuccagcuacccaggagccggcagccuuaugggcauguaggcagccuugcucaugaccacaggguaccuaaggggguugcagaugg

SEQ ID NO: 13946 - RNA, 12558 nt, Homo sapiens
gauugugccccaagcacaugaggcaggagaagcagaaaggacccuucaccugucacauguccugagcccucacccuggcguucagacccagugucacuguuucugacauguagccucuuuccaaaccuuggaaaaucgaucauucuugcucaugauguuuuuuuauaaaaguaagggcaaguuuuggugaaaggaauuccacaauuuucauuagcauuggcuauauuuauuuuuuaaauaaauugauacauaauagauauacauaauagauacauaauaucuauuauugauacauaauagauauacaugguuuuaagguacaugugauaauuuaauacauucauauaaucugcaaggaucaagucaguguaguugggauauccaugacuuuaaacauuugucuuuaugcuagaaauauuugaauuauucucuucuagccaucuugaaagguauaguagcuuauuguaaacuauagucacccuccugaccuauugaacacuaggucuuauuccuucgaucaaaccauauauuuucacccauuaaucaacagcaugguuacauuucuaucaucagacuugauuguaauggaaugggggcuugaggagggcagaugugaagcuguuucauugguaugauauuauucucacaaaaucaaauagaccuccucaaccugcaagaaugucugagaucaucuggccucacccugccaucaugcugaggaaaugggggcuugccagggaccauacagcugguaguccuucucacgauugguuguccuuucuugauaaaaacuguugggcucuuucucacuucauaguuagauacaaagucuggcaauaauaauaagcauguuucugaaucugauaaugaugacauagagggaauauuuucuucauaugaucugcagguucuugagaguuggcuggccagccuacagugagaaacccagcuggggacugauacacugcccaacacacacaucccagcagcagcgugucucgggcaccucagccauccucaagcuuggggaccauucuuagugucagccuuuguagcgagcuccugguugauacauuugccucuaagagauauaucuacuuuuuuaagaccuuaagagaaaaagggagauuuauucuuauuuaucuucgugcugaaaccauacuauuucuagauauuuaggcaguuguguguaagagagauuaacugccuuuaggggcuccagaagacaaggccagguagaaguugcaaggagacagauuucagcucaauaucacaggguaacuacuucaaaaugaagugagccuuaccaggagauaaagaaccucacaucacucagauagucaaaucuagguucuaggacuaucaggaaugugguaaggggcuuucugcauuagaaagggggcaauuacuaaauagacccuaagaccuguuguccuuagcauucaaguaauuguuaugguugaugaugaugaugaugaugaaagcauuuguuugcaugacuauuuccccacuagauuuugagcucuuuguucccagcaccuagaauuaugccuggcccagaguagacgcucaacaaauaucuguuaaccugaccugaauuauuauggcacugacuuggucacagcuauaaugugcuaaccaccaacauaggaguaucucggagcucgugaggcaggaagcaucgcugcaacaacagaggaggggguuggauuacugagagcucuuggaaagauagauaucugggaaguuuguaaguauuuuagauacaguucuaauaaaacuguagugcucaguugccuacaaguuuuuuacugguccagaacaaaucauaguuugagaagcacuucgaagucugaggaguguugaggaaacaaugauucaucaguacuuguuaaagcacggcaaagcagacuuuauucaggacuaucucaacauguauagggaccacugccaugggauuuugcagugagggagagaaauugggcucaacuccaaauacagcaggcacaagugggaauuuuuagccaaggagggggcuggagguagguagauagaaaauuacuaagaagaagcaucggggguaacggggauucuggcuaaauggaccuaacagaauucuugcugaagagaggacaggguaaucagacaucaccuggggaugguggaggaugaggaaccucaucaaacauugaagaugaccagauauugaggagggggguucuugcugaacugacuuagcagggcuuuuugcugaaacugaauuuuauaagcaaggacacagauguaccuagaagaagguucagaugccuggccaaaguuuggaaaaucugagaaucuuugucaagagagauuuaaccuuuccauuaaauaaaaaaguaacagagcaggacccaggguucugugaacagucucaggaacaaguuaaugccuuugccgcaggcaauggagaaugaagagaagacgggagguucaguuggaacugucauucaacuuggccauggggcacaggggccuacuugcugccacagauguacaaaaggaucaaccaaauguugagaccuuggcaccggaugugucggggugcccggggcuugcugucuaggcaggugccacuagagcuguccucuuggcugcuacaugccccaggagacgcuuuauuuucuguuguugcuuuuuuucuguuaguuuugauuuguuuucuugucuccuugugugccuuauucuuuuuuagugugugccagauguuguguuugcaaaauuauuuguggaaaugauuuagagacuagggugauguuaucuuccuccaaaguggaucuauguuggcuucugugaggcauuugggagcaucaaaacuugguaucaccucaauucgauuucagggcuugggaagauuugaagcugaacuacagcaucuguaaaugucuguuuccuucugauuugcccuuauuccuauggugcugcccuuugagaguccaucccaaaaggagaacauuuagugaggggccuuucaaggugagucuuucacaacaaaacuuacuccccaucuccaugaggcugucaguaaugcuucccagccucucccuggcucccuccagaagcugcaaaugcucgaguugaaucacagccacaagugcuagacuuacaucucuagguccuuguuuuuccccagagucauaacccuauguuccucauugucuuauuacuucuccaauguuuuauguauuuuuuccaguuugucuaauggucaucugcaagacaguuaguccaaauuagccuguuuguucuuaccagaagcagaaguuaaauauugaccuguacuacauuguuccuagaaccccauagagaugaacaaaucaucagcgcuauucuccaguugcucagcagggcaaggauuugugccuggccuuccagguacuuuuggaguaagaggaugcugagguugaccucugaguuccuccaggugacagagcagaugcaccaugaacagguccaaugaggccuccccuguguugggguucguucuccugggccucucugcccacccauagcuggagaagacauucuuuguguucauccugcugguguaccuggugauccugcugggcaacgggguccucauccuggugaccauccuugacucccgccugcacacacccauguacuucuuccuggggaaccucuccuuccuggacaucugcuauacaaccuccucauccuugacagcuuccugacccccaggaaaaccaucuccuucucagccugugcaguacagauguuccucuccuuugccaugggagccacagaguguguucuccugagcaugauggcuuuugaucacuaccuggacaugugcaacccccuuagguacccuguggucaugagcaaggcugccuacaugcccauggcuguuggcuccugggcagcugguaucaccaacucuguaguacagauaucccuagcaaugugacugcccuucuguggggacaaugucaucaaucacuucaccugugagauccuggcaguucuaaaguuggccugugcugacaucugcaucaacgugaucagcaugguugugaccaacaugaucuuccuugcacucccaguccuguuuauuuuugucucauaugucuucaucauugccaccauccugagaauccccucagcugaggggaggaaaaaggccuucuccaccugcucugcccaccucacugucgugaucgucuucuaugggaugauccucuucauguaugggaagcccaagucuaaggacccaaugggagcagacaaacaggaccuugcagacaaacucaucuccauuuucuauggaguggugacccccauucucaaccccaucaucuacagcccgaggaacaaagauuugaaagcugcuaugaggaaccugguggcucaaaaacaccuaacagagugacuaucacagauccccagacugcgagaaugcauaaccuccaaauuccucauuguucuuuuggggaaaugguaaccagggaggaccuuagacugucaauagaaagaaccauaaaauuucugaggcugcugguuaguuugcuggcuuuacacagaaucgugcugugucauaucauagcuauauuuuacugacuaaaucuuaaauucuuugauacagaauuugaugaauauccauaagaguuauagagguggucaaaagagacaaacaaacaaaaauuuuagugguacugggaucuuggaggauacaggauaugguugggcucugugucccugcccaaaucuccugucgaauuguaauccccaguguuggaggaggggccugguaagaggugauuggaucaugggggcagauuucccccuugcuguucucaugauagugagucaguucccaugagaucuagauguuuaaaaguguguagcaccuccuguuucacccucuuccuccuacuccagccauguaggacaugauugcuuccccuuugccuuccgccaugauuguaaguuuccugaggccuccccagccaugcuuccuguacagcauguggaacagcgagccaauuaaaccucuuuucuuuguaaauuacccaguuucagguauuucuuuauaucauugcaagaauggacuaauacaauguuguuuuguccuguguaaaacugcuacuuacucuacucugauuuuguguuaccccagagaccuuugcuguuucucauguagggauaaauuggaaaaugucaucugccccaacauauaauggugagcauuagcacuauggcaggaauucuucucacaucuuagcacuagaaauagugagaccugagcagcugcuuuguuuugaccucaugggcacuaagaaucuugucauucacaacauucaucuauuuauugucaccacaggagaauucagaggcaaacuugccaccccacugaagcaguaacuaaguacuguaugacugggugccaguagcuuccaaacuuuuguccaugcaaccaacauaaugcauagcaguuacacacagcacauauuccaugaguauguccacauuguucuggaacaccaaaaagacugugaggaagcaaaugcaaaaguaauucucaauccuacaacuaauaacaggccaauaauaacagucauccccgaccaucucugacgccagugagauuggcuguguguccuuugcaucucaaagagcucuaaguccaugacuuccuucuacacucaaggaacagacugagauaggagugaaacuuaauguguuauagugacuauuuucaguccacuuuauauuuguaaaugucagugucuucauccauuuuugcugcuauaacaauauaccugagacuagguaauguauaaauagcacaaauuuauuucucacaguucuagaggcugggaagcccaagaucaaggcaccaacauguucaaugucuggugacaguccagucucugcuuccaagaugauaccuugaacacuauguccucacauggcagaagggaugaaaaagcaaaaaaggggcuagcuaguucccuccagccuuuuuauaagguuacuaaucccauucaugggguuguaccuuuuaauacuaucacauugauaauuaaguuucaacauaugaauuuaggggaaccauucagaccauggcagucaguuauuaucaaauuuugguccuuuagccaugccaagacauacuagguuguuuucuccuuuucuuuucucuuuuuuucuuccucauccccaugugaaauaagacucaggucuuugcccuaaaugcauuuuuauuggugggaguguaaugaggacauagagaggguggccuagagaauuaaaacagcuggaauucaccaguucccaucacuuuuuaaaaagccuaagcccauuaaagagacacauucagauguccagaaggggaagaagaaagggcagacgugaaaacaggaaggaggagagauuccuuccagaggccggagagagguggaggucacagaucccacucuaggcaggacucaccccuacugcaaaugugagaaccagcuauuauguaugucugugccaguuaugcauuuggaaaccuggagaaugaguaccagugguuaguuccauaaaaauccauuuguccuaucaggaaacaaacuuggaccuagaccccauuuaucaccugauuuccauauacuccuacaguagaugcuccuuuggguuccuugguauuggugucaguuaagauucuauaaccaacagcccucaaaauauugggguauuccauuuuccccaguguacagcuacucagggaaauagucacaaguuccuggagggaaauauagagaaaaucaccacuacauacaugcaagggaaugcccuugaggcauucuuccucaaagaacagccucuccuucaauugagguauuuuggaucugagaauuaauuuaggucuggaauugagugaaugaucauaauuuuucaacagggaagcuguuaucaggcuucugcucauccaugcuugauuuuuuuuuuaauuaccuacauuuacaaccuucuaaauugccuaccugucuugcucccaggaacaucacaguuucauacucauuaccguacauuccugugggucaggcccucugguugcuauucugaccuugcugucuauuacaguaauuaaucuucuugccccuaauaguuaagugcugccaucaggccucuacuauucuggaaaauuaucaucuccauuaacacuagggaccccacuuccaaaacagcaccuccuacagucagccucagcugacagaggauaaacacugcugagguucucaauaaugcaccucacuagugcauuuucuuauuaacuuagugaagagaguguccucuagccuuccuagggaacauagccaucugguaggucuaauuuggaaguccauugagcauaccaaauucuuugaaccuuuuggcuccuuccucuacacucugccaaggcaguuugauguuuccaggagccaccccaaccguccugaaggaucucuugguugccagacacccucucuaaaacagcagccagcagaacagcagccuguuccucugugggggcugugauggccugaugacuuuuaaagaagucccuuucaaugagcaauuugaaaaaauugugauuccuggcauacacccacucucaacuccuuagaaauagcauagguuuaauaugaauuuaggcccaaaaaauagagaagccuuauuucacaagacaugaggcauuucugugacucugauaccagauaacauaaacucuaguuccaggcauauucagaaggaaauaaugccaauguuguuuguacaaaagugagucggcaccuuuuaugcaucauuaucggucugaaaugacuggcauguuugaagacagaagggaauaaaggcagccaaugaugauauaaauggagcaacugaccaucugagcaauugaauauaauuggaagcaauuggcaugggucaagacaggaaccaggggaggugucaguagaaaaauggaguucuaaaggccgggcacggugguucaugcuuguaauccccgcacuuugggaggccaaggcgggcagaucaccugagguugggaguucgagacccgccuggccaacauagugaaacaccgucucuacuaaaaauacaaaaaauuaguuggguguggcggcgggcaccuguaaucccagcuacuugggaggcugaggcaggagaaucacuugaacccaggaggcggagguugcagugagcagagaucaugccauugcacgccagcccacgugacaguaugagacucugucucaaaagagaaaaaagaaaaauggaguucuugcugggcguggugcucaugccuguaaucccagcacuuugggagggugaggcaggagguucucuucaggccaagaguuugagaccagcaugggcaacagagugagaccccccacuccaucucuacaaaaacauuuuuaaaaguuaaccagguguaguggugcacacauguagucccagauacucgggacugaggcagagggaucgcuugagcccagaaguucaaggcugugguaagcugauugugccacugcauuccagccugggugacaaagccagaccccagaaagaaaauggagguuucauggcucuccucauccccaagguauucacuucuggaaaaauuaaugguuaggauuacccaaguauacauaaauucuaaacaaauauauccuacguacauagggcucuucuuagcacagggugcuggaagaaagcuggcuuacaaguuuucaacuuuacaauggugaaaaagugauacacauucaguagaaacuguacuucaaguacccauacaaccauuuuuuucaccuucaauauaguagucaauaaauuacaugagauauucaacacuuucuuauaaaauuacuuugugcuagaugauuuugcccaacuguagacugcuguaaguguuuugagcacauuuaagguaggcuaggcuaagcuaugauguucagcaaguuaaggguauuaaaugcauuuucaacuuacaauauuuuccauuuaugauggguuuaucaugacguugcgccauuguaaguugaggggcauuuguauuccagcugagccuggaggaccgugaucaaggaaguaguaaggcugguaugcuuugcacaggaauuggccugauuagucccuaaggcuccuuccaagcuugggccuaccauugucuaugagcggaacaaaagccagaauugaagaauggccuguacggugguguguuuuaggaaacccugauuaagcagagagcauccauccugugacuguuucugacuauuuugcaugaccacugaaagaaaaacacuggcaaacacuccaaacaugaauacuuccaaaucaaauuaauuaggcuuaagugaucccaaaauagaaacaucccucaucuuucuucuuacaagagaaugaagguuugaaccaugauucaauuuguggaauaaaccauauggcuuccuucccaggacggaagaggagcugcucaaggggaaucaaaacauccagcccugggucagagaggaaucugaccuuggagacauggggcccagacagagucccuacagauccugaccugaccuguguauggaagacgucaggggcagauggauauucauucagucuuuuagucugaccuuuacauuuaaaagcaaagaggaaaacagcccuaguuauagggcugggccucagauccaacuuaaaggcuuaccaguggaauaagaacaucugcccccguuccuuagacauauguuuuggauuuuauugcacuuucucucuucaucugaggacagaugugauagcucuuuccuucugaggauguugugagaaugacaguacauaaggugccuaguacauaauuuuucauuuuuuuaauuuuuuugaaacaaggucuugcugucucacccauucuggagugcagugguaugaucaugccucacugcauccucaacauccugggcucaagcaguccucccaccucagccucccgaguagcuguggaacuggcaaaaggaucuaguugcucacugcuuguggaaugaagucaaaauaauaacgaguuaugauacggaagagccauauuccuuuauuauacaugccagcaaggggaagaguagacagcaaauuccagucuucaauuuguggagggaaugcagggguuuuuggugguggugguggugguggugguuuuuuuuuuuuuuuuuuuuuuuuuuuugagacagucucacucugucacccaggcuggagugcgguggcacgaucucgcucacuacaagcuccaccuccuggguucacgccauucuccugccucagucucccaaguaggugggauacaggcaccugccacugcaccugccuaauuuuuuuguauuuuuaguauaaacgggguuucacuguguuagccaggauggucucaaucuccugaccucgugaucugccugccucggccucccgaagugcugggauuacaggcgugagccaccgugccuggcugggaaugcaaggguuuuuaaagaaggcauuuuggaauguggaaaaggcaaguggggcuaggagaugccaggugcuaugacaguccgauggcucaucuugaauuauuguuccauuuggugaaggggcuggugccauuguggauccuaccagguuauaaauuaaucacagucaaccuuguguucacucuucagcugagaguggguuccagcccugagguaaccuuuuguuggacagagaauucuggaggugucuggucccuaucaggaucugaccucugaagcaucaaaggaagcauaugaccagauaagugagcauggugugugcuuaacaagcaucuagguaaauaaaugugcauaaggcaugggagcacagaaugggaaaagaaagggaguggagguucacagcccauucugaggcuguauuucaagaugaaagguaacacauaagcagucugucucaaaguuauaucuugagacugggggugggaggaggaagaaaggggaaaggaaaaagaguuauaaaaugcauuuugaggcuuagcugcuaagcugcuugauuauagcugggacuacuggugcaugcccccaaacccagcuauuuucuaaaaaaaaaaauuuuguagagauggggucucauuguguugcccaagcugguuuugaacuccugagcucaagcaauccgccugccucagccucccaaagugcugggauuacaaaggggagucaccgcaucuggccuccuaguacaaaauuuauauucaauugauaauagcuccuaccacugcuucuacagcugcuguugcuguuauagcccuugcacugauuuuuuagcaugucugucuucuccuaaauauugagcucuuuaaaguagaaacuuugauuuucaucucugaguacccagcacugagaaucaggccuggcacagaaggugugcucaguagccaucucuugacuugagccaaacggccacggcacagacacugugugcuugcacagguacaggacagucucacagcuccuugcuggaagugcuccuguagcaaccugggaaggggucagaucacaaagcagagcucggaggagauggauuucuacagaguuuguaugguuuucaagcacaggguaaaauaaagccaacugcaaaaccucuggauugucaacaagcuuaugaugacccaggauaaaucacaugugagcaccuagaaauccgaaagagagauuuuuaguucccugaaaaaagcaagggaaaucucaggaccagccucagaagcaagucagugucuuucgugagagcugauggggaaugaggaggagggaaguucagagauaacugaacuucaacuuggccaaaacgugcaggaggccccuugcuauccagucauagaggcucacuggugaagugaaauuuacuuaaaggucaguaaaaguuuaaagucuuggcacuggaguuacaggguaccugggacugacuccuggcugauaucaccagagcagaggaguucuuggcccaucugcccuaagggaagggaagagacuaaaugucaucagucaccugcccuucuauggggacaucaucaaccacuugaccugugagguccuggcuguccugaaguuggccugugcugacaucucuaucaacaugaucaggcaaaaggccuucuccaccugcucugcccaccucacaguuguggucaucuucuacaggaccauccucuucacgcaugggaagcccaagucgaaggacccacugggggcagacaagcaggauuuugcagacaaacucaucucccucuccuauggaguggucacccccaugcugaacaccaucaucuacagccugaggaaaaagggugugaaggcugcugugaagaaccugguauuucagaaaccccuaacugaaugacagacugucagaaucccagguggccagaacauaugaucucuaagcaccucacugugcucauggggaaaugauaacucagaggaaagaagggacuuucccaagguccaggccaugaaccaugggacuaggacgaacaaguaaacu

SEQ ID NO: 13947 - RNA, 237664 nt, Homo sapiens
uguuguccccggaagugccuucccucccgggucugcgcggacgcggccuccuuaccucauuuguccucgccccuccccgucccucuacgcguuuugguucccgguuggugcuuccuguucgcagcugcggcagugaguaugugugugacggacccccgccgcccgcggcucgggaccccugccuacccuccuucuugcccgccgggcuguggaacuagcgcgugcccccucgccggccucgacgucucccguccgccccucacucguggcagggcgcagcuccugguccgucaccugcgcgccgccccacgcggccgggcugcgggucuaggggguccgcgucucccuggcuuuccaagggcuaaugccgugauucuagagcggcugggcgucuagggccucggugaggguggcgugucugcccuuuuuauuuccccgcaaggcccccagucuucuagggaagccagucagugaagcgcggaggucccggcgcgccgagagagaguccagucuuugaggaccgaguaguccugggccaccucccgccucugcugucagaagcagcagcugcagcaguagaauccaaaauuucgggagcugugacccuuuccucauguaaaacgaguagacuuggacuguguuuacuaaggcgcccuuuaucccucccauccugugagcggacaguugccuucaacuuuugggaagagcugcugguucgguggaaaagcuguggcugggaaucaggaggccuggguucuagccguggcucccccacggauucgcuggcgauuccagaaagcucuuauugaagcugaauuuaagauuauuucagauugcacaguugaauuacgggcugcauuaguagggccuuuuuagcucagugaauaaguuucucugagcuccuuucuccaacuauaaaacgagagcguucaauuugaugacuuuucagguccccucagaagcucuugacuuugugguuuucuuuuucuuuuuaaaauuuuuucuaggaccguuagagaaaugacuucguguuugaauaguuaggcugucgcauacaaagacuuuuaaauggauuguguguauacuuaggaaagcguuaugcuuucaggagaaucugagcauggggaauaaagucaggaaggaucgcaagugaggauuauauuaauaugauaauuagcacgguaagagacugcaugaccgaaggaaaagggcuaagggaaaggugaaggaaauguuuccggauaggauuaguucucguaaaaaucauauauauaucccaagaagagcugggacuuaagugacuaaauuuagcuuauuuuuuuucccccacugaaauacugugcucuguuugucuuuugugacuuuuguuuuacacauuuggauucuccaucccaaucagauuugauucagaguggccaucgcauuugaaaaauggacagacauuuuaacccuuuagacaauuguguuucaacuguccugucagggcagcuuacuaagaguaagaaaaauuuuacuuugaaaguaaaguguauucaucacauuccaaugaaaauuggacugaaaaugaggcuguggauuugauuuaaaucggccggagauggaugcgugugucaucaagaaggaacaucuagggaggcuaaagauauuuggaaguaaauaagagcaaaaggucagaaugaccaguagguagacugugagagcagaaggauugauuaaagacuguguuaaguaaaugcugaaagcuuaaauaagccuuaaguugucuaguuuaaaacaauucagucaaugaauacugcucccucuuuugaaugguaauagccuuugcaguuauucuauagcuguuuuauauuuguuaagguauuuuaauucuuagauaaguuucauuugcaugauauuuuaagauguuauauaggaaacaucuuuucuggucaugggauugauaguuuuugaguaccaacuugggagauucuuaaauggcaaacugacaaacguguguuuuccuuacaccuaaaaugucucauuuaguuuuuaaacucugcugggacauaaaauggauauuugugagguaaauuuagguguuagaaccaaugcaaauauugcaaugaaggaagguuuuucuucaaaaaaucuuaauuugaaguuaacuuauuugaaaauuuuauuuugggccaugugcgguggcucacgccuguaauccaggcacuuugggaguccgaguggggcggaucacgaggucaggaguucgagaccagccuggccaacauggugaaacccgucucugcuaagaauacaaaaauuacccaggcgugguggcgcgugccuguaaucccagcuacuugggaggcggaggcaggagaauuucuugaacccaggaggaggagguugcagugagccgagauugcgccacugcacucucaccugggggacagaacgagacuccgucucaagggggaaaaaaagaaauuuguuuaaaaauuuuaguaaacaguuggcugagaaucacagaaaugugaaucacuucuagccguguucuuaaccagcugcauaaccuugaauaggcuuccuaucucuuuguauuucaguuuccugaugggaagauugaggagucuguaugagauaaucugauuuuguuaccuaguuaguauacuugggaaucauguacagggauaaaaaagcugagaaagccuucugagucaagggugugugugugugugugugugugugugugugugugcgugugcguguguguguaaaaaacauauauugucuuccaagacacuuuuuaaaaggguaaauuaaauucauuugaacguaauuaaagcaguaacauuaacgaaaacaaccuuaggcagaccuuaacccuggcauacauaaacuaccuaaauaagagagcacguuaugcccagcacaauuuucaaguacagacgguacaaaauccucuuaaaggccauaggggcuaaauuguuaaauucauuuuucuacauuucagggaaagagauaaauccuuugacccaaggaagucaguuuuuauuaugguucuguaguuuauuuuuggcauacauucacaggugugccuauggcucuauucuuaaucccuuuccuuugggauggcugcaagaguaguacaaacuuguaacuuuguaauuuggcuuuuuaauuuuuucugugcugcacuggaauuauguuuugucuuaaguccacacuggauccucaggauggauccagugaggauuuugaaagaagcauaauuccuuugacuucuuuuagaauuaauuuaccuauuaaauaaaaaggaaaggauucaucuuuuauucgaauuccucugaggcuaacaauucaauauaaacugaugaaugcugugagcauuauucagacaaucacauucaauuugugugacaguaacagcauagccaccugaaggacagugcaacaagggcacagguauaugauacccuuuagaagaaaagcauuacagguggguuuauuuguuucuggaaaacaaacaacuccaguaggaauguaguacauuuuuggcucuuguccauuugguuuuugggauuaaggugguucuauuaccagaacuaccaccacaacacccugguauuuuugggcagaaauuugggacacuaagaaaacaacuauuuuuuauuuuauguguauagcuguuaguggaagaaagaauaaauaggcaucauuauugcucuuuaggcugucccugauuuuggacacacacuuauuuuuucagggcucucauuuuaaucaguaguccaucaguaccuaauggaaacaucuacuguguagaguuuugguugcugaugcuagaauuuaagacuuuggaguagucgaaagacaacagagaaauucaucucauaauuuuuguauuuuaagcacauacuagauuuaucagggcugaagaacaaaugcccgaugguguaguucauuuauucauuuaugaauucagcaaacguuuguagcugaccccgaaaauaccaguuacccuguuuggcuuuggugauucauuguuuagcagagugcauauaguuccugcccuccugggauuugugaucugcguuucuuggaaauuuauauugaauaaguaauuauaaaugugaugaguguuuugacauguaaaguacuuauggaagcccauaaaaggggcucuuaauuuagccugguugcaagugauuuugagcugaguuuaaaagaugaaggcugaggaggauuuaauaugcucacaguagaaaguaaaguguuucacuuuacacauuuauucccaaagcugggaguuuugucucaauauugggucauuauuaaguuuguauuuauacauuauaaauauacauuguaaaaauauacauuuuuguaacuaguacagaguuuuuagacagucugcucuguugcccagggugaagugcaguggcaugaucucgacucacugcagccugugccucccagguucaagcuauucuugugccuccaccuccugaguagcugggauuauaggcgcacaccaccacacccagcugauuucuuuauuuuuagcagauauguaguuucaccaucuuggcuaggcuggucucgaacuccugacucaagugauccacccgccuuggccucccaaaguccugggauuacaggcgugagccacugcacuggcccacccuuguuuuauuuuugaguuggguucuugcuuugucacccaggcuggaguacaaugguaugagcauagcucacuguaacuuugaacuccugagcucaagcgguucucccaccucaaccuccugaguaguagcugggacuacagguuugcacugccaugccuggcuaaguuuuuaguuuuaauuuuuauggagauggggucuuacuguguugcccaggcuguucucaaacuucuaaccucaacgugauccuccugccuuggccucccaaaguguugggauuacaggcaugagccacugccagcucaggcauuuuuauuuauucuuuuggccaaugaucagagggccgugcgauuaauuuguuaauugagaauauacauuuacacccaaacaguaaacaaaauuguuuccuguuauagauuuuagucauaauugaaguaauauuccuguauaugcuugaaaauaugagcuauagaaccagaaccaaggaaaagaugaagaauggauaggauagugagagcugcuuuaaguuuuguuuuaacauuuuggaaagcaaggguuuuguauccugcgguagaucucaauuuguuuuucguuuacaauauaccugugaaaucuuacauaucaugugcugcauaauagcauuuugguuaaagacagacagugugacuguggucccauaggauuuguauacguuuuugcuauaucuuuuguauguuuagauacccaaauaccauuguguuacaguuacuuacaguauuuggcaccguuacaugcuguauugguuuguauccuaggagcaauagaccauaccauguagccuaguuguguaguugacuacaccaucuaguuugugaaaaucauccuaugaaguuugcacgaugaaaucacagaacaaagcauuucuuagaguguugacuguguuuccaucaauaacuauaacucaauuugucaguaguaauucucguuggggaguggugggacuuacaggaguggguccuaacaggacuuagaaauccuuggaaaaaaagguauuuuaauaugucugagaauagugauggccuucauauuagcaguugucacugacaggugauauuguuacuuaaacuggcaugaucugaacuuuuaaaguauauucuguguacaacuuucucuuuugcagcuucaagguuacugacuuuuuaugauguuugguggcuaugagacuauagaagcauacgaagaugaucuuuaucgagaugagucaucuagugaacugaguguugauagugagguggaauuucaacucuauagccaaauucauuaugcccaagaucuugaugaugucaucagggaggaagagcaugaagaaaagaacucugggaauucggaaucuucgaguaguaaaccaaaucagaagaagcuaaucguccuuucagauagugaggucauccagcugucagaugggucagaggucaucacuuugucugaugaagacaguauuuauagauguaaaggaaagaauguuagaguucaagcacaagaaaaugcccauggucuuucuucuucucuucaaucuaaugagcugguugauaagaaaugcaagagugauauugagaagccuaaaucugaagagagaucagguguaauccgagaggucaugauuauagaggucaguucaagugaagaggaagagagcaccauuucagaaggugauaauguggaaagcuggaugcuacugggaugugaaguagaugauaaagaugaugauauccuucucaaccuugugggaugugaaaacucuguuacugaagguuaguaucauauuggccauuuugaaaguaguaucaucuuucauaaggaggacugcuuuuccuagagaaaagaccaauagggucuacuccguuuaauuccucacuuuuuggucuuguuuuuugguuuguuucucaugcgacucucuuaccaguggcuacucuaauggugguuugucugaacgucagaaagaguaugucagaauaccaaagacacucugcuucugcuguaagcagauucauagcugcuucuuccuguuuggcuagagccaguucuggaccugaaaucuuacuuccccccucucucucugcuugguaccacaggugaguacuccauccaccucuggcauuagcccugugcacucauucagccaacucuguugggacugucucuuccuaugggauuugcuuacccaggaguuagauggcaagcauagggaaugucuggcacacagaauauauggaauuaguguuaggauuaggauuuuagguacuccacagucagaaagacaggaaaauaugaagagcuguaagucuagggcagguuauaggggagaaugcaaauuuugauagcuacaucaucaaggauuaaaauuuugguguuaguuaugucucugugacauguagucaucuagucuuaaugcuuaugccuucaagaaguuccuuuucauuucccucccuuuaugccuaaugcucagucucuugcacuaguuuccuaaguagucuucuuuuauaucuacccuguacacuguuguuaaaacugguauugaaaugcucuuuuacucauaguacuuuauugcugcuccaaaauuuuuaauggcagccugcuucccuagaaaugaugacauugaauguagauugugcuuggagccccugggauuggcaaauguuuuuuuaagaagccagauagaaaauauuuuaggauuccaagccaugugauaucuuaacuacucaacuuggcccuugugggaaagcagccuuaaauaauaccuauagaaauggggguggcuguucucaguaaagcccuacuuacaaaaacagguggccggcucaggcuguaguuugcaaacccugagaacuugacagcaaaacgaaaagagagaauaguaguuaggacagaacagaaucgcguaaaguuuuuuccauauaggugagcucugauaauguuuguagguagaaagaaagaaacuugugaaggagagacuaaaccuguuugauggauuggguugggggccagguuagagauaggaucagguguauguguuguugaauuauuccuaaaaaggaagagagacacuaguaauugcuaaaucaucaaauauuuguagagguagaggagaaagaauaaauucagauggauugaggcagaugagagaacauauggggauguguuugauuuucuuaggaaaaugaaagcagaagugggagagggcgggggauaauuggaagcuuagaauguggaagggauguuuaagugcuguggggaauacuuugaggcagugguuaccaguauuuugaagaugacaaccuguguaacuuugaaacaauuuguggaccacccaugguuguaguuaugauuuuaguauucaauugagaaaaugcauauuagaaagaagcuacuacucuuacaugacuuuguguuuuauuaaucacaacauugauaugugagaaauaguguuuauaaugcguugcucuagguacccauuaagguaacuaauucugcaguuucccaggaggcugaaggcucuuaaguuggaaaucauugcacuugagugaaucaacaguaagagaauaaaggauuguuuagaaguaguauucagucaaaauuaaaaugaugugaacuuguagugaacucacuuugaaggauuccauaacuuuauccaguaauacuugucagcuuggagcaagaugacagaaacaaaaugaucuuggguuaggcguaacacuauagaaggccaaaauaagcauuuagcuuauucuuucucuaaauuaccuuuuccugagaucacaccuaguuucauuaaucacuucuguauuuauggucaucaaauugucaucuccuuaaccauuuuguugauuucaaauucucuguguacaucuacagaauauuuccauuuggguaucuuacugucucacauuugacauacugaaaagaaagcuugauaacuugaaaaaaaagcuuauuaucuuuccuuugaaacaacucccugcugcuuucuguuugcacuagagaaucuacagacaugcuaaaguugauggcacaauguggauagguugggaaaaacaugaauuaggugcuggauuuagugaagaaaucgaacugugccauauuuggcaaaugauggugaugagaaaguagagagaaccuuggauuuguuuucuguuuuagccaaauagaauuaaauucugaauuuuuggaaauuaauuuacuugacucuuauaaacucuuacaaauacucaaauauauauucuccauuuuauuuccuugauccacuaaugcuguaauccuauuuccaauuaauaaacaacauauuuaguacugaugcccauuuaaguguguuguuacucuguaaucacuaucccucucauaaaacuaucuggggauagauugguucauauaaucuuuagagagaagauuuuucucauuucuguaaaaguguagagaaaaucucaaguacuuuagaaaugccuauuguuaaacaguauccauaauuauuuuguguucuguuuccuugaccucacucaagaaaaaaacaaaauaucucccagaauuauggcauacugaaaacugcaguaugacauaaaagaaaagacuacaggcuccuugagguugggucuuuuccauacucauaaaccugcuuauaauaauauuuagaguaauuucuuggcacauacauuaccugcuuucucaucaauugcuaaaucaucaaacauuuauugagcaucuccucuauguaggguauaaguaaugcugagguaguacucgugacuuacagugguaaaagacuuaaguuuuaggccgagagcaguggcucacgccuguaaucccaacacuuugagaggccgaggcggguggaucaccugaggucaggaguucgagaccagccuggccaacauggcgaaaccccaucucuacuaaaaauaaauaaauuagcugggagugguggcaggcaccuguaaucccagcuacuugggaggcuaaggcaggagaauugcuugacccaggagguggagguugcagugagcugagauugcaccauugcacuccagccugggugauggagugagacugucucaaaaaaaaaaaaaaaaagauaaguuuuagccuugaaugacauaguguuucacuaaagagacagaauauaggaagcuaaguaauuuacggaauucucuccuuuuuuuuuuuuuuuuuuuuuuuuuuuuuuauagcaguggggucuuacccuauaaauagagcaaggcuaguuuggaacuccugggcuugugugguccucccgccuuagccuucagaguagcugggagugcaggugugaacacagcuuugaaaucucaauuuuuuuuuuuuuuuuuugagacagagucucgcucugucgcccaggcuggagugcaauggcaugaucucggcucacugcaagcugcgccucccggguucacgccauucuccugccucagccucccaaguagcugggacuacaggcaccugccaccacgccuggcuaauuuuuuguauuuuuuuuuaguagagacgggguuucgcaguguuagccaggauggucgcgaucuccugaccucgugauccgccugccucggccucccaaagugcugggauuacaggcgugagccacugcgucuggccagaaaucucuuaaccaugggaguuaagucucaaaauucuggugauacaagugguugaaacuuaaaacuuuguuuaaaaaauaggauuagugaauuugagauaauucauaagucugugaaagacaauaaauacauacauauuuuacauuuacuauuacuaaauuuguaguaaauuugaguacagcacuaccucuuuaucugugaaaacuucagacucuccccuauuacuuuaauuucagugagacauuauuauauuaaaaaaauggccaggccugguggcucacgccuguaaucccagcacuuugggaggccgaggcagguggaucacgaggucgggagaucgagaccagccuggcuaacacggugaaaccccgucucuacuaaaaauacaaaaaauuagccgggugugguggcggacgccuguagucccagcuacucaggaggcugaggcaggagaauggugugaaccugggaggcagaguuugcagugagccgagauagcgccacugcacuccagccugggugauagagcgagacucugucaaaaaaaaaaagaaaaaaaaaauacaggccgggcaugguggcucacaccuguaaucccagcacuuugggaggcugagguggguggaucacuugaggucaggaguucgagaccagccuggccaacauggugaaaccccgucucuacuaaaaaugcaaaauuagccgggcauucuggcaagcaucuguaaucccagcuacuugggaggcugaggaaggagaauugcuucaaccugggaggcggagguugcagugagccgagauugugcaacugcacucaagccuaggcgacagagugagacucuugucucaaaaagaaaaagaaaaaaaagaaaaugggcguacacauuuguuuugcucuacugacaguuaauaccacaacucagaggcauuuuuuuuuccuuucuauucuucuucuaaauguucaacacuuuucugauuuugugauuugagguuguugauuagcuuccugaggcuccauugagacuguauauacgugacacuuaacagucuagccuuccucggugcauauagauauaugauggugguuuugccuguaguaaauucaugucaaaacauaggcuuucagugccuauuacauaugacuuucagcucucucuacugagggauguaggaguuuauuucugaggucugagccucuuuuccuuuacuuccuuuauucuuuccuaagccuucuuuauaaaaacuaugcauguucuaucguuuguuuuccuucuugauucccgccccuuccuuuuuuuuuaauuauccccagcaggagugacuuguaauucucauauauuagaaaggcagaucuccugguggaagaaaagaugcaccgaaggaagucagcauauuuaguaauuugugagggggaucucaaguuuggaaaggauuguuauguaagacaaccaaaugaugacaugugacaauaaagccauaauagcuacuuauuuuccugguuagggaagggauauuacuaguucuaggaguaacugcuagcucuuucuuguacuuuuuuuauuguggaaauauaaaaauauacaaaaauaaaauguuauaauugacuucagugucccauaaaccagcuucaacaguuaccaauuuaugucuaaucuuuccuaucuauaacucugugccccucuguuauuuugaagcucaucagacaucaagucauucauauauguauguauguguauguguguguauacacaucaugugugcacauguguguaugcauguauacacauuuguauacaagugugcacucauguuugucccucagugucugugggggauugguucuaggacuucccauggauaccaaaaucuauggaugcucaagucccugauauaaaauuguggaauauuugcauauaaccuauuuacauccucucguauacuuuuaaguccgggguguccaaucuuuuggcuuccaugggccacauuggaagaauugucuugggccacacauaaaaaacacuaauacugacaguagccgaugagcuaaaaaaaaauuaccagcuggacaugguggcucacgccuguaaucccggcacuuugggaggccgaggcgggcggaucacgaggucuggaguucgagacuagccugaccaacauggugaaaccccgucucuucuaaaaauacaaaaauuagcccagugugguggugugcaccuguaaucccagccucagaggcugaggcaggagaaucgcuugaaccugggagacggagguugcagugagccgagaucgugccacugcauucuagccugggcgacagagugagagagacucugucucagaaaaaaauuaacaaaacaaucucauauuguuuuaagaaaguuuacgaauuuguguugggccacauucaaaagccuucauggcugugaguuggacaagucaucucuggauuacuuaacauacccauacaauguaaauaccauguaaauaacuguuauauuguauuuaaggagucauaaugagaagaaaaauauacacguuaaguagacaugcaauuuuuuuuggucuggaauauuuucuuuuuuuuuuuuuuuugagacacagucuugcucuugucacccaggguggauugcaguggugcagucuuggcucacugcaaccucugccaccuggguucaagcaguucuuccaccucagcuuccugaauagcugcgaaugcagguaccugccaccaugcuuggcuaauuuuuguauuuuuauuuuuuauuuuuuuaaaauuuaaaaauuuuaaaauuuuuauuuauuuucugagacggagucucgcugugucacccagccuggagugcgguggcguuaucuuggcucacugcaaccuccgccucccagguucaagugauucuuccaccucagccuuccgaguagcugggauuacaggcacgagccaccacgcccagcuaauuuuuguauuuuuaguagaaacgggguuucaccauguuggccaggcuggucuugaacuccugaccucaggugaucugcccaccuuggccucccaaagugccagaauuauaggcgugagccaccgugccuggccaguuauuguauuuuuaguagaguugggguuucagcauguuggcuagacuggucuugaacuccuggccucaagugauccaccggccuuggccucccaaagugguaggauuacaggugugagccaccgugcccgacugaaacguacuauauauauauauguauauauuuaaucauauuaccauagguaaacaaauucccgguaauucuuucaucaucacauacccagcuaguguucagauuuccuacacuggcuccuaauuuuuuuuucuuacagauuauuugaauucgauccaauccagguauuguaauuggcuguuaaacuuaaguauccuuuaauguauagguuccccuuaaucucuuccuuuuuuuaauuucuuguaauuuguuguaauaccuagauucuuugucuucuagaauuuccaauggucugaauuuuauaguauugcuuaacauguucuacuguccucugucuuuccugugaauugguaguuagaucuagaagcuugauuaaauucagauuuucucucuguuguuacaucaucaguuugacacacagguucauuuguuucacuuugcuuuugauauguuauuuuuuggaauuaucuuuuaaaaauuugguuuucuuuuauaaucauguaaaauguguauaagguuccagauucaaaucagcaaaacaugauaaaaucuauccagagaaggcaaaccuucuguccagucgccauccuguuccugcccuuccccuuaugaguaaucauuaagagaaaauuguugguuuguccuuacauguguauaucuuuguacacucuugcccuuguuuuuuguugguuguuuuuuguuguuguuguuuuauuuuuugagacggaauuucgcucuuguugcccaggcuggagugcaacagugcagucucagcucaccgcaacuuccgccucccggguucaagugauucuucugccucagccucccgaguagcuaggauuacaggcaugugccaccaugcccagcuaauuuuuguauuuuuaguagagauggggguuucuccaugcuggucaggcuggccucaaacucccgaccucaggugauccacccaccucggccucccaaagugcuaggauuacaggcaugagccaccacacccggcccucuuucuuaauaaauaguggcauacuaucuacucuuuucucuaaccuuauuuuuuucucuuagccguauauccuggcgaucaauccauaguccuauguaaagauauuuaauauuucuuauuucuaggacuaugaacuauuuuuguaucuucuacacuaaucugagcugggcacauuaggcauguaauaaauacuuuuugaaagugaaugaauaguaauuuaaaauaguugaugacuaaugcacuuguuacagucuuaaaauauauuuuaaacaaauaaauaauugucuaauuccacuuucagaagaaauaagaaguucuuauuccuguuuguaauuuuuuuuaucauuugguaauuuugaaauauuuagguuuagcaaaaaauuaauaggcucagguuuuaaaaagaaaaaugccuucugcaaaaggaacaauaugguauuuuuaagaguugaagaaaccauauuaguuccugguuuaugacuguuaugguauagaauuuugugucaauguagagcuccuucaguauguguaauuuggcacacaaccccuuuaguucgucagcauuuggcacaucggggauaccuaacaaauuguagguaaauuuguuuauuuauuuauuuuuucccuuagguaaauuuauuugcaguucugccuuuguguauagaguagagcucuuuacauaguauuauuuaaagugaaauaauugcuugacuaagguaaauggcuuuugaaacugaaguaaaauuauggcuucaacacuuauggcagaaaguguuuuaacuauuuuguguuaaaucccuuuuucucccaaaacuauacacacagaaguuuuggauauaauuucaaaggaugaagaacucaucuagaggccauuguugaauuccuggcauucauuaggcacucaaccaagacuggauaucuaauuaaaauuugaauagaguggguuaccuauuugaauuuuagguuuucuaguaaaucauuuuguuugaucuaggucuuuacauauguguuuuuuuguuuguuuuucuuuuccuguguggauuaguuucuaccuugccuggcugauauaucuacuuaucucucaguucuuaguuugaaaggucacuucugaaugagguguaauggucauagguucucaauuagugguuguuauugggucuguuacagcugugcaguuggccaacuuugacuuuggguaacuuaauuucuuuauugguaaaaaauacuuuuuauuuuauuaaagucauaaagaaaaaugagauauuggguaggcuuaaugucacaggaaaauauuuugauaaaagucuucauaguuacacgauagguucaugaucauuguggcaaacaugagcuuauagcuuccacuuuuuuguuguuguuuguuguuguuguuguuuuucagacagggugucucucucccaccccaccccugccccaccugcaaucucucucucucugucuugcucucacccaggcaggaguacaguauugcagucauggcucacuguagccuugaccucccgggcugaagugauccuccuaccucaaccucccagguagcugagacugcagaugugggccaccaugcccugcuaauuuuuuguauggaguuagauggaguuucaccauuuugcccauguucaccauguugcucauguugcuggucuugaacucuuggcucaagcgagcugcccaccucagccucccaaagugcugggauuuacaggugugagucaccgcccuggccccacuugauuuuuuuguuuuguguuguuuuguuuuguagagacagugucucaccauguugccuacccuugucuugaacuccugagcucaagcucccaccuuggccucccaaaguguugugcuuacaggcaugagccaccgagccuggccccaaguugcuuuugaacaacaugucucuaguauggugcuauccuuaaagaaauuuaauuuggugacauuuuaugaucugcuaguuuaugacauugaacuuaauucugaaaucuuaaaaucuuuccaaauauuauuuacugggugcugacaacguacaagccacuguaccauuaagguauugggauucaaaaauugccauguacuuuuugccuuuagaaauccuaaaaugcaugacaguauggaaaguucacuguaaaaccagaguuaaaugcauuucuacaaauauaugagaugcuccagcagaauacguaaucauuccaggugaaugcaguagauuuuuuaaaaagauuaaaaaguagauaggcaaaguacaagacugaauugaaaaggaacccuuugaauuugaguuucgaaaaauggguaggacuugaaguucagguuaaaugcagcuaaaaauagaaggugaagcccuuaguagaaacugaagacuguaugugccauucauguuuauauguggcuggaugugaugaaauguuuuaauaguauaucuuuuuagaagccaccucugccuaaacaagaaaggauuauuuauguuuuguauauguucagaauacuguuggaagauuucuuagucauaauuuuauuucauugcuuucucccuguuuuuugcguacauaccuccuuuuuucuuuuaaaauuaauuggaccagagguuagucaaaggaccugaccagcuguuuaacguguauuuugugcagggcuguucaaaguagagcaggucuuaagguacaacuuucacuccucauaguuauguucuuccuuauaaucuuuuaacauaggaaaggaucauuauuuuguuaguuuggaaacaauacauuaaacuuugccuucaguaacuucucagaucauuaaggugguguuuuuuccccuccuuuggcauucaucgucuuaaugucaguaguuucuugagacauuuuauacccuaacaggucauaagaguguauugccaugugacauacuucucauuaauguauaguuuaauuucugccuuauaacugaaaaauggccacaugcuagaauuccagucaccaggagcaucaaggagcucccucucugauguuuucagcuuuuguaagccuguacugcacaguuccuaaagcugcuuuugaacugugucuuuaguuguagcaugucaccuuacacuuaacuauuguuagggcaucuuuuuauuuaauuucuaauuagcauaaugacuugagcuguguuauucacuguuccauggugaaguugucauagggagagaagaaauaaaaauguucaguuucagcuuuacuugugaauggagcgagguuugaagaaagcuuuuuauggccauuguucagcagaaugaaaaucucauuagaaaccccagaaaucccaugcagcuuuggguuggauuuuaauaacauuuuggaauguugauauuguauaucacuaauuucugugauuucacuguagaucagcaacauagggaggcagucuuccaaaguuaauuuaugacuuuuaaucuaaauucauuuacaguuuucuuuucaacaauguuaaguacccagggagagaauuaaauuuuacuuuaaaaaaauacauuucuucuaguaacugauuugaucuucauguaagauauacuaaauucauuggaaacugcuuaaacagaaauaccaugauauguauuuauugaacuaaugacuuaguuuaguugccauuaaaaugucacucaccuuaucuacagguuuguauuuuuuuuuuuuuuuuuuagaauggaaaagcauaaaauuagaugggcaacauuuucuuccuugucagaagagcuugaauccugaugucuuuuuaagugaagaguguuuauauauaauuuucuuguagcuuuuguuuauuauaaaaauaauuauugcauauagugaucacuuaucuaagaagauaaguaugauuuauauagacaguauauuuuuauggucagaaaguaaauuugaugugagcuacauaugauuagacaguaaaacuuuuuuccaaagaaauauagaauggagaacauuuaaucauuauuuccccuucuuagaguagaggcuguucagauaauucauauucuguaaguaggagauccuguuuuuaagacuuuacuaaauuuaauuucaaaguaauaaucucuuauaaaugcuuccuuggugguuaagacuuauuaaugaagcaaaaguauggacuucauggaaguuuucagccuaacguuuuaaaucucuucauuauuauuuaucuuuguuuuguuauaaauuaaagauacuggcaugguuaacuuuuggcauuuugaguuacuugccagauauuuguugauugugcaaauaguuaagaaauaaauauuuuaauugggcauccaccauguauuaugucacauuuucuuuuuaaaucauaugcuuaagaauacuuaaaggaguaugacuugcuuuuuaguuugaaucuugaucuaacagcauugguucuggauggagauguaauucuagagauaaaaauuauuucuguuguguagauuuggauucuaaauguaauaauuauuuuaaaguggaucuugucugcuaaauguauagcuuuuauuucuauaacaaauucuuaccuuagaauuccaacuuuugucaguuuugaaaauuaguuuauuguggacuugagagcaucuguucuuaaucucguguuuugcaaacacguuuuaagggaagacagcauaaaucugugauagugaaaaucauuuguacuuccccucccucgcuuuugcuuaaauauacaauuaacuuauaaccaccucagugugaaagaauggauguuaaguagcuuaagagguauuuauuaagggaaaauauuuuuauuggcaguucccuuaagucauauuuguuuuguaacuaaauagugcuugcaacagaauuaucuaucauagggagggaaagcuccaacucuugaaaacuuuucaauacuuuuucuauauugguaguuaaugagaauucuuaagauaggaaauagacugguuaugacugguaauaugauauugcuaauguaauacaaauuaugcuuuaaaaaagccaggugaggaauucaggauuuggaagaauaugacauacauauacauuuaacuaaagaaaggagauuuucuuuaaagagaagaugugcaaccacaaucaauccuguaaguuaguccuuaauccuguacuagccaguuuuuaguauuaaauggucugauuuaacacaaaugaacuuuugucaaugguuuuauuuagaaauagcauuacuuccuacuuuuaaggaggauuuuaauagcuaauaaaaauucguuguucugauaagaacuugaaagacauccuuacucccauauaauugaguauuuugcucuucauucaacaccucagcccuuuugguuugcuuaaaaaaugauacaaauuuugugggagaauaaauauaacuuaaauauugcuguaaauguguuguauaaucauauuuuagccugguauuauugguucuucuguguaugaaauacuuuuaaacauucaaaauauucaauuuaaaaguuucuggauaggugagugguagagauccaucagguacuuacuugguuguggaauauuuguguucuugaugccaugacauuuuaaaguuguauuaaucccuuuauuuuucuguuugagaugauucaguuugggagguuuuauuaucagaucuaacagaagaaacguaaguguuguaccacaggucaucuaauuuucaaaccauguugguuaguuaaacugacuuugguguauaauuauguacccgguagucagaggaguucaagucgauugcaauucaacucugugauugugccaccaguuagguuaacaucagcagugaagggccuucauuguguuaaauuuuuaaauuccguuaagauuauuuaaacauagaaggagauagguuugugaagcaaauuucuaaagcaguauuaagcaaagagaaucuuuucuuccucuucuuuuagauauaucacauacauguguauuuugauuaaaaggaaaaaaauuuaaugcuuauaguauaaugcgcauacuuauuucuuauuuuuagaauuuauuaaaacuaauaaaauuuguuuggaaaucucaaaagaucuuuaguaguauaccugcaaccucagcagucccuuuuuauccauacagauucucugccuauuguggccguuugcucuaauuuaaauuucccauggcuuucgguugcagacuugguuuucugcaagagugcccaugcuuacauggucauauauucuuggugacuuuuccacuuuuucuuuuuuguuauuuuguugauugcuaaagaaaaaggggaauuuuuuuuuuuaaauuuguuucuuuguuuugaucuuucuuccuuagcccaucuauuuguguguucuuuguuuugcagauuggaaagaauuauugugugguacuuagauccauggggacuagcaggggaaaacuaauuuuguucuugguuuuguuuucuuaauaacagaagcaauuuaauuuuugagccauugagaagcugaaaagauauguuaguguuaugcaugaaauugaugggaaauuauuaauccugaaaauuuguauucauggucacuuuacuguuggaauaaaaauguuauuuuauaguguaaccaaguuaauacuagaaauacuaauuaacaguaagugguacuguuauaaaucuuuaauuuaaauauuauuguauauuaaguaguuguuuacaagaaaucuguuguaaucugauaaugugauuucucuuacauucaauuuugugguccacaguguguauauauucaaauaagcauaugaacaugccuuugacgguggacacauuuuuacuuugaccagaucuuaagaguuugcuuuuucuuggcaaaacuugcauacuuucaaaugugaggaauuuuguuuuauaacauaacuuuguacugcugaauuuaaguccuugaagugcuauggcaauuuaguuauuguuagaagucaaaaguagaggucucuguucccaacaucuccccaaaauauuuuuucauuaauauucacaggcuuuaaaauaucaaauuauugugaucaaagcuacuucuguuuuacaguuguuuugugaggcuggugucauacaguaacauuuaacugaauuuuguauuugcuaaauuaacauaaaauaauaaagagauccuuuuuaccauuuaaaaaauucuaauaauuuccuaaucaggaaaaaugauguuaugauauacuguaaauaggcuaaaaaaaaccuuguaauguugauacauagggaaaagaguaauuuugauaauuaauaauuuuagauuuuuuuccuuugauuguaccucaugguugugaggugucuaaaaugcucuuucugcauaucuguuaaggacuuugggaauugggguaagggcaagccuucuuucugugucuguuaauuacagguuuuuucuuguggauguagugcucuuagaauaugaaacugauuuauagaauuuguaauuaccaagaaauaaauagcaucauugaauuuuguuuucuuuauuuuugcuauuauuuucuaguuacugugcuucacauuuugauuucuaucaaaugacuucucaaaaagcaauuucuuuuaaaucagugaguuucaaacuaagaagaaaauguauccugauagucuaauuagcuguuguuuguccaugccaauuaaaauaaucuuuugaauuucuagucuuugauuauaguuauauaggcuucaugaguuuguaaaacuauuccuccuuuuaaaguauuuuaaaagguguauuguaauuuuauaauugauauucauauguaauuauugagaaacuugaauaaccuaaaauauauuucuaguauucagcacaucaaaucaagguauaaccugugauauaaaagugguccaacagaaguauacagcuuuaaaaauaacaaggaauuaauucuguuagcauguuuuacuagcaaauguucguggaaaauguuauuaauucuuaaagcucagugccuggguuuuauuguguguggccuuacuaggagaacacuguagagccgaacuugaaauuuauuaaggaaagaagaaacuggugaagugcuuuuaugcuguuaaaaaaacuucacagacaauugucagacaauuuuuuuuuuaaaggucaugauugcuugaugccuuuuccagucuuuauuugaaacucucguuuuguaggauuucuuuuuuguucuuccucuuccuuuuuucuuuuggcaguggguggaagauucuuuuaaaacugaauggcuaaaccuguaugguaacuauugaaguaugaucgaaauacuuuuauucaugauuuuuuuaggccaaaaaaugcuaugaagguaagccaaugaugguaaaauuacauuguguugcguggaaacuguuuuagcuuuagcguuuucuguucagaaaaguaggcucugcauuagaguuuuaaauugggauuuguuugugaaauauuuuguaauucucauauugcugauugccuuuaugucucgguguucuaguagauaguucguaguuccugaaaaauaauauucuguguaugaaagaaaauaggaggugagaacagaaugagaauugggaaagaaaacccccuacccaaaaugccgccaccuaacagguggaaauaucuaugccauuacagauuuucaaaacguagagugcuugaacucuuuuuuucuaagagauuacuucaaauuugacagauuucacaaaauuuuguuaugauaaauauuaaaauuuuaacucuuauuuuuauccuaaauuuaagcccuuacaaauuaagaaaagagugccucgaggcugauugcuaauguucaauuaaguuauguguucagugaaguaauuuuuugauuaugauauuuugauuuuauuaauauguaaacuaaaaauuauaaaaggauuaugaguacagaaauuaaauuaugugaaauuaauuuugauauuuugcggcagacaguuuagaauuaaaauauccuugguguguaauaauuuuauuucuuguaaggacaucuguuggcuuucaguauucagaaaauuuagacuuuuuaauuuuaaauguugacguaaauuaacgggagccauacuuuaaauugaaagaacuuaagggaaauacauaaaauaugcuagugauuggcuuacuuacauuuucagugauuagacuuugugaaauaagaguaaggccuagcauuuuauuuuauuuaagaaaauauacuuaauuuaaaaguacuaauacaagaaugagagaaaucuggucaaguauaguaaauccauauccauaauuauuuucaaucacuaguuacagaggaaggugugaaugcuaauaucuucuuuguugaaaaucauaaguuguauuuugaaaagggaugaaagggaacaaguaacugcuuucaggcagauuuauaucauccuaacaucauauguuauuuguggguucaugucacaaaagcuugcaaaacuucacaaaauaauuuaauguauuuuaauuuaguaagcuugcugaaaacucuuuugugauaaaucuagaaaaauuuauacaugauauuuuucuuuuuuaaaguuuagugauccaucuugguacuuugucucaauuucagucuuguugauuuagauaauauucuuauuguuuuauaaauuuccuuucaggaauguguuacugccuugauacguucucaccuuuccaguuauauaugauccaucuaugacauucuaucauccagguguuacuauuuuauuguucuuucuuguacuuuuguuguaagguacagacuucaagucuaaaguaagagcuaguguauauuacaguguauaugaccauuucuaauuugaccuguuacuguaaagaaggcuaacaaguguguaugccuagcccaccccuucuggagcaguugaaaacaggccucagaagacucaaaggaauucuuuuaacuccuagcagggccacggggucaaugucagauuuagucaugcuguuauuuuagcccagugguccagagagaugacugaaaagugagucuuucauuucuuuuuuugugugguuauuaacaggauuaaauguaagccauuguguacuuaguaccaauuaguuucucaucugagagguucauuaugauuuuuugucagccuucgucuuguaauauuuguuucuuuguuugauuaguuaaggggcugaaugggcuaaagggaaguuuuaacagcaguacuuuuaaauucauuaagaauuuuaauagucaacuuuucaaauauguagaccuugauuaaaaaagggaccauguugaaaauuggcaaaauuaaguaaauuguuuaaaauuuuccuuuuccuguuguauuuuuuuaaucugaaaaacagacugucuuuauuauaucaaauaauacuuuuauguuucuagaagucuacuucagauucuuguacauacuucuuaagauuguauuuaguuugcugugaauauguaauuaucguucagaaggggcacauaccaaaaagcuccaaaauuaaaaaaccuuuucaguuucuaggauagaaacauagauugagcuauuaaaagcagaacauuagaguucugggauaaagauaguugucagguguaaacaagccuuaauugaaaaggaggcagccuaaaaguugauucuuuaugcuauuauaaauaaguaaaaaugcaaacuugcuugaguucagaaaauaggagcauacccaacuuuuaaaacuacuuauuagauugguaguugcuuuagauccuuaacuuaaaaaaauucuuauuaaaaucaguguucaauugaguaauauuccucguuuaauagauugagaugccucaguuaaauuuugaacaaaaauuguuccuauaaauugaauuggagaugcugaucuguuaaaagcaaggaauauaacccaaaauuaaaauaggaauuauuuugcuaguggauaauuaucuuggacaguaggucuuauaucuuguugaaguguguagaacacacauuuucacauucauucaucuuuaagugaauauaccuguaggcugauucagacuugguauuuuauuuauuuuaaacauuagaaaugauaaauacuaauuuaagcaagugcgauuacuauuuuaacucauucuucgagaguugcuucauuuaucucagaguuuuugguguaccuuauuuaccuuauuuagauuauaucauuguauuaaguccuuugcuuacugcuguaguuuuuugguaccuagaauaauuuauuauggaauugaauauuaaaaauuugacgaucccaauaguuaugaagcuuacagauucuguauguaggcuuuuuuccuccuuugguuucaggcauaaugaauggauggcccuugcuuucugauauuuguguauccaauuuucugaggaaacacuuuucuacaaagucugcauguuugauuguucuacauuuuucuuucauuauaauuugaaaaggacuuagauccuccaaaugaaaaauggcugucuuggccauaugguaaauuaggccugcuuuauuauugucuaauaauuaagccucccuuuacuuaucccacccucguuuuaaaaacuaaaaacgugugguagcuguauuaguuagaacauuuucaaguaacaggaaguaauucagugguaacuuccucaugugguuuacuguuuaucaaaaaggaaaguaguuucuuuugagagaauaaugcaguuuuugcugcucaacauuuucucaagcucuuuggaaaauaagagagaagucuuuaaugugcuuguaauaugauaaggacagauuuaaaaauuuuguuucucuucucauuacuugguguuugacuucaguggaagcugaaagaaguaaauagauguuaaguugaaaaucugccucagugucagaugcucauauaauuuaaauaauuuaaaauuuguggguacuuauauugauugaccuuauauuuuaaaaacauagggaauaacaucaacuauuuguaucuucucucuuaacuuaaaguugaauuaauuaacuuuagcuaucuaauagaguagguccagaaauuaacauucaaauaacaguaguaaguauaggugaagaccaggcuaucccaaagauaauucauuaggacuucuguuucuauaguaucuuucauaugauaguaacuguuguaaacaauugaauuauauauaucaauuuaauaaauaauugcaauauuaaaaaguuagccccgauaauuucuacccaaacaccuccaaauuaugcuacuucaaaaacaguugaagggaaguuuaggaauauaauauaguuucauuuuaagaccacuaggauaauagacauuguaauguaauggaaaaacauuuugucccauaaaaaccacuuucauuuaaugcuuuguuuuucugucuaaccagguaauaccuagcaaauacagaaagagagauaaagcaagcaagcuguuuugaaagugucuaauauuggcugauguagagcuauagguggguguaucuuauuauuccauaaaauuaaaaauaagaguggggggaaaaaacaaaucccaagaaaauaaauggaaggugagugaagagugaauagaauaaaaauagagaucuaguauuucagucagucugcuaguuaaauuuuauauucagagcuuuaacauuuugggcuuuuaaauuuccugcagugcacaugacuuucuuucauaaaagauaugucaaucauauuaggaauaaaaguaauagcucauauagugcuuuauuauuagcaucuaagaaaccacugguauuugaguaaauuguaaguuagaauugauuuuuuaauagcuuuuuaaugcagaucaaacauuuguggcuuuugaaugaaaaauacuuaucaacuaauuuuuauuagcauugcauuuuuaaaaaaaucuacauuauaacauauuggagguugauugaaagggaguuuuugccuccauuuuauaaagaugcucuguaagagcacuggugauaaugaugucuauuccuguauuuuuugcugacuuuuaccugguauccugucaguaauuguuuuuucauguugaggaagaaaaaagaaucuauacuugcaucugucaguauuauuguuguuuuaacuuuauagguauauuguagacauugaauugaaagauuuguaagcuuuugguuuucugugauacugauugggaacaaaggcauagauaaucagagacagcaaauaauagccaaaaauauauauuugauauguauucauuuagccaacaauaacuagggccuuuugugaaucacugugcaagaugugcugguacuuacaaagaugaaucagguauagacccugaccccacggauccuauggcuuaauagaagagguaagaggugaguggcauaauagagucauggggugcaggagaggaaagauacugcuuucaugagggguagaggugugugucaggggagauaaggauauaucauguuuagaggaacaacagacuuuuaaaauucuauuuugaauuaggucgguuuuucuuagacugaguuccucauucuccuaggguccauuuguagggaaagguuuuuuaguucuuaaauuauuucuuaaauuuguauuuuuauuuugauguuaaaaagugaucguaccuguuauaaagguaacacuuugcagugauaacucauagaugaaagacauuuguuauaggaugagacuucaguuucuuaagucaguguuucucauugggauuuuuggacagauaugauguucaagagaacuuuuuuuuuaagggguuuauauauuuucuaaguuugagaaacaaaggcuuaggcucauuucauguuacuuugcacugucuaaacuacauucuaauugguggcagaaaguagguggccuagaaauguaaguagcaaauuuuuuucaggagguaaggcaauucagcaagguaguggagaguucacugucaguuaccacuauuuaggaguuaaguugguggcagugcugcugaaugggcacaguuuguuugauuuuaaaugguaaugaacugugaguuuauuaaauagaggguaaaaguucuaaauacauucugaacauaaacuagacccguuaaagugguuuguguuacaaccuacucuauaguguccuauacaguagucaaagcuuuuguguaauugauuacuucuguggucccaauguuaauuucugcuuauaguuuuguaauagcuuaauuucauuaaaguuaauuaaacauagauuaucuuguacaguaugguauagaauuuuguuccauaaauugggagaaacucauaaggaauaaauaaguacucuuuaauuuauaguucgguguuuccaaagaaauuugggcuucacauugggugaauucaucacgauagauuuaagaauaucuguauugaauaucccaaacauuguacacuuuugggggaacaucacugaacaauauuuuccuuucccacuuauuuuuuuuuagcagaaaaaaauaccccccuguccccaacaaacaaaacugaucaaaguaagaauuagaucauggcuuucaauuccuuagacauuuuuugaagucucuccaggcuuuuaagaugaggaauuccuaggaauuacuauucuuacuggggaaaaagacuauuuugauuacagagagaaaauuaggugacauuugcucacauuauacauagaauagaaugauucuaguucaucuguagauucuuauuauaguguuucgcauguaauauaugcuacuuuaggauaauauuuuauuacuguuugagguucuuaauaguucaugugucagcuugccuuuauauaaaagucuauguaaguugcuuugacagacuuuaaauaaaaaugggaaacacauaaaugcaguguugccauguucucuuuuguuuugagcaauuacaagcauuucucauuuccugugcacagaaauucccugaaaaaucaagacgcugcuaaaagagucaaacucugaaagaaaucccaaagauacaucacugcuugacgcaaacauuuuuaagaagucacugauuauaaugaacacagccuuuaauggcaguuuuucaucuccuuuucacaagaaugugacagagugucauuaagguuuuagaaaugaaugcuccuaaggaaaggaggaucacuaggacuacaaugaugcucaguauguggccaugggauucucuguugggcucuuuuuagguuuuuaaucagguuggagaagggaguuagagaggaaaggaauaggaacagacaagagcuuuaggacaccuguacaccacaguauuuuacuuucucauugaucuucuagauguugaauccguaagguuuaauauagaaagucaaacaagguuccaaauauuuugaggaccaguaaacaaaaucagcucuaacuauauauauguggaagcacauaauuuuugcauuuaacuuaaaguguuuggauauauuaaaucugaaauuucauuuaaauaguaauuccaguucugcucuaaggauauuguuuuaacccauuguucuuuucuauggugacagugauugcccuugauguauucugcaggucagucagauuguaucacagaagagggcacauaauaaaugugagccagaaacagcuaugucucaguacaggaacagaaaagcauauuuuugcaucacacauuaaaauaacacccagaaggcauugcaucacauauaaauguaaaucuuuucuagagggguguagcauggaaagaaggguucagccaaaauguccucuuaaguuuuuuaacaauaacaaacacuauaaagcucauauuuaaugaguaauaauuaaugucuaugaaguuuguuuuaugaguuuuuaaaauuacagaauauuguaauaaauaauguaaaauauuacaaaauaugcugugcuugagaagauauuuuuccagguuagaaaguuacaguuuuucugagcagguguuuucugugaaucucuguagcauuggaauuuauagagauauaacuuuucuauuucugugggguuuuuuuguuuuuuuuuuuuuuuugagacggagucuugcucuguugcucuggcuggagugcaguggagccaucucagcucacugcaagcuccgccucccggguuuacgccauucuccugccuaagccucccgaguagcugggacuacaggcgccugccaccacgcccggcuaauuuuuuuuguauuuuuagcagagacgggguuucaccguguuagccaggauagucucgaucuccugaccucgugauccacccgccucggccucccaaagugcugggauuacaggcgugagccaccgugcccgaccgauuuaucuauuucuuuuuuccauuugaagucagaaagaaauugcuagaauccuucaagucuuucucagugagaguaaaccuuuucuguauauaaaacgaucauucuguauacuucauuuuacuuugaguuuuuuagacauuaaagcugacacuggaaaggguagcuuuuauuuuacuuuuugacuuagcuacuuagguuguaugaacaauuauaaaaucaucuucauauguuaaaucuguaacaaauucuuuuucuggcugggugugguggcucacgccuguaauuccagcacuuugggagccugaggcagguggaucaccugaggucaggagcuugagaccagccuggcaaacauggugaaacccuguuucuacuaaaaauacaaaaauuagccugacgugguggugcacaccuguaaucucagcuacuugggagccuggggcaggagaaucacuugaaccugggaggcggagguugcagugagccgagauugugccacugcacuccagccuggacaacagggugagacuccaucucaaagaaaaaaaaaaucuuuuuucuucgacucuaagaugauguugaggcuuuuuugagcucugaauguaaacuuagauccuguggguuguuucuuaguauacuuucugguagcucagugcuacauuagcaguucuuuauuuuggcauuguauuuccucacacaaaguaaaaagucucauaaaucuuccuccuuuuaaaaaaaugaauugagaccaacaguuuucuaaucugaucuggcaaccugggcuucaguaagggcagacuaacaguaaugguaguauguaguagaaagagauugaaagaauuucucucccuggagugcucuaaagaaagauuuccaaauagcuauagaaaauuaaauaacuugcuuugaauuagguaggaaaauaaacuugaacuucccccuuucuucauuuguguuuuguuugcuguuuuuuguuuuuuuuuuuaauuuuagaaaaauugguuuacagaaaaauugcaaagauagugcagggaguugucaugugcccuguauucaguuuuucccauuaguagcaucuuauauuaauuggcuacauuugucaaaauuaaugcaucaauauuaacgacuuauuaacuaaaguccauacauuauucagauuucuuuaguuuuuaccuaauguucuuuuucuuuucuaggauccuguucaggacaccacauuacauuuaguugucaugucuccuuaggcuucucuuggcuguggcaguuucucagacuuuccuuuuuuuugaugaccaugucaguuuugaggaauguuagguauuuuauagaauguccccaaauuaggauuuguuugauguuuuuauuaucauuagacugcauguauggguuuugggaggaagacagaaauaaaguagcauucuuaucacaucaaguauaaaaugcuaucagcaugauuugucauugauguuagccuugauuaccuugcugaggucguguuugucugguuucucuacugugaagguauucuuuuuuccccccuucuucccaaacaguauucuuuggaaggaagucacuauacacagcccauacuuaaggaagagaguguuaugcucuaccuucuugagggugaaauaucuauaaaaauuauuuggaauucuuccuaugggugauuugucuguucuugcccauucauucauucuuauuuguaucaacuuguggauauuuacuuuacauuuuggguuauaauuuaauaguacuuuauuguguugcuuaaauuguucuagcuuugaccuuugggagugcuuucaguuggcuccuauguuucuuuaauauacuccuaucuuuuuuccuuaauuuuauuuuuuaaaauuuuauuuuuauuuacuauuauuauugauugauugauugauugauugauuuagagauggagucuugcucuuuugcccaggcuggagugcacuggugugaucucgguucacugcaaccuccgccucccagguucaagcaauucuccugccucagccucccaaguagcugggaucauaggugcccgccaccaugccuggcuaauuuugguauuuuuaguagacacaggguuucaccauguuggccaggcuggucucgaacucccaaccucaggugauccgccagucucagccuaccaaagugcugggauuacaggugugagccaccacacccugccuguuguuauuauuugugguuauuuuuuagggucaggguucacucuguuucccaggcuggucucgaacuccuaagcucaagugauucuccugccucggccucccaaaauguugggauuaagguaugagccacugcaccuggccuuucuuucuuucuuucuuuuuuuuuuaaacaucagauaguggagcaauaauauuggucaucaguguuucuuuucuuuuuuaaagcacuucguuacuuccuggcacugcaagaugcuaccgcucaucuuguuucuuucuuuccccagaccuagaaucagcuauuucugaaaggaguccugguuucuuuaauuggagaaugauauuagaaaccaaaaucugggugcucaguguuugucuuaauauaguuugacucaauggauugagucaaaucauagguaauuuuuguuugcuuuuggagacaaggucuugcucugucauccaggcuagagugcagugguacaaucacgguucauugcagccucaaucuucaaguucuaagugauccucacaccucagccucccaaguagaugagaccacaggcaugcaccaucaugcccaacuaauuuuuugauuuuuuguagagaugaggucucacucuguugcccaggcuggucuagaacuccuggccucaaguguccucccgccucagccucccaaaguagcuggaauuacaggaugagccacuccgccuggcucuuuggggaucuugauuacucuugagaguggaggggugucaacucuucuuuccuucuuuauuaccuguaaugaaaauaacagugcuuaccuugggguuugugaguaugaaaugaaauaaugcaugugaugaacuuaaccaccaucuugcauugacuguauuauugcuaacccauuuugagagaugaacuguuugaauaucaaggugucauguaggcaagaauauuguauaaauauaagcuuguuuagaauucugugucauuaauugcauuuacucuaucaguuaauuagagauucuuuuuuguuggcuuuuuuugagacagugucacuucgucaccuagguuggagugcaggggugccaucacagcucacuauagccccgaccuccugggcuuaagaaauccucucaccuuaucccccaagaggcugggacuaagggugcacaccaccaugccugggugauuuuucuguuuuuuguuuuuuuuuuaaauagggacgagguuuugccauguugcccaggcuugucuugaacuccuaggcucaagccaucuaucugccucugccuccccaaugcugggauuacaggugugagccacugcacccggucguuaauuagagaguccugaucucaguuggauuguuuaaaagugaaagugaaugaugauaauauuuaguaaaaucaucuuaaugcauuuugacuuuuaacuucuucagauuuuuauuaaaguauagagaauuuagauguuuuagaaaaucagugcaauauguuuggauuuuggaaaacaugaaauuuacauaauuugaagacaaaccucauugcauuuaauauucuguuuccacauuuguggguguucuggcuacacugguuauuggaagacauuuaaagauggcgggcgggguguaguggcucacaccuguaaucccagcacuuugggaggccaaggcgggcggaucaugaggucaggagaucgagaccauccuggcuaacacagugaaacccugucucuacuaaaaauacaaaaaaauuagccgggcgugguggugggcgcacguagucccggcuacucgggaggcugaggcgggagaauggugugaacccgggaggcagagguuucagugagccaccacugcacuccauccagccuggugacagagcgagacuccgucucaaaaaaaaaaaacggcaauuaagaugacauuuaaauaauucacuuaguaauaaccaagucaaccaaauugauauuauuaauauguaguaguugugcuuuuaauauuacauuugacaauaauuuuuuaauuaaauauauucuaguaaaugguuuugaauucuaauucuuucuuuaaaauaauucuuucauauaaauacuuuuacauuuaaguccagugauuagauaucucaugcuguugacuaagaacauucaaucuucguaaacuggccauugguguucugagaaauugaaucuuacagaguucuuuaauuuugaaaguuucuuguucucagauaauagccuuguaaaugucuccaaauuucagaguccuauucaucuuaccuaaaauacacuaagccuuuguucucuuuaaguaguacagauaucuuagcagccgguaaugguuaagggugugaguacaaggaacauucuguuuuggcccucucuguugugcauuguagaugccucaucacuucauaaauauuuauugaguguuuuucuuguuaagcacuagauaaaccuacaaagguaaauaagacuagaguuccugaccugucaaggauaucaccaccuggucuaccauccaucuguagcaaagugaccccagcguuccuaugcuuacacucuccuuuuuggcagcuuggccauguuaguucauguguguuagcuguuauuuuuuauuuuugcuuuugccaaaaaucucaguaagcuaaacauugggaucagauagguuucauucuuagauuucuugauagauuucuuugguuuaaguuaugguuugaguuuguuucccuuuuucguuaguaaggccacauuuuugugaacauuuauuugaauuaaauuucuguuuucuuugauuuaagccauuuucaugaauuuucuccagaugcgugaauugacauuagauaucacauuucuuuuuuaauggccauuaugguuuaauauguugcuauuaaaagguuguuuuagcuguuuuucaacucguuucaugaucuauguguaaguucccaaagggagagaucauauuuuaucuuuucccguaaacgccacagcauauaauagagugcccuguauauggcgguugucaguaaauguuugacuggauucucugaauggaguaaaacgguuuuuaaauucuuuucauagcaggauagcccaaauggcuauaaaagaggucaaaaauucuuuguauaaauguuuuugacuuuuggcugaaacuauuaaauucuuuauaaaauaaaucaucguuaaaaagauacccacauuuauguuauaagccaaacucuguuauucugguaacugaaaguuugugagcuuuuuagaugguuaaugggaauguucagauagauacgacuuugucaucuauugucucugcauuuguuaaaauaguaaugcuaucacuuucuuuagccucuaaguuaguugauauuuauuuacccuuguuaccaauguucuuauguuaaaacauucauucauucaauauuaacaccuuauuguagcuagguauuuuaauaaguaaauuaacuuccugaugcaaggaguugguagcauaguacaguguaguguuucacaaauauaaccuguugauccuauaaggucaaaacuauuuucaucauaguaagaugugguuuucuguuaucauuguuuuaguguuuguacugauaauguggaagcaaacaccaaaacaaugaaaacagaaaaccacaugauggguaaaacugcugaugccucagcaugaaucagugcugugacaccagucuguacuaguagucauuguauucuucaccaucacaaacuuaguugaaaaaaaaaaaaaaaggcggccgggugcuguggcucaguccuguagugccagcacaugggaagauaaggagggaggaugacuugagcccaggcguuugaaacuagccugggcaacguaaugagacccugucucuaaaaaaagaaaauuauccagguguggugcuugccuguagucccagcuacuuggggaaacugaggcaggcagauucccuugagcccaggaggucaaggcuauagugagccaugauugugccacugcacugcagccugggugacagagugagaccuugucucaaaaaaaagaaguuaaccuacagaaugagagaaaauauuuauaacccacguaucugauaggggacuaauaucuaaaauguauaaggaacucauaauacauauuuguagcaaaccaaguaacccaauuaaaaaaugggguaauggaccugaacaggcauuuuuccaaaggcauacaaauaacuaacagauaugugaaaaggugcucaauaucacuuuucagggaaaugcaaaucaaaccacaaugagguaucaccucacaccuguuguuagaauggcuauuaucaaaaaguaaaaugauaacaaauaguggugaagauguggagauugggaaccuguguacacuguuggugggauugcaaauugcuauagcuguuacaggaaacaguauggagguuccucaaaaaacuaaaacuagaacuacugucugauccagcaguucugcuucugccuguauauucaaaggaaaugcaacuacugucuugaggagauauuugcacugccauguuacguuagaguauauacagaauauacuugguaaggauguacuucaacugguugaagcagaagugaaugggugaacuugaguguggccugccacucuugauuauuuaauauccuguagcaucgguauguuuuauaaaacaaauugagagcauuagucauuuuuagucaguggguuauguagagauuuguuaagagagcauuuauugugacaguuugagucuguacaacauccuugcuuagaaaccaauuaaaaugccucaaggaauggauacguauguaguuacuucuucccuuucuagaucccaaauguuaaaggguauuauauagacccaaggaaguuguuugguuuuaagcacuuagccccauguugaacaacgacucuaggcagacauacuugaugagugaagcaaaaggaggaaaagcaaaagucaaaaauggauuuugauuauggguagugaucaaggaauggaugaugugggaacaguguguaaggaguaucuggagggaacaugaaggggaguaauugugucagacaaguuugagagagucauuuauaugacauuucccccuugagauuuucccuuuuaucuugaauuuuguauuacugaagauaauaaaugcauauauuuagcuaaugugaaacaaguguuuucucugguggauugacuuuuuuuuuuaacaaagauauguguauuauauauaaaauuaaugugguaaccuuuucaucuuauucuccuuagaauccaucaguagaagaauuauuuuguacacuaugugugaaagaucaaagaauauggggcagucaccaguuguuuacaaccugguuugcaaguggcauaaaaaaauauuaguuugucugcugaauaaaauuaaacuuauuuuucucucuguagcauauuaauuguauuauaguaugccacagccacuuccagugcaauccuccuagucuuggaacagcagccaauuccaggaauuaagagaauuagguuacuuugccuaguggcacaaaaaauaccaagguauuaaaucauuggcuugucuguuuggggcacaaucagaaauaaaguuuagagauaaaaguugauuugcaugcuguucacauuuguucauacuuuaacagguauguuuuucuauuucucuccgauuuauauaauccuuuugaaacagauuuucaguugcuguuagguccagaggaacagaauguuaauaaaauuuuagguuaaagacuaaauucagaauucaacuacaguaacuugaugcuacuggcugugacaacauuuuaaucuaucuuuggaauauuuaagcaaauauuaaaauaugugguuaccuaacauggcuauauauuaaaauauaaauguuauauuacccuguaacauuuuaaaugauuuacuaaucuauuauguaaaguaauauaagaagccaguuuagugguagaaauguuaauuuuauuuuaacuuuaguauuucaaaacaaagauguuauuuuugaacucaaagugguagaagcagagaggaggugacaaacugagaaccuuuugauuuuguugggguggaacuuggucugcuguuauagcugacauuauuacuguaucucaaugauuuuugagauuuugggaaaauuguuuuaauguuucacucccaagcgcugaagauacuccagaaaucuuugccguucuguuccuauaacauuugcucuuccauuuugaagcuacaacaguguaggauauuuucagcuuucuagaauuccuguagaaccucuguauucuaaaaucucccaggauuaaggaggagaaaaauaagcagaaagacaucagaaaaacuaaucagucauuagguucucuggcaagugaaaaauggaauaaagauaaagaauguagugguuaaucaagaguaaccuguuuauaacauagacuaggcucaaaacuuaaacuugaaacuuaacacaauaaauuaaaccaucuuuguaaacaguagaauuuaaagagauucccuuaaacauuaaacauuaggaccuucuguggugucaccuuauucaaacuaccacuguguuaccucuuuuugacucuuaaggcugccagacacccuacuugaaggauccuguuggaaccuguggaaauaauacuuacaagaacguugcagcuaagcugguccgggugcagugguguuacaacuaauggaucacaaccagucacggauuucuuuguuccaucuccauucccacuucuucacuugacuagccuuaaaaaggcucaugccuguaaucccagcacuaagggaggcucagacagaaggaucauuugagcccaggaguuugagaucagcccaggcaacauagcgagacuucaucucuacuaaaaauaaaauaaaaaaauuagccaggcgugguggggugugccuguauucccagcuacuugggaggcugaggcaggagagucacuugaguaauaaugggguuugaggcugcauuaagcuaggauugcaccauggcacucaagccugggcaacagagugagacccugucucaaaaauaauaauguugcagcuaaaagguccuaaagcauuaugugggccagaauaucccaaaucuaguuguaugucacauuuaacaugggcugggggcaguggcucacgccuauaaucccagcacuuugggaggcgaggcagguggaucacuugaggucaggaguucaagaccagcccggccaauguguugaaaccccgucuguacucaaaauacaaaaauuagccggguguaguagcuggugccgguaaucccaacuacucgggaggcugaggaaggagaauugcuugaaccugggaggccgagguugcagugaaccgagaucgugccauugcacucuauccuaggcgacaagagcgaaacuccaucucaaaaaaaaccaaaaaacuguauguucuuaaucucuaccacagauguaugcagguggggcucaauaauuuuuuuuuuuuuuuagauggagucuuggcucuguugcccaggcuggaguacaguggcacgaucucagcucacugcacucuccaccuccuggguucaagcaguucucuuaucucagccucccgaguagcugggauuacaggcacaggccaccacaacuggcuaauuuuuguauuuuuaguggagacaggguuucauuauguuggccagacuggucuugaacuccugaccucaagugauccaccugccucgccuuccaaagugcugggauuacaggcaugaaccaccaugccuggccaaggaaucuauaucuuaacaagucuguguuaaaauauaaguggcagcugggcgcgguggcucacaccuguaaucccagcacuuugggaggucaaggcgggcagaucacgagguuaggagaucgagaccauccuggcuaacacggugaaaccccaucucuacuaaaaauacaaaaaaauuagccagacaugguggcagccuccuguagucccagcuacucgggaggcugaggcaggagaagggcaugaaccuggcaggcggagcuugcagugagccaagauggcgucacugcacuccagccugagggacagagcaagacucugucucaaaaaaaaaagaaaaaaaaguggcacagaucaauuauaaaucacugcuucaaggccagugcucucacuuuguacauuaauaaucucaggcccaaauaagauaagugauaugucaacguauguucacuuuggucuuuacauggcagcuauaguauacggaauauuauaagcucagaucgucauagcuacauaacuccuuuaguuggaagaucacgcguaaaugcccaucaagagcuagcaguucugcauuugacucuugaagaccguggcauggcagacaacacuucuugagcuguaacagguggacauuaaauccaugacaggagguagagacggccagauuacuugagcccaagaguuugagaccagccuaggcaacauggugagaccucaucucuacugaaaaaggaggauaauccaacucucuucuacuucacauuaauauccuuuuaaugagcauggucagauacuuuggaaaguuguggagauaacuucagaaacuaaaucugaauaaaaaccuauguguaaacgaucauauagauggcuguuagcaaagugguacuuuuguaaacuuuacaguugacauacuauaguauauacuacauauauacuuauauacuacauauaauacauagaauuauacauaauauacuauaguaugucaacuauaguauaguauauuugacacguuuaaaauguacaguuucauagguuuuaagauacauauauacacaggaagccaucaucacaaucaagauagugaacauaaccuaaaucuccagaagucccucauguuccuuugugaucuugucuccugccccuucauaccguccauccccagggaaccauugcauucugucaugagagauuaguuuugcacuuucuaaaauuuugcauaaguggaaucauacaguagggacccuucaggaguggaggagggcuggcuuauuucagucagcauaauugagauucauccauaaaguagcaaguaucaauacuuuuuauuauauauugauugugguuaucccacaguuuauccauucacuuauugauggacauuugaauuccaguuuuuagaaauuacaaagcugcuaagaacauuuuaguacaacucuugguauggauagaugcuuucuucuugaguaaauaccucggaguggaauggcugaauuguaauggauauguguguuuaucuuucgaaggaaacaacaguuccaggccaggugcgauggcucaugccugucaucucaacacuuugggaggcugaggugguuggaccaccugaggucaggaguucaagaccagccuggccaacauggcaaaacucugucucuacuaaaaaauacaggccggguacuguggcucaugccuguaaugccagcacuuugggaggcuggggcaggcaaaucaugaggucaaaagauugagaccauccuggccaacauggugaaaccucgucucuacuaaaaauacaaaaauuagccaggcaugguagugugcgccuguagucccagccacucgggaggcugaggcagaagaaucacuugaacccgggagguggagguugcugugagccgagaucgcaccacugcaguucagccuggcaacagagugagacucugucucaaaaacaaacaaacaaacaaacaaaaaaaaacaaaaaguauuuuuacgugugguggcaugugccuauaaucccagcuacuugggaggcugaggcacaagaauugcuugaaccuaggaggcggagguugcagugagccaagaucaugccacugcaccccguccugggugacagcaagacuccaucucaaaaaaaaaaaaaaaaaaagaaaagaaaaaaauagcaguuuucuaaaguguuuuuaccuuuuuauguuugcacucauacugcagcagaugagauuuucaguuccuccaaauccuugcuaacccuacgaacagucuugauaauuuugucguucugauauuugugcagugggugcacauugugauuaaggacuaaugauguugagcaucuuuucauguguuuauuugcaaacuguccagucuuugcuuuggcuuuguauucacuuaauagugucuuuugaagagcaaaaguuauuaauuuugaagcccagugugucaguuuguucuuuaauggaucaugcuuuugggguugaaucucaaaaaucuuugccuaacuaaaggucauagauaauuucuguauguucucuuauagaaaucuuacaguuuuaggcuuaauauuuagguuuuugcuucauuuugaguuaauuuuuauaugaugugagguguaaaucagaguccuuuauuuuuauauggagauaucuaacuucuagcaccauuuguugaacaauuauccuuucucuauugaauuauuuuuucaguuuuguugaaaaucaguugucuguuguauucuguuuauuugucuuucaugaugccuauacuauacucuguugauucuguagcuuuauaauuaguauugaaguuagauaguguuaauccuccaacuuuuuuuuuucaaaguuguuuugguuauuuuagguccuuugcauuucuuuuucuuuuuuugaaagaggaucuucuggccagucaugguagcucacgccuguaaucccaacacuuugggaggccgaacugggcagaucacuugaggucaggaguucgagaccagccuggccaaaauggcaaaaccccaucucuguaacuaaaaauacaaaaauuagccaggcaugauacugugugccuguaaucccagcuccuugggaggcugaggcacaagaaucacuugaacccaggaggcggaaguugcagugagccgagaucacaccacugcacuccagccggggugacggagugagacugucuuagauagauagauagauagauagauagauagauagauagauagauagauagauagauagacagacaagauagauagacucugucucagaaggaagggagggagggaaaggagagaaagaaaagaaaagagagaagagaaagaaaagaaaagaagaaaagaaacagggucucccucuauugcccaggcuggaguacauuggcaugaucauggcuuacugcagccuugaccugggcuuacuugauucucuuaccucagacucuuguguaggucaaacuauaggcauucaccaucacaucuaaguuuuuuuuagguauuuauucacucugugguccaggcuggucccaaacuccuggguucaagagaucuacuugccuuggccuuccaaaguguugacauuacagucaugagccacugcacccagaugcauuucuguauagauuuuaaguguaguccguuucuuccagaaagugugguggggggugaauugggauuguguucaaucuguauauccauugagaauugacauauuaaaaauauuuaguauuccagaucgugaacacgguauaucugucuauuuaggucuucuuuuauuucugucaacaauauaacuuuaguuuauaaaucuucugucaaauuuaucccugaguguuuuauauuuuuugaugcuauugugaaaugauaccaguuuaaaauuacaguuuccaguauuacugguauauauugaucuugauuccuauaacuuugcugaaaucacuuacuaguucuagaauuuuuuuucuuuuuugguagauucuuuuggauuuuuaaguuguggaacuuaucaccugggaauaaaaaaggcaguuuuacuucuuuccaaugcagaugacuuuuuuguuuuuuuuuucuugccauauuggauggaagggaaccuuaaguauagggcgagagugaacauccuugucuuguuccuguuuuugagggaaaguauacagucuuucauuauuauguaaauauuagcuguagguuuuuuguagauacccuuuauugguuugaggaaauuuucuuugguuugcuguuuuuaccaggaguagauguuggauuuugucaaaugcuuuuugugggucugaucgagauaaucacacaauuuuaauauagugaauuacaugacuugaauuuucaaauauuaaaguggucuuguauuucuggguuaaaucacauuuuggucaugcaauauuauuuuuuuaacccuuuuugcauuuagaaaaaaagcugcagcuugcugccaguucucauguaauuucacauaaacacacucuuugaggcugaagcaaaucugauuuucagugugaaaauaaaauauaaaaacuguucuuggaguuauuucuaaacagaacuaacaucagaaucaucugacucaucagaaucaucuguuuuggaaaauucagauucaucaaauuagucuucggccaacugagaacaauguuaacaucaccuuuaggaauguuaugcaggugaguuuauaauugcaaauuuaauuuuuuaaauagacauagcuaaucaggcuaucaguuucuucagaaagcuucacugguucauguguuuggaggacuuaagaaaaaucucaucuaaguugcugauuuuauuggcacaaagcuguuuauaauauucccucaguuauguguagaaucucggcugggugggguggcucacgccuguaaucccagcacuuugggaggcugaggugggcggaucacgaggucaggaguucgagaccagccuggccagcauggugaaaccccgucucuacuaaaaauacaaaaaauuagccaggcaggguggugcacaccuguagucccagguacucgggaggcugaggcaggagaauugcuugaaccuggcaggcagagguuugcagugagccgagaucgcgccacugcacuccagccugggugacagagcaagacuccaucucaaaaacuaauaauaauauguguagaaucucuagugauaccacuuuucucauuuuuuuuccugguaugucugucuugagauuaguaaauuuuaaugacuuucucaaggaaccaacuuuugguuucacugauuuuucucuauuuuuuuuuaacuuuuuaaacuuuuuuuauuuuuaacuuuuuaaaaauuacauucuuuuuaauguuuacaguggauuuuauuugcucuuauuuuucuguuuucuuaagguggaagcucagguuguugauuugagaucauucuuuuagugcuaucaauuucccacuaaguacuucuuuagggcaucccacaaauuuugcuauguugugucuuuauuuucucuuuguucaaaauacguucugauuuccuuugugauuucuccuuugacccagggguuauuuagaaguguguuauuuaauuucuguacguaauuugggauuguccagagaucuuucugugguuaauuucuaauuuaauguauuguguucaaauaaaauacuuuguaaaacuucaauccuuuuaaguuuguugaaauguauuuuauagcccagaauauggcucucuugauaaauauccugcguaagaaugccauuuaaaggucagauuuuggaaaauuucaaaaaauuucuuucaguuuuuuggcccucuuuggagauuggaauuauauguguacuaggcugcuugaaguugucucacauaucagugaugcuuuuuauggguuauuuuuuacuuuuuucucucuguuuuauuauagauaguuccuuguuuugucuucaaggucauuuuuuucuucugcagugucuauucuguccaauguguuuuuaauaccagauauuguagcuuuccuuuuuuuuuuuuucuuuuuuccuuuuagagaugggaucuugcuuuguuuccaggcuggucuugaacuccuggccucagcuuccauaugugcugggauuauaggcaugagccaccaugccuggccaaauauuguaacuuucaucucuaaaguuuuauuuuggucuuucuaauaucuuccaugucuguacuauuugaauguaaggaauauaguuguaacaaugguuuuaauguucuuguccccuaauuuuaacaucuuuuucaagucuggguuaguauuaauugauuuuucuccuuacaaugagucauacuuuccugcuuuuuugcaugccuuggaaucuuugauuagaagccagacauuaauuuuaacuuguuuuaugcugguuauuuuuauauuccuacuaauauucuugaccuuuguucuaggauaaaauuaaauuaccaagaaauggcuuaauccuuuugggccuugcguuuaagauuugcuagguggaaacaagaauguuuggggcuaacuaauccuacuacacaacccuucuuacugcucuaugcaacaucauguaaauugaugagauuuugcagucucacugguggaaauagacacuauucccaucccugugugaaugccugguacuauucucuguaauccuuuugggugauucuuuccccagccucacauguuuucuuuacacauuuugaacacuuugccgaauauucagaaauauucuccuuuggagaucugugggaguauuucucuguguagcauucucuccuuuauuacuagaucuuucaaauuuauuugucuuuagucuuccuggguucucaucccuuucugcuaaacuccaggaguuugucaagagucuaccuggguucuugcugucuguucuggggccuggaaaaucugaaggcaauaaacuuugggcagugcuagaauucaccuagaugucuuucauggauuauuguccuguuucuuaaugucucguguuuuaaacgcuuuuucauguguuuugucuauuuuuuguuuauuuuuugaugguuucaggugggacgggaaaucugaucccuguuaauuuaucugaguuggaaguggaagucugcuacucacucuugauuucuguguaauaauuugagguuugacuuaaugcuuuagagcacauuagacuguuucaccuaucccucuaaagguuuauguauuuauaugucaaaaagguuauaaaaacaaaacaaaaaaagcauaguuuuaaaacugcuuauugggaagauaagaauucacuuuacauuuacgaucucauauuuuggcauauucgguauuuccuccauaacgccuacuaaaauuaaauuauguaaacaaaguacccaggccaggcgugcuggcucaugccuguaaucccagugcuuuugagagccgaggcaggaggauugcuugagcccaggaguucaagacuagcccuagcaacauaacaagaccccaucucuacaaaaacaaaguacccaguacauauuugaggaguagaaaauuagcaucuacugagguuuaucaaauacccagccuugggccagaugcuggagggacacagccaaaucugacagggacccgcccucaggagcccacauucuaguaggggagacagagucacagccguaaugacagaaaccagugcauuagauaagcaauacuuuaucuuaagucuaauuaauaauuuaauuuuaaaaguuccaggacccuuccuacaucccgagacauucuaauucucugccguuuguguagcaauucuuugaacuguugaaagaucuccugacaaauuguuacugauauuguguuaagcaauaaucuuaaccuucccaguaaaugaacuggaaugcccaauuuuaaguuucucuauuuaugaagaaacaaaauacaggggucauagucaggauacugccuaugguacauuuuaaaauuucugggucuacuaggauauaaucuuucuuaaccucuuuugagauuugaugucaguucaagggaagcauuccauugaugucaggaaggcagcuauuuguugacugaaauucugguacucuggcauaagcucguucuaaaaauccacaaauauguuguuaauagaaugggaccauacuuuucacuugggggccuacccgcuagaggugagaugucauccuugagauguuuggaagacuuugugagauuuuuuuuucuuuugcaaacuagacgugcgccagcuucucugaccuaaauguagcuccagugggaauuucacuauggauacuuuaucuuaagucuaauuccccugguaacccaacauugcugguuuuagaauuuaauagucuucagaaauuuuuuaagauaaauuugcuauuuucuuuauuaucuuuuaauuacuuuuauaacaugggguuuuuguuguguguauauacuagcauuccuuuggacacaaaguagacuauaaagaaaauuucuaaauucugaaugcaguuucucauugauuuuaauuauugcuauguuccuuuugaaaauuuuuuggcuggcucuggcaacuuaugccugcagucccacccagcacauuuugaggccaaggcaagugguuugcuugagcccagcaguucaagaccagccuggguaacauggcgaaaccaugucucuacaaaaaauacaaaagauagggcuugguggcaugcauuuguagucccagcuacucaagaggcugaggcuggagggaucgcuugagcccaggaaguugagacuguaaugagcuaugauugugccacugcaauccuuggcugcaaagugagauccuaucucuuaaaaaaaaaaaaaauuagaaaaagaauaaaaaagucuacccuaaccauuuuauauuuaaaacaaguuuguucuuuucaguguccuuacuuuuaaaauaguugaacugauuuuucugggaaucuuucucaaauacaaccuuaaacagaauauauggauguguuucugaugucuuagaauuauucuaauauuaauuauuuggugccauagacauauuguaguucucagaggcuauucauauguaugagaaauuuuucuuaauugaaauuuuccaaagauugcuacacucaagaguuuuuugaauucuguuuguaagcuaccuaagaguagcaaauagguuucauucucacauaccaauuccaaucuuuugaaacagaguguugaggagaguucugagagcuuuuggacuuaggaaggauaacuaagacaggaucagccaaaauugucuguuuguuugggaaaaggggauagagugaugggacugguacgcauuuuuguucucuaggguugguaagaggaauuuggguguaauuuguguacaucaugaaaacaugccaaugaaaccaaauggucugaguucagaugcauuuaaucccuauauugucuuuuucuuggaucucauugacacauauuucuauucuacucaucgacacguuucuucucuaagucuacucuaaugacacaauuucugcucuaauccacaaauacuuggacauucuagcucuucucauugucccaaccuuuuaaaacaacuucaguaauagcaccuuucuuaaccucuggggugauaaaauggugcuacuuccaaugacuguuugaggccuuaucuauaggguaacacacagccaucaaaguauagaucaaaagcucaaaagguuuaaguucaucaguagaaaaaccagggaguuuuuuucuccuguucuagagaaaaaagcucacagauugcaggacuguaguuaacuaguauuuauacuuguccuggguugaagcaauuguaauaguaugguugacaguagguuuauaaaauacacuuuuguaguuuuguaugauuuuuagauuuuacuugggguaaaauuggaagcgacaccuuaaaaagaacuuugugggaagaaauguguacaauugaguuucccuguuaaguucuuuuacuuauuugcucuuucauuggcccuuguauguguaguuguuagaaguggggugaagguaaauuguguaguggagagaaccaagguggcagaauuccagcuauagcauuguuucuugcuggugaguuguuagcuuguuugugagugcuguuuucauguucugucaguuucauuaauagacaaaacagugaaauuaaugaaagucuacuggcaucuucuuuuuuauuuuuuauuuuuauuuuuugguuaagauacaggcggaagugcaguggugcgaucauaagcucacugcagccucgaauuccugggcuugaggaauccuccucccucagccuccugaguagcugggacuacaggugcaugccaccaugcccagcuaauuuuaaaaaguuuuuuuuagagauggugucuugucaucuugcucaggcuggucucuaacuccuaggcucaggcaauccucccucagccucccauauuugacaucuucuugaaccucuguuuagggacucuucuucccugcagauaccauucagugccucaaccauaguuuuuagaggaccuugaguucuacaaacuaguuacuaauaaaauuccaagaccuuagcuuauaaugacuuaacaugguuaccuuuucuaauauugcuuauauuugaguaagaggaauggauguuuuucagauggaaaaaauuauuuugguagauguauucuucuguuauuucuuaaaucuuaccaauaaguagcaguuuacucuauucaugggugaucuugaccugguugauuuuuuucuaucaaauucauuaaauaagagaauuuuuguacacuugguuuaauaaaugaggcgaguuuuuaugggaccugugucucuuaaaguucuaauguacuuucuucagcuaccaaauugucauuuuaaaaacaaagugaagaucagaggcaaaauucauaagggauuauuugcaaauuacauguuauuucguuuagauucuuuaugcacaccuugacuaaguuuuaaaauuugcugggcagguucaacagcuaggaaaaucuguuaaaauuguaaauuuguugcuuuuguuacucuaaaauuaucauuuguacuguuuucuuaaaauggucuuuagcaucuuuuauaccuucacuuuugauaauuuucugaacuuugccggauauuuugacauuacagacugacuuuuaaacauucacuuuccccccauugucuuacgcauuaauagaagggaaugucaucugguguuuugagugugcaaaauaauauuuauggaccauucauagauaaguuauuuuuaaaggcauuucuucuuaaaaauuugaauauacacggugucuugcagugguucauaaaguacuuccagcauugguauuuuaauuugagcaacaguuuuugugugagcaacgacaugagugagcaauaugggcauugcauuauggacuugauugagcaaugugggcauuccaauagggacuugagugaacaaugugggcauuccaauagagagacuucagugagcaucgugggcauuccaguuguuacuugagugagcaaugugggcauugcaauagggacuugagugagcagugugggcauuccaguugugacuugagugagcaaugugggcauugcaguagggacuugagcgagcaacaugggcauugcaauagggacuugagugagccaugugggcauuccaauagggacuugagugagcaacgugggcauuccaauagggacuuuagugagcaacgugggcauuccaauugugacuugagugagcaacgugggcauuccaguagggacuugagugagcaacguggccauuccaauagggacucgagugagcaacgugggcauuccaauagggacuugagugagcaacguggccauuccaauagggacucgagugaacaacgugggcauuccaguugugacuugagugagcaacgugggcaugcacuagggacuugaguuagcaaugucggcauuccaguagugugacagauauucuuuugguuggugucucauuguucauuuugaagauuuaacauguuuuuucugaguuccuucucuuucaaccucuuaugacccugcagacugauuaugaaguuuccauuaaccagaauaagaaaauguacuugcagacuacuguaguuaacuguucauauagcauuuuaucuuaugcauacuauaaaacuguuauauggguauguaauacagaacagacaaaauaaggaaaacauucuuuuccaaaggacucaccguagaauuccuuuaacagagaucucugaugguauguuuugaaauuuaauaccuauaaaacuucaguuagauucugcauuucagaagcaaaucuauuguauagagccaaauacaacuauauauuuuuacagcacguuuguuuuuuugggggagaucauuaaagaauauuuaccuucuaaucagauuaaaaacuuuucuuugaucuuuuauguguucgauuuguuaaugguacaguugguaucagauucuucugauuaacagcaacuggccugaaucuacuauaaacuugugagagaaacuuaaaauuggcccuuguuauuacuuaauaaaccuauuauuuuucuuauuaauuuuuuuaaugaccaucauguuuacucuucuaggcagaaauuaugguuuauuguguaaugggaauaaacaugauuuguggaauuauaccucguucauauacucacuguauuucuugugaaagccguaacaucucuaagcauaguuucuucaauuguacaauguagaaaauuacuuuguagaauuauuacaaaaauucgaugaguuaggcugggugugguggcucacaucuguaauuccagcacuuugggaggcugaggcgggcagaucaguuuaggucaggaguucgagaccagccuggccgauauggugaaaccccaucucuacgaaaaauacaaaaaauuagccaggcaugguggcaccuguaaucucagcuccuugggaggcugaggcacgagaaucgcuugaaccugggaggcggagguugcggugagcugagaucacaccacugcacuccagccucuagucugggugacagagcaaggcccugucucaaaaaagaaaaaaaggaaacugcuaaaguuccagaguagcuguauuuuacauuccuaucaauaccgugugagugcaaaguauguuuuuuaaaaaaggaaauaacaugaauguccaggaaaaauggaguaauuguugauuguacagcuguaucuuggaagacugugugagucaucagaaauguuauguaguguuuucauuaaguagaaaagcagaaucuaaaacacuauuaucucaauaaaggcauagaaaauagaaguuguucauaauggauaauuugaauaagaauguuauaauauaacaaguuuauguugaaggauauuuauaucuaacuucuuaugucauuccuaguagcugaugguacccuucaguagaaaaggagggagagggaauauucuucccuaauucuuguuugugucacuauuuaaggguuuggaguauucacugucuaggaaaauaaauuacuuuuacuaagugucuugcuaugugcuaggugcuuuaugggaaaguuacccuaacagccuuaagaauauucgauccuggccgggcaugguggcacacgucuguaaucccagcacuuugggaggccgaggcaggcagaucacuuaaggucaggaguucaagaccagccuggccaauauggugaaacccugucucuacuaaaaauacaaaaauuagccgggcauggugguacaugcccgugauuccagcuaccagaaggcugaggcacgagaauugcgugaacccgggagguggaucgugccacugcacuccaaccuggaugacagugagacugucucaaagaaaaaaaaaaaaggaauauuugauccugugguuuauuggguauagucaagguaccugauacagccuguuuuucuuaccauccuacuaugagaauauauaaauaccuuaauuauuuaaaguucuuaucuucauuccuuuuaagcaugcaaaacuauauguauaaaccguaucgcagaauagcaccuccaaacugaggacugauguucauuguuuuuguucuggcagcucuagcuucgauuuucugugauuccuaauauuucuuccucugcuagcucaucucuaauagaaguucucucccauuuuaggccaggcgugguggcucaugccuguaaucccagcacuuugggaggccgagauaggcgggucacuugaguccaggaguuugaggccagucugaccaacauggugauacccuuccuccaaaccccuccccgcacaccgcagcccaucucuacuaaaaauacaaaauauuagcugggugugguggugcucgccuguaaucccaucuacucaaggaggcugaggcacgagaaucgauuaaacccccgaggaggcugacgcugcagugagccaaaaucaugcuacuguacuccagccuggacaacagagugagacucuguuucaguaaaauuuuuucucccauuuuauaguccauugccucauuccccacaaaaugauuuugucucuuuuauuaugguagaauugucugucuugcagaccauaugaucugaccagccuuucucucacauacuaguauuuaagauuaaauaaauuaaaauaauuucuuaguuuuguuuuguuuaaauacuguugugguaaaggcuguuuuuugucuuuuaucaaaaauguaagagguugaacaacaagaaauuaguguaaugguugaauauggcaauuucauaugcuucugacaaauauuucuuaagccucauuuguuuuuguuuguuuguuuguuuguuuguuuuguuuuguuuuugagauggagucuugcugucacccaggcuggaguccaguggcucgaucuuggcucacugcaagugccgccuccuggguucaugccauucuccugccucagccucaaggaguagcugggacuacaggcgccugccaccaugccuggcuaauuuuuguauuuuuaguagagacgggguuucaccguguuagccaggauggucucgaucuccugaccucgugauccgccugccucggccucccaaagugcugggauuacaggcgugagccaccgcgcccagucuagccucauuuguuaaauacgcuuucauuaagguagccuaggaacucagccacccuauagauuguugcuucaguacagaaaugagucccacauuuaaaagaacauuuuaucacuguuugugguguuuuaauauccagacuuuuguggucuucauguuggaaucaauaauauaugucaauauauuuugguauauauuaauauguaauuauauuuuaauauauggaagcauacaucauauauuaaaauauaugcauaacugaauuaaauauauacauuuaauguauauauuuuaaaaauuaguaaugcuucuaaaugucagugagugcccucagcuucugacaaugcuuaaucuaccggugucuaaacagcauugcaguguuccugcugcuuaaaucauauaggauucauuuuagcuaaggcuaaauuaggggaauaacugaagauauaucggaaauggaaaccccaaagaguaauagcuaugaauucuguaaaugggaagacagaccagccuuuacuguagcagucaauauauagagauaaggucuuacacugguguuuuuguuuguuuguuuguuuuuuuaaacuacugaugccucaguccuaccccuggaaauaugaguaaaauggggccaggacaacagaaaguugagagcuucuuuuuguacuggcuuuaaaagcaaggaucuaggccgggugugguggcuuacgccuguaaucccagcacuuugggaggccagggugggcagaucacgaggucaggaguuugagacgagccuggccaacgcagugaaaccccgucucuacugaaaauacuuagcugggugugguggcacacaccuguagucccagcuacuugagaggcugagacaggagaauugcuugaaccugggagguggaguuugcagugagcugagaccacgccagugcauuccagccugggugacagagugagacucagucucaauaaauaaauaaauaaauaaaauuaaaaaauaaaagcauggagcuaggucagaaauagcuacagacugagaguaaucacuguaaguagugacacaaagacuaaucuuugugcaguguggaaaguacagcuggguuguuucuuugauuccuccugccccauugagccauaccuacagagagcagcugugaaaaacuaucacuuucaacaaugaagaauaguaauaugucauaauggagauuaugaaguucagaaagggguaaaugcaguuuuggggagggcugagacuaagagagaacacaauaagacaggcaauuaagacugacaugaaagaucagucacauugauaggauauacucuugauaugauauaaugagaauggcaguuuaccgcugugguuuucuuuucccaaaacccauaaccacagccuaaccaugagaaagacaucaaacaaaucccaauuugggacauucuguagaauaccuaacccaguauuccuuaaaaacaaugaaagucagagauacugucacagccaagaggagccuagggagacaugacaacuaaguguaaugugguauccuggauagaauucuagaacagaaaaaaauuaaaaacuaaagaaaucauguaugagcuucaguuaauaagguaucaauauuguuucauuaauuuugucaaauuuaccauacuaauguaagaugucacuauuauaggggaaacuggcuguggugcacaugagaacucguuguacuaucuucacaauuuuucuguaaaccuaaaacuguucuaacccuaaaccuagccaguaauggugccuugguaauuaaaacaccaugcugaugaguauaugauuucuagcuagcuuuaugaaccccaugauagaauuuggauaugucaguccaaauuuaucacucuuaguggaaaaucaggguagguucacuucauuguuaagaauacaacaguaacauuauucgccuuuguaacuuaaaacacaucccagcgucacauaccauuuguacccccaccuccccucucaaacccauugcuuccccacuggccgcccccuaccccccaccaaaaaaaaaaaaaaaggaaaaggaaagaaaaaaggagaagguaaaaaggaaggaaagaagguaaaagagaaaguagaaagagaggaaaggaaggaagaauggaaagaagaaaacucacaaugguuggcaaauaaaccucuauauuucaaagguuauugugaggauaaaacucuuauaguuaugauauaaaagauuuaacgcgguguugguacauguuguuggaauaauucacagucaacauaaugagcagugauacaaaguucagguguuguagcagacguauuuugaguuuacagauauuaaacagugaaaguaaauuuuggguuucuguuaagaaacacguaaaauagccauuagaguuuuguggauaugucagguaaauuuugaaggcauuuuagaaaugucaacuugcuaacucuaggugacuaaaauagguaagcuuuuuauaaauaagguagauugagaaauuuuuggauaugaaauuaaugaucuguaugaugacugauauuuuauuuugcaaaucagcauaauguuuacugugucucuucuuguuaaaguguuuuauuuaccuuuccuguguuugacugucuauucuugauauuauguggucauuauuucuuugccucugucauuauguacuguuugcaucuuuuccguaguaucuugaucuucaaaauaaccaggcaugcuauuuacaugaagcagauaagcauaacccauguaaauuuucauugagucacugagaggugguguguguuuuuucccuuuuacuuuaaaaugauuuauuuauuuauuuauuuuugcuggcagccuuaauaauguuuucauaaaauaugaucgauuuauaagucuguuuuacaugccuuucccuuuuugucuuagugcuuugcuucuaaguugcagaugcagugggugaacaauacccuguguggugugacagguaaauuucccaauuuaccugccguaauagugcgcuguguaaugccauucaaucaucucugaauuuuacuugccugauuaguuaagugaagcagauuuucaauuuaaauguaacuucaucugcuugauuaaaaauguaacagaacauuaucugcugcaaauaaauuucaguggaagagaugauuuuugccuguuuaaaaauaacaucuguuuauguuggcuggaagcagacgauuaauaccucucuaauuucgagguuuaccaguccagcucaccugucucuuugcauggauaguugaaauugauggcugucgaguauaaacauuuaccuguugauguugaguugauggauuucuuuuuuaaggauaauacagaaucccaucauugggcauucauuuauuugcugcucaucaagaugauugacaguuuugccaacaacauggaaaaaggaucuuccuucaugaugcauaugagaaaaauuuuaccccucaaugaugagugcccuacagaaaaacauauucuuguagauucuuuuucauaguugguauuuauuugaauuuugaguuuagaguccauaaguauaaauuuaagucaagugcauaguaaauuaggguaguacaccccugcuggcauuuuucaucaagugauuguauguauaggccauaaggacaaggagaaagauaggaaaaaccaaaaugguuauuuuuuuuccccugcacuuagcauaguguuaggcauguaguagacuacucaauaaauauuuauugaauuugaauuaaaaauuaggcacagaguauauuugauauucuauaaauguaauagacuagaugucauugguuuaaauauguagcugaaaauuagagcagaaagaaauuacagaaugcuaauuggucuguuuauguuuuuuaagugaaaacuuccuuuuaggagcuuauuaaaaguagauuuuuaaacacagaauucuccuguaaacguccucuagggggaaaaaagacauugcauacuguuaauuuuccuaacugguaaguaaaacuggguuaaaaaaauagauucagaaaauucuaauguuaauaauacagugguacaauuuggugguuuuaaaaguauauuuaguauauaguaaaacacuauuuguuuucugaaaauugcuguaguuucacaaucugaaaaaaacgucuugucuuuuugaaugcuguauuuacuuugguggaauauuuugaacaugccacuuauuuauagaggaauaauuuugcauucuuuugguaacauuuuuguuguccuuuguuauaaagcaaacauaaauauuggcuugucuguuacugaauugauaaauugcaaacucuuauuuuaguuguaauggguuuuggccacauuguguaugauuugaguugaaacuauuucaggcagguauuugaggagauuuucuuuaucaaaaugcuucaaaucacaaaucaacaaaauuaauuuuuguucucaaauauauaggauacuuuauucuaagugagacuauauaagauauuuaaucucuaauuaguagauuuggucauuucggaugauaugauuguuuuauuuauaaaacaaauauuuggagauuguuuuccaauacaucagguuauuccuugauauuuagcagaaguuuuugccauagugcuuaaugaaaacagcucaaacuguuaaaauacauuuuugguauaaguauauuugguauguucuaugcuuuaauuauuaauuuguaauuuuauuuuaacaaauuacuuuguguaguuuuuuuuuagaagcagaucagcucaguguaagaaacuuagaauauuguuuuguagcuuucuuuguuauuucguuguccuuccuuuuuauuuguaguuugcaaggguagaugagauuuuuuuuucaguuucacuuguccagaugauauuuaauguagaaugaauaaacucagaagagcagccuuuaccuaaggaagaagguaugacuacuucaaauuguuucaucacuuaguuugacuucagagauuuuugcucugugauuugcacugacuucaaaacuuuuugcauguaucucaaaagugggugagaacauuuauagcagcauuauucauaauaaccaaacuuggaaauaaacgcuauauccaucaguugauaaauugacauacaaaaugugguauauucuuaaaauggaauauuauucagucauaaaaaggaaugaaguacagauucaugcuuuaacauaccugagcuuugaaaacacguuagugaaagaaaugagacaccaaaggccacaaaauaugugauuccauuuacgugaaauguccaaaugggcaaauccauacagacaggaaguagauuaguagcugacaggaaggagcugggagaaugugggaauggaaagguacuguaauggaugugggauauauggaagauguucuggauuaugguugcacaacuuugugaauguacuagaaaauacuugcacauuucaaaaaggugauuuuucuuuauuuuuauaaauuuuuaaaaaaaauuugagauggagucuugcugugucgcccaggcuggucuuaaacuucugggcucaagccauccucccacuucagcuucccaaagugcugggauucaggcaugagcuacugugcccagcccaaacagaugauuuuuauggugugugaauuauaucaauguuuuuaaaaagggaguugaaauauauaaauuguugguuuauagagauauuauuacuagaugagcuagucauugcuaauucuuugacauuuaugcuguaaucugaugcugugaagacugaaaauguugacagggaaauaggcugcaaguucgaggcuggccuuuuaaugaguuguuaaaaaauacaaaauuacaguugucagucuugucuuaaaaucuuaagaauagcauuucaauuuuuguugauaauacaggcacauuuaucuauuagcauuauuuuugcuuauuuuuuuacauaucuucuaaugauuacaguuguauuuuuuuuucuuuuuuucuuuuuuuuuuugagauguagucuugcucuguugccuaggcuggauguaguuucgcucugucaccuaggcgaucuuggcucacugcagccuccgccucccagguucaagccauucucuugccucagccucuugaguagccaggauuacaggcacacgccaccacggcuggcuaauuuuuguauuuuuaguagauaagggguuucacuuguauuggugaggcuggucucaaacuccugaccuuaagugauccguccaccucagccucccaaagugcugggauuauaggcaugagccaccgcgccuggcccagucguagugauuucaaagauggaacauaagacagccuuguggaaaaucagucugucuugaaauuguguuguuauuuuuugagguuucaguauauucauuuuagugugagagaaugacauccuuuaagguacaugguggauacauuguuaaaucguaguaacauccuucugugagccuagugcugggcacauguuugcaaucccagcuacucagcaggcugaggcaggcaagucccuggaagccaggagcucaaggcuguagugugcuaugauuguacaucugaguagccacugcacuucagccugggcaccauagugagacccccaacucuaagcagggucaggggagagaaacagaaaagaaauccuucaggaaauauuuaggaagauagaaauaauuauauuaaaaucaauguaaacauuuaugaaauguaaauauauucuaucaaaaauuauguugauuaaaaaguuuucuuggcacuuuuagauuaaaaaccauaaaucagcaguagcuuaugcaauguucaugugcuugaaauuagacaucucuuuauuuaauacauaacaguacauuguauaccguuugaagcugugugaacucucauuuugugacucagaggagagagaauagguacuugaauauaaaauauuaguucaccuuucaaaaucaauccagugugaaauauugguugccugagaggucagucauacagaauugugugcuuuauuauuugaaauguuauuuguuuucagccuggugcagaaauccuuuuccuucaguuauauuuuagaaccacugugugaguacauuacuuuuuagguuuugggccucauggacauucuuagcaacuuguuuucacagcccuuucuuugauguucauuugaaccauagcguuguugauauucagaguauuuugaccuacaaacauaaacauuuuauaugguucaaacuaacaguuaauuugcuucaguuuaccaggcauggaugaguacaguuucaaugcuaauagcaaauauuuuacuuauuuuacuuuccugagcacuuuacauguuuucacuguuuuccuccucacaucaacaaccccaaugaauuuuaucucucauuuauaaauaaagaaauagguguaaagagauaaaguaauaugcccaaguaagugggaaacucaggauuugaacccaacuccucuugcuccagagucuacacgcugaacaacaaugcuauuccgcccucuacccuugaucuaguccccucuuggccaucugguaguuuuguaaauucaagcauagcuccuucuauggccuugagccccuccuuucccugcacaguagagagggguuggacuuuuauuggauuguguuuguauuguaauuguguguuuuuccagauguguuuucuagccacaggaagagauacucaaauaagucuuucaacaguaucuauuaugcugacauucacacuuguuuguguuauuuuguacguuuuggaagccuucuguaguuaaguauuaguugagcuaauuccuuacuguuuuugugucauacuuuguuauggagcaacguaauauguguauguuguuaacugaaucgauagaaaucuaagaaucaacuuggucuauaucaucugaugauucaggggcugguuuggaucauugauaaaguaaauuauucccuguuuuacuuaacuccuuaguggcaguuuucuagauucccauuauuggcuugcaucaaaaaaaaaaaaaaaaaggcauuuaaaaaguuaugccagagcugggagagcaagaggugcucuauguuuuacugauggggccuggcaggauccuauuccugcucuccugaucucuuauccugaauccccugacaccucuauuucuggaauuuuucucuuuuguacuugguaucaguaaggaaauacauaguacgaauacccugagagagauuuccagcuuuauuuauugaucugacugucuuucagcugauaaaaugcuauuuuauuacccaaguuuuaaccucugucuggugauuuguuguuguuguuguuguuguuguuguuguugaaguucaggcugcaugugggauagguuugcucaggcauacuucuuaggaaguagucacuugcaugacuguuuuugggauaacucuuugaguauuuggagaggucuauuguaacuucugaaaggcauuguuuuuacguaugaauguucuaaaauucauucuaaauggucaugaaaagaaaaggauucacauuuuagaauggcaauagucccugaggacuauuaugucuuuuagauuuccuguggguuucuaggaauguuaguguaacuuagauuuccaccuaccugauuucuggaugugccuauuggaacuugcugagaucuuuuuuuuuccuuaacauguuguccccuugacccguacuucgaaacuaaacauauuauuuuauuugcuuacacuucaggaggcaauuggcagacaccaggccaacagucucuagaggucgugggugccaucuacaaguagucaugguuuuuuauuguauuuuaaaguccgcaaaagaucucuugcuauguuagguacacauacuauaggugaucaccuccuaucccuuaggaguugugaucaucuaccaucauuuggacacucauuuaggcagucuuccuggguguuccauuugaucugguguuaaaugauaaggugaauaucagguuacaauuuagagccuuuaaauaaauaagaugauguauuauuuugcauauaaauguacacuguucuuguuugcuacuuaaaggaauguauuaguuucugagggcugcuguaacaaauuaccauaaacucaauggcuuaaaacagcagaaauuucuucucucaagaguucuggaggccagaagucuguuggcaagcuugguuccuuguagagcucugagggaggccugucugugccucuuuucuggugucugguguggcugguaaucuuaggcauuccuuggcuugugauugcaucacuccagucuuuaccucugucuucagguggcuuuggucucaaauuuuuuucuucuuuuucuucuauggacaccugucauugguuucaggguccacucuaaauucaggauaaucucaccucaagauccuuaauuauaucuagagggacccuguuuccaaauaaggucacauucagaaguucuugggguuagaauuuggauauguuuuugugggaggggacacuauuugaugcacuaucaggaauaucuguucauucaugcauuuuauuuauuuauuuauuuauuuauuuuuacaauuucagccaauuugcuaagcaucuuacauuauacaguacauauguuauacuuuuuuucugggacauaauauuuuggagauuguauuauuucccaucucauuauucaguaaaccugaacucucacacugggauuuugugggguuggggguguguggaaaaucuguuuuauuaaacuuaguuugcuauaauuuuuucagauuauuaaaaacauguucuaaacaugaguguaugauuauguuuaguuuaauauuauuuauuuuuuaguuccuuuuacuuucuaucccaccauuuguggauagcauguaaauaaaucuugaaauuuggggcaagagaaacguaagagguuaauccacuucuaaggcuacaucauuuucagaguaacugauuccaaggaugagcagaauauauuuauuuaauagcuaugagagauggauuuucauaaacuuuuauccaaaguaacaagauucucacauucaguguaaaggguguuaugaaaauguaaaguucauuaauaugcuguauauuuuuauccccuugaauguaauuuagagauuauauacuguaauaggauuuaugacauuauacuguuuaaucuuuaggguguuacaaacacaucaaggacaguuggcaguaacugaaguuugcuugcauuuuaagaaugcauuaguauugcugaguaucauguacuuuccuaaaaauaaagaaaauuauacucuuagaauauuuacagauucaaauauuuuuuuuuccuugcaggccaagaauaaaaucuuuaugaacuaacaagaugaauuaaagauggaaugauucauuucuaugguuagguuuuaauuaauacaugggggaugauuuuggcacuuuuucaaagaauuuguuucuguguaucugaauuugcaccuacucuguaaccuaacugcgauuuauaaaaugaaacaaucucuucuaauuuggcacuugauaggugcuuugacuuuaaaaggcaaguguauuuuucugucacgaauaucuugucauucuaaaauaaguaaaaacaauggauugaugaaacuucuucacugcuuuuuucuuuguguauaacaaauacauugauauuuuacuggcauaaaauguguauuuuaguugagucuuuaaauuauugcucaguguauuuuguuuauuuuaagccauuauuacuuccuuuauguuggauuuggauaguuuagauuguaagcuucuaaagggcaaauaauacaucuuuucaacuguggucuugacuagcagucccaaaccuuuuugacaccaaggaccaguuucauggaagaaaauuuuuccauggacaggggucgggggauaguuucgagaugaaacuguuccaccucagaucaucagacauuagauuaucauaaggagcauacaaccuagaucccucgcaugugcaguucacaauaggguucaugcuccuaugagaaucuaaugcagcagcugauuugacaggaggcggagcucaggcucuaauucugacuagccugccggcugcucaccuccugcuguguggcccaguuccuaacaggccacgaacugguacugauuguuccccagaguuuggggaccccuugucuugacaguaucaugcacagguagguacuuuuaagcuguuugauauuauuguuucuacuucgggagaugggaagauaaauggaauaaaaugagcaaaguggcagugccauuaaagaucuguggauaucugauuucucacagaauucacagaauuacccuucauuaaaagaugcaaauggcaguuuuaugaagucuuuuugcccuguuuuguguuggguguucaguacagaugcaauuuuuuuuuuuuuaaauuuucgauacaggguugguugaauccacuguuguggaacccauggguaugaaggcccgacugugcuggguuaaaaggucuuuucuguuagaacuuaaaaauacuauccuacuuccuuuuguccucugugguuuccgaugacaaauucucaguuauucuaauuuuguuacuuugugaguaaugcaagugaaacuuaagaauuugaaaauuugaguuuucagccauuauuuacucaaaugcuuuuucuuucuccacuauacucuucuucccuucuggaacuugaggaaaugaauauuagaccucuugauaacuauuguccuguaaguccuugagguuuuuuauuuuuauuuuuauuuuuuuguuuuaagagacagggucucauucugucucccagcgugaagugcaguggugugaucacaacucacugcugccucaaaauuggcucaagcaauccuccugccuccaccuucagaauagcuggaacuacagaugugugccaucaugccugacuaauuuuuuuuaucuuauuuuuuauagugccaagauuucacuauguugccccagucuggucucgaacuccugggcucaagugauccucccaccucagccucccagagugcuggaauuaggugugagacaccaugcccagccccugagguuggucucuccucucaucuucucucccccuaccccuccccccuuccuucccccuccccccucuccccaccccuccuuauuacccuccccccucaccucccccuacccuccccccucaccuccccuacccuccccaucucaccucccuucccuucccccgccccucccccuccuuuccccucccccuccccuuccuccccuccccucccucuccuccccuaucucaccuccccucccuucccccaccccucccccucccuuccucaccccuccccuuccucaccccucucuucccccucccuccuuuccccucccccucucuuccucaccccucccuucccccucccuccccuccccuuccccuccccucuccuccccucuucccucuccccuccccuucucuuucccccuccucucccuucuccucuccccucccccucccuucuccccucgccccucccuucucuccuccccucuccccuccccuccccucucuccucccaucuccuccccucuccccacuccuuccuuucuucauuuuuuucccaucucucagauuuaauauuuucuauaaaucugucagcuaucuagccugucuaaugagauuuucauuuugguuauuauauuuuucaguuucuaaauuuugcauuugauuuuucuuuauaucuucuauuuuuugagguggcuuuccaucuuuguucauccaagaguguuugcccuuguuggaacauuuuuauaauaguggcuuuaaagucuuggucagauaaauccaucaucugcauuauuucaguguuggcaucuguuguuuuuuucucauugagguuuuccugauucuucauuugucaaauuauuuugggcuguauccuggacaauuuaagugucauauuuugagaccuuuugucuugguuuaaugcugugaugaauguugaauucuuuucccccgcugagacugaguuuugcacuuguugcccaggcuggagugcaacagcguggucucggcucacugcaaccucugcuuccugggcucaagcgauucuccugcgucagucucccaaguagcuaggauuacaggugcacacuaccacacccagcuaauuuuuucuauuuuuaguagagacgcgguuucaccauguugaccaggcuggucucgaacuccugaccucaggugaucugccugccuuggccucccaaagugcugggauuacaggcaugagccaccacgcccagcugauuuuuuuuuuuaauaggcaauuugguuggguucauucagguugaaaguucuaaacagccuucuguaggcuguaguuccaaugccaguuuccuuuacaaaaccuuugcagucuuacucagaacuguccagugugugugccaaacauuggacugucugggaacugaguaguugucuacuccauaguuuagcucucagagucugugguauguuauuuuaggaucaaccuuaugcaggcauaguuuggaagggugagcacaaacuucauggggccacuuuccuaugcuucuccuucuucauaaucucucugguacuuuuugguugccuaauccuccccucuuuauacuuccagcuacagagcuggagcuugcuuuaguuacucucuucugcugcacauuucuugcagcugugcccauacuggggccaaguagcaagaagacagagaaaaaaauaagcaaaaagaauucuugcuacccucuugaugaugaagguuuguucccucagaguuuuagacuucugcagaccccacugcugcugcugucacugcuuccaccaccaucuuguuugcucaggggcuggguauggaggauguugaaaagaauaaaaaaaaugccuagggaauuuucuucauucuaucuaaguauuaggagauucuguuccugcuccucaagcuagaacuagaggcuucuccuggaguucucuuugucuaucccugagugccugcuuccagauuucagcugcuuugagucuagggcaggagauacuaaagggggaaaaauacuaaaucaucuguuugauauuaauaugaauucuuauuuuauuccccagucugccuuaacuagcugcuuuaugcaucauccagguuuucuggauucaguggaaaagacaagguagugugugcuuauuccaucuuacuuggaauuggaacuccugguauauuuggaaaucaacaaaaauguuaaaacguaagaaacaauuguaacucuaauguauggguuuccccauauucuuuguuuuaugcuucauguuguuuaagaauacaugcauuaggcugggcacgguggcucacgccuguaaaucccagcacuuugggaggcugaggcggguggaucaccugaagucaggaguucgagaccagccugaccaacauggaaaaacccugucucuacuaaaaaaaaauaccaaauuagcugggcgugguggugcuugccuguaaucccagcuacuuggguggcugaggugggagaauugcuugaacccgggaggcggagguugcggugagccgagaucgcgccauugcacuccagccugggcaucaagagcaaaacuccgucucaaaaaaaaaaaaaaagaauacaugcauuagaacccacacaaggaaacugucccguuucaggguacaccuuuuaugggugcaacuaaaugugcaaauuuaguaaaacauuuugggcacuugaagcuauugcaacuuuugcugccucagagaagcaggauaauuaaauuuuugccuauggaaaaaguaauuuuaccuuaguuuuaugucuuuucuaauuugucauaagauucuaggccaaagaucuaauaaccauuuucuaggaaguuucuuuuuguuuguuguacuuauuugaagugcauuagguuucucuucuuuuuaaucaccaguauauuguuuugaaaguauauugaacauuuuuugucauauuuuuucuccuuucucuuuuauauuucuuaccuuuuuguacuuuuuguuuuuuacacuguauuucuuuauuuuagauucuucaccccuacucuccauguccccuacucccaccccacuaaaaugguggauaggauuuauguaggggugcugcucugagaguuugaacucugauugagagacuaauccccacccccgaaggcugucugcaucagcugucccccuggcuaauuagaauuccaaagggcauuaauaaccauuuaaauuaauccgauuauaccugcaguugcuaaagguaagguucaggcuguuuaacccucuguuaaugaacgcaaacaugaaucaaaacuggguaggaauuuuacaguuuauuuucauuucugcccaaaggaagaaaaccauuucaccugcucuuuguagcagucuaguuuacaacaaugcaaggaagccuugccauuaauucagccuucauuaaaagaccaaagcuaaauugcuccaucuugugaaaaugcauuugcauuguuugugaaaguccuuugggggcagagcuguagaaaaccgccuaacagcaaauaauccuuuaguuaaaugcaaaaguguuauaaagagcuaaaaauucucuuucuagcaacuaauguugcaaugauaauuugacaguaguggucucccaaggggcauuaaacagguggaaaaagagcuaccauuucagaacuuuaguuaaaaaggaguggaaauugaaugaccaguauuaagagucagaagaaagucuauaggguuauguaguccaguuucucucauauaggaauuuuuucuccaacauaguggacaugguuaccuaguuucuuuguaaacaucucaguaacagcaaguguuaauaaggcagcccaucucauaaucagauaacuuguuauugucagagaauccugaucugaaauuaguaacuauuauuuuucuuucauuuuacccuuugagccauauugaauuauuucaguauagcucauugcccucauuccuauucccugaccucuccauauuuucuucuuuagaucagguguguauuacaggagauuuuugaaauguagaaauauauggaagaauaaaauguucaguaaacaugauuguaagacagcacuuuucauacaugguugaaguugaaaaauuuuaaagcaagaaaaggaccagaagaaauaucuuuccauguaauuggcuauuucuugaagaguuauucuuuuugcuguuaaugugugugucaccuauggaaaagucuagauucaauaacuaagucagaaaaauugguuugagaaaaagacaucuacuggaaucuguacggcaguccuucaacaaagauaucuauuagucgauagaugucauccccaacaccugucuacaaugacucaugucuuuuccugauuaccacuuauagauuuuucccuuuuuaaaaaaacuuuacacaaaauguaaacuucauacauugggauuauucuuuagucuggaucuuuucuuugaaugaaauaagcuuugggaugcuuauuuagauguucaauggaacaguguggagaacaguaauuguguuugggcuaaagaauuaauccauuuagucaugggaagcacuacuuagcuuuccauagcagcugaauuguggugcaacuuuggggcuauuuuaggauuuuaaccucaaauagaaaugaaaguuuauuuguauugaugaacauaugcuuuugaauaaugagccauugacuugauuucaaugaaagugaaauuguuuuucaauucaguuauuuuauguuugaacaugaauugaaagcuacaucuuuguauugcugaaauuuaaaaaaaaucaauaacuuuaacauuuuaacagaaaguguuuuaauaagcaauuauuaggguggcuucagaaggguauuguagcuuuaaaaauuucugacgguuauuaguacacuuuuguacuguguaaaucagacauuggaauaaaauuacuuuuauuaacuaaaauucuccuacaauaggaaauuuuacugcauuuugacaucuagcaggccaaagaaagauguucagaaagucuuauuucugucucagaccaauaauuaucccauauuuuguauaaaacauucuuuaaaauuguuaguuuagaugaucacacaaaaguaacuuuuccaagggauguaaguugccugccacuguacuacagucuggcagguucuacagccuggagaaaaaucuaguagccuuuuaaaaaaaaaaaauuguguuaauaauagccuguuuauguuguuggauuuucugcuguuucauguacaauuuuauaugagcuaccaauuaaugcaguuuauaugcaguuucuauccucagcaaggaaugaggugguaauccugcccugcucuuacuacaaaagcugggcacauaucuaccaaggaaaaauuuguccgccuucaggaauuucuuucucccucuuuccuaaucagugcaaauccaucagucaccugaagucucaucuccuccaugaagcuuguccugugugacccuuguaaccugauauccucaucuuuaaaauuauuauuugaaugccucaucccuuucccucuuacagcguuuucauuaugauuuucagguucacacucaaacucagacauugcugauguucuuugaacuccucucuggcacuuaacuugccuaucccacacaauuaagcacucugaccaauuuuguaguuagggugaaguuuucauacaaauguggauauauugaagacaaacucuaaaaaauuggguacuugcuaugcuaggauaguggccuuuaauauauuaaagaauauuucucuuuuugaguuagcauuuuuaauagaaaauuagauaaugguuaaaacucaaauuggaguacuugauuccuggugauuuaagagaugauacagagguccuauaagagacuuuagagcuuacuuacauaucguaagugguaggucaauguagaguuaaguagcaacggccuugcaacucaagagcaagacuguuagauaauauagguagagaaucaagcaggaugaagcaguguauuuaguauagggaauggaauuauuuggaguaaugguacugggaaaacaugucugaacagauaauagagagugugugggguuaagacagacucuaguggcacugggaggauugggauagagcuugguguugcacagauauugugccuuaagcuuaagugauguauugaugauuuucauggagcauuuauucuuuuuaaagggaagauuuauuuggguguuguccugguuaacuucaggaaggcuucugugugaaauuaugcuggaauucguuuuaaggauguaaauccuauaaauccacagcuugggugacaaauugaaucucuaacaaauagaaggaauuuaagagaaaaauccuguugucaaagaauagcugauauuacaaacaguuauuauauauacaaauucucuauccaaaggaugucuuuguauguuguugagaucauugucacugcuuacucucagguggguauagcagaacaagaacucagauuucuuggauucucuuuuuucuuuuuuuuuuuuuuuuugagauggggucucacucuauugcccaggcuagagugcaguggugugaucucggcucacugcaaccuccaccacccggguucaagcuauucucaugccucagccucccuaguagcuaggauuacaggcgugcaccaccacaccuggcuaauuuuuguauuuucagugaagacgggguuuuaccauguuagcaaggcuggucuugaacuccugaccucaggagauccgcccaccucagccucccaaagugcugggauuacagacguaagccaccgcguccagccagauucucauauuuuuuguaacagcagaucccuuauaagugcaucccuuugcacaccuaaaugccuaaaucauauuguugauaaguuuaauucagcaaauaacuguuauuuagccacuagggacguugcagaagaaacuacaaaauaaaguuuuuuuuguuuauuuucuucucaucuccuuuagauauaugaaaaaugcugcucauuagcaauguuugugauguggucaugcaaaccaauguguuuugcgucuaauguagcaguuuaaugagugggaagaugacuauccuggggugaauaugaaauguggcauggaaaaggaaacaauugcuugugaauccuggagaaucugguaaagggggaacuuaaauaugucgaggaagggaaaggcauuguaaaccagaagaauagauagggagaacaguuugagcaaauuguuuugggaggcauauuuaauguagugaagacuuaauguaguagugauuuaaugcgaauuagcuggaagagacacuaccuacaaagcucauaauuuaguccaaauucugaggaguaacuuauacuagguugguaaugguacuacugcaaguaaauaaaauauugccaaaauaauuuugaaauuagagucaccacgauuuaaugacuugauaaaaauguuaauggagagaagagagauuguaaguuugugugauuuuuuaaaauaauucaacuacugauagcaauagggaaguugaaaggaagggcccaguccacuuuaguuuuagauguguagaguuugaauuuucugcauuugauuuuggugaaggaauuaugaggguacuucaaaaaauaagacuagaauguuugugucaggcccagauauauaaauauauauaaauauuugggcauggaaagaaaaucccaggaaucaaauaaugugccaguuuuaugauuuugacacacucaaaccucugccuuuuguuucucugggucacucuguccaguacaacaauaggcuugcuauguauuuuggaugaacaaugaaagagagugaacuguucuuuaaaaagcuguuuauuauagugaaacuuuaucuguagaugcagccacuuugccagaucucugauggaacuaacaauaauuuugucuaguuaauuuuaauaguacguccuuugucacagguuguucaaaugaacaaauauaacaugauuuuuauggcagguaaagaagaauauuuuaaauggaaggagaccugaugcaaagaaaaaggcauuauuuuuaguggugcagcgauuuugggacuuauuauaguagaaccuauucuuuauagagauuauuuuguuugauuuuucuauuuuguuuuucuuugcuaucuagcuuuguuacauagugaccauuuuuagcacuauaaaacuuaauguaguaaucagauuuagcagauuauuauuuaaagcugagcauuuaaaauuaacuuuuugcccuguguucauuuuugaauuuccuguuuuuauauaaauauuugauuaaaaagcuuucuguuuaauaaaauuguguuaugauuauuuuaaugucguuugaggacauuuaaaaaacccucccaaaauaucuaggauauuguuuuaaucuguagccuucucaguagaaauuaaaaaaauugggggauacacuuuuuugugugaaggauaaagcucuuguauuaaugacaacauuagguacuggguaguauuuuagucauuauuaaaauuauuauuaaaaauucuguuauauauuguaacguauuaaacauuugaguauguguugaguucaucauuugaauacauagugcuguuuuaaguuauuuguguguuaugaagaaaaggucacuauguuuuauuuuuauaagguggaaaaaacaauccagaaugauaaucaaagccaagguagaggaacuuguuaaacacuuuaaaauuagacuuccccccacccccagccucuagugugauacuuugaaggcagcugcuacagauaaacucuggagccccagauggugguugccuaauccucaugagaauucauguccuggaagcagcucuuaucucuccagaccugacauugucugugagcuuuugcuaaggagggaauaauauaaacaugcuaugcaugaguuucacuucuugaauaugucaaagacacaggaaguuauaacaaaguauaaaaagaaccgaguucacauuuauugaaaauguuguuauuuaaagcacuugaugcuagcuugugaugaugagugauggggugcagucuggaaggaaaggcacagugaacuguuuuuuauuuuggaaacgaaaaugccagucucaguguuaugauuucagagauguagauuugucauuaagugugcaguacccagaauaauucaguuauuugaucuaauguaagaauguaaaacaauccauccuguaaaugaauguccuggcuuuuauuuccuaugcaggaguccucucuguuucgaaagucaaaacagcaauugcacuauucuggauuugauguuuuguuaaaaaaaaaaaguuuccgaaaucugaucugugagaucugggccagugacaacuauaagugguugucucuuuggcauagcagccaaauauucugaagugaaauuguggauacuuuaucuacuucagguagugucucauuuaauauaugagcagggauguuggcacugucaucaugaauaauuguugaaucacccaucacuugauguuaugacugucuauaaggaaaaaggggaauuucccaucuuauaaaaugacaaaauuuguaauuaaaugggaaacuguaguguuccucauaacaaagccuaagccugucuuucaaaucugauaccucuuucucuaaauaaccuguuuuccaaccacucuggcccucuuacuuguccuagaaucuguggugcccuguuauguuuucauaucuuuuuucauuuuauuucaucauucugcagagcccuuccucaaaaaagcuucuauucauccugugagaugaauagacccagcuaaaauaucacuuguucuauggagucuuucucagacugaauaauuuuauuuucucccagaauguuacaaccagaguaaucuuuguaaacuacagauuugaucaugccucaauaaaaaaguuuuaaugguaauuaacauuucauaucaaacucaguguaucagccuaguggucucugucuucauuuguccagccgaucacaucuucucuuugucacagaacaacuugcuguuaucccuuccucugagccuacuuuguggucacuuuugcccuggagugcucacccgucugucuauuuuagucuuccucauuuuuaaagaucuagagucuaugaggaauuaagauaauacaaaguggaaaguguuaggugccaaaagagaaagaauucaguuggcauacuuauguugucuuugccuccucuguucaagugggagguccuaaugauagagcuugcucccucaaacuuguguauauucugcagucucuaguacaguaucuuagggaagagguagaggaggagauaaauuugaaagauuaguaagaaagaacugaguaaaaccuggguuugguuagauaggauaggugguagagugaaggaagaggcaucaaagacucguguucaauaccuuuuuugcauugaauuaauugaugauugacccuugguguguuugucauauuuuccuugcucuuugaaauucuuuugccuaaugugugcuaaaguagucugaaacagacugcuuaccaccuguaucuuuuagccuucuacccacugagcuccuuuucuauugcuuccuauuuuugacacauuugccacacccuccuccccaccuguauucucuuuuugggguucuguuucccauaguaauuuaaauggccaaugaaaacaugccccagaugauacuauuuuucaucaugcucuccugccacuuuguuuuccuguuuaaaagaacaaacagcaaaagaaaaagacacaagcugcuaguuuguagccuagcuggcucugauuucucuaauucuugucuuugcuguucugucauucuugguuucuacuguuucuuuuucuuuuuucuuuucuuucuucuuuuuuuuuuuuuuuuuucuugagacggagcuucacucuuguugcccaggcuggagugcaauggugcgaucucagcucgcugcaaccuccaccuccuggguucaagcgauucuccugccucagccucccgaguagcugggauuauaggcauacaccaccacgcccaguuaauuuuuuguaauuuuacuagacacaggguuucacuauguuggccaggcuggucucgaacuccugacuucaggugauccaccugccucggccucccaaagugcugggauuacaggcgugagccaccgugcccagcccuacuguuucuuuuucugucugucugucugucugucuuucucucugucugucugucuuucugucugucuuucuuucugucuuucuuucuuucuuucuccuuuucucucuguuguccaggcuggagugcaguggcgcgaucucggcucacugcaagcuccaccuccuggguucacgccauucuccugccucagccucccaguagcugggacuacaggcacccgccaccacgcccggcuaauuuuuuguauuuuuaguagagacgggguuucacgguguuggccaggcuggucucaaacuccugacuucaggugauccaccugccucggccucccaaagugcugggauuacaggcgugagccacugugccaggacuguuucuuuuucuuaccgcgcucugcucccauuuuugccuucccauuugugcgccaccauuauuaaaugcuuuauauucucucuuuugauuggguuacacguucuuuuauucuuccuauucuuaauccuuuguguuuucucuguuacuuuguuuuucuaauuuccucucucuuuguuaucuuuuucuguuuucuucuccauguucacuuccuuuuuuuauuaucuuucaacucuccuccuuuuuucacucuucacuguguaucauuaaaaaauaaaaacaaacccgaaaacaaaacauaagcucuuggcuguauucaggccucauuuugugcuuaauuuccauguuuccuguugcuuuaauuagagcugacaccaaguuuuccccuucauuuaugacuuuucauuguuuuccucauauuccuuacccauaacaaaucuuaaaaagcuauaaucccagcuguucuccaucaccaucauguccaacuccaugugcuuucuuuuuccauuuuucuuccagugauuuuauguauguguguuuauuaaaguccuaaaauggggaaaguauggcugaugugcaacuguugaguccugcaauacuggcuuuucugccuccuagaagccuugguggugaggguagaagcgggagccaauucauaaaaagagagugaagagucaaauaagaaauuugaggguguuuauagcugucuguaaauuaugcuuuguggaaaauagaguuggaaguguaauugaggaacaggaguagaccagaaauaugaaccauugaaaggcucucugcuuaaagaugcuuaucuuuucuucccuuccccugugacucauaccuacuguucauuagaaaugcauguguuuuaacuggucuuuuuuaaaaugaaaauguucuguaauguuaagucuucaucacacuuugugugacuuaaucagauugugaauaggaauuuuaauuuugagugugagggaaggacaguggagggagagcacuaauggguagaaacucuccuguguaacaggggcuaugggagacaaggguaucauugcaugcucuuguaacuuuuguuuugaauucauugaauuuuuuaaaugaagaagauauuagugagagucuaguuuaauuuauuuauuuuauagguuaaaaaacgauccagagagauuuacuuguucaggucuuacagcuuguuagugauugaaaagggccaguucaauccauugucuuuuuaaugccauauuauuuuuguauuacaguggcuuccuagccauuccuugacuugaagugagaagaaaaggaucaaagagaaaaagagacaaaaaguaauauguauaugugcccuuccaccuucucauucuuuucuuccuuuauugucagcauauuauaauauucugguuuuccauaucugaagaacagauccugcuuguacggcuaaggagcuguuuuauugcaaguauuagaaaacaaaaauauuagagcuuuauugaggaggaaaguaauaauauauuuuaaagguuuucuaugcuauuuuauuuguguucaucaaaaacacaagaucacuuuuuguguagaaaaucugaaugggaagcaaaaucugacuggagaauccagugguccagaguuacuuuaagaagugaauauguuuaaauagcagggcccaaugacaugcauccuagggcacuuaaagauguggcagauaccauugcagaggcacuagcaaauuaccaugcacaggaugugaaaagggcagaguaaugguagggcuucuaagccaccacuuuuguuaaucuagugcucuuuaccaccucccccaaagcuauagaaacaaagaagcuauacaaaacucauauuaucugcauugcacugggcuuugaagacaccacuuauccagccauaccccauuuucucaacuuacgcauccuaaauguaaauccaauguggguuuuaagagcuuguauaaugucuauggaaaauagagaguagaaauagagcuucuauucacaaguguuucuugaaucccauuuuuuagaguacauuuagcauacugacuuauuugauccucuaagcaacucagaaugucucugauauaaugcauaaaaauaaagauagcacagugugcaauaaaaaaguuuacauucuuuggauucaguuuguauuaucaauccagaccuuuuuauuuguuuguuucuauuauguaccuugucugcuuccacaaaaggauuugagauagauugggauaacaugcauguacaauaguaggacagcugaagauaaaguuaaaggguaaacagucaagugagguuaccucuucuaggaaccugagguaaaaugauuauuguauuuagauauuaaauuuagcucucagcuuuggcaguuaaaaccaaagggaaacauaaugaauuguuuguuuuaauuguuuguuuaauuaaagagaagcacauuacuuuuaaccuuaaaucauggcuauuuaaauacacauguauuaucucuguaaacuuuuuuguuuguuuuuagaggcagggucuugcucuguugcccagguggagcuuacuguaaccuccaccucuugggcucaagugauccuccugccucagucuccccaguagcuaggacucaguugugagccaccaugcccagcuaauuuuuaaauuuuuuuguagagaugggguuuuacuauguugcccaggcugaucuugaacuccuggacucaagcgauccuccugccuuggccuuccacagugcugggauuauaggcguaagccaucacgcccggcccuuauaaacuacuuuagaguagaaaccauauggauccacguuugucuccaucacaguuuuuagcacaagugaacaaaugguugaauaugauuuauuuuuaggaaaguaacuuguuuuggcacuagaaucuaagagaaaauuuggcuucuggaaucuuaugaacaaaauacugaguaauguaaguuauugacaacuauuucagccaaaguuuuacaaaagaagcaaaacaguucuuuguauagcccuugcuuuuguuaaacccacagaaacuacagggggcaacuaggaagugcagggugguaucuugaacaaaugagauucugagucgauggacccaaaucuagucccauaucugcuuugguuucugugacauuggggaagcuauauaaccuuacugaacuuuacagauuuccucauuuguaaaauagggcuaauaauaauuuucucaaaggcauuuugguuuguuuaaaugagguaauccagguacgcaacaguuucuuuugagagaaaauauuuuucuuuaaaaaauuuuuuuuuuacuuuaaguaccaggauacauguacagaauguguagguuuguuacauagguauacgugugccauggugguuuccugcaccuaucaaccugucaucuagguuuuaagccccacaugcauuagcuguuuguccugaugcucucucuccccuugccccugcccaguguguguuguuccccgcccuguguuuauguguucucguuauucaacucccacuuaugcaugagaacaugugguguuugguuuucuguguuccuguguuaguuuacugaggaugauggcuuccagcuucauccauguuccugcagaggacaugaucucauuccuuuuuguggcugcauaguauuccaugguguauauguaccacauuuucuuuauccagucuaucauuaauggacauuuggguugguuccaugucuuuuguauugugaauaguguugcaguaaacauaugugugccugcauguuuauaacacagugauuuauauuccguuggguauauaccgaguaauggaauugcugggucaaaugguauugcugguucuagauccuugaguaauugccacacugucuucaacaaugguugaacuaauuuacgcucccacuagcaauauaaaagcauuuguauuucuccauagccucgccagcauuuguuguuucuugacuuuuuaauaaucgccauucugacuggcaugagaugguaccucauugugguuuugauuugcauuucucugaugaucagugauguugagcuuauuuucauguuugucagccguguaaaugucgucuuuugauaagugucuguucauauucuuugcccacuuuuugaugggguuguuuguuuuuuucuuguaaauuuguuuaaguucuuuguaaauucuggauauuagaccuuugucagauggguagauugcaaaaauuuucucccauucuguagguugucuguucacucugaugauaguuucuuuugcucugcagaagcucuuuacuuuaauuagaucccauaugucacuuuuagcuuuuguugcaauugcuuuuggcgauuucaucauaaaaucuuugcccaugccuaugucuugaaugguaucaccuagauuuucuucuaggguuuuuaugguuuuguguuuuacauuuaagucuuuaauccaucuugaguuaauuuuuguaugaaguguaaagaagggguccaauuucgguuuucuguauauggcuagacaguuuucccagcaccauuuauuagauagggaauccuuuccccauugcuuguuuuugucagguuugucaaagaucagaugguuguagauguguggucuuauuucugaggucacuauucuguuccacuggucuauaugucuguuuugguaccaguaccaugcuguuuugguuacuguagccuuguaguauaguuugaaguuagguagcaugaugccuccagcuuuguucuuuuugcuuaggauugucuugguuaugugggcucuuuuuuuggcuucauaugaauuuuaaaguaguuuuuuucugagauaaaauaauuuucugaacuaagcaugggcuuuucaguuaggcugacuuuggauuuugcuguuugaucaugggcaaagcacuuaacaugucugcuaugguuugaaugugucccccaaaggucauguguuagaaauuugauccccaauauggagauguugggaggugggaucuuuaagauauguuugggucaugagggcucugcccucaugaauggauuaaugcaguuauugugggagcggguucaugacaacaggaaaaguuuaaccccaucuuaagugugcuuuagcaccugcacaguaugcagguuaauucucuuggcaagaaucuugcccuuaacugguuuguuuacaacaaugccaacagcgugcaggguaacauuguagacucuuccagguuugccaugguaacauuugugagguguuccuuuuugaacaguaccuauucccuugaugucugcaguaucaccuuucuuguagcuucacguguauguggccaaaagaacaacucuuuucuaaaaggccuggagaacauuaucagguuccucccuuacuagaaaaugagagugucccaccugaaaaacaacuaguauacuuuaauacacuuuaaagugacuacauaauauuucacagcuuagaugugucaugguuuaugucaucuuggcucuguugauggguacuuuguaagcuccacuuuuuuugagacggagucucgcucagucgcccagguugcaaugcagaggcacaaucucagcucacugcaaccuccaccucucagguucaagcaauucuccugccucagccuccugaguagcuggaauuacaggcacaugcgaccacaccugguuaauuuuuuguauuuuuaguagagaugggguuucaccauguuggucaggcugaucucgaacuccugaccuugugauccaccugccuuggcuucccaaagugcugggauuacaggcaucagccaccuugcccagccagcuccacuuuuuuuauuuggugaggaaaguugaaaucaugcauuuguacaauuguggauuuguuggaguuuuuuuuuuuuucuuuccgcuuagucaguuccuaauuuguacauuuugaagcccuauucuuaggaguauuaugauauuuuggugaauugaccccuuagucauuauuaaauguuucucuuuauuccugacaacgucauuuguucuaaaaucugcuuuuucuaauauuaauauaggcagccacucuugcuaucuuuucugccauuuuuuaguucuuuuauuuuuaacagauauaugucuaaaagguagguuuuguguggaaagcauguaggaggguucuuucccugauuucaaguaguuccuuccauccccacacaagagaauaguacuaagccagaaaauugaugaaaccaaucuucagcuuucuuuccccucccucucuuccccucccggcuuucucccucccuucccccuucccccucucccucucccuccuccuccccacuucucucucauuccucuucccucccgccuucaccuuucccgcuucguuuuggcagggucucccucuguugcccaggcuggagugugguggcgcgaucuuggcucagcgcaaccugcuggacucaagcaauccucccaccucagccccccgaguagcugggacuacaaguauguaccaccacauccagcuaauuuuugcauuuuuuguagagauggguuuugcccauguugcccaggcuggucucaaacucccgggcucaagcgauccacuugccucagcuuccuaaaguguugagguuacaggugugagccacgaugcugggccuagcuuucuauguggccaguuucucugguauuuuucucuggaaauugcagcgacuuugaccuguguacauucugugaucuguccuugacacucaauuacguagauggggucugguuugacuaccuccucccuuacaagguggccaggaaaccuucucaauguaagauucaacuuaccuauuuccuuucucuccaggaucacuauucugccaugucugugugucuaaaaguguuucaggcagaggcagggggaucucuugaggcuaggaguuugauaucagccuggauaacuuagugaaacuguagucucuccaaaaaaaaaaaaaaucguuggucaugguggugugcaaccguagucccagcuacuggagaggcugagaagggaggaucgcuugaacccaggaguuugaggcuacagugagcuaugaucuuaccacuguacuccagccuggaugacaaagccagacucugucucuaaaugaaugaaugaauacaguugugucuucuuauuguuuagaguugaaguauauguaguccuuguuacuccaucauaacugaaaguguaauuuugcuuucauucuuaaaugauauauuuggagcauauaaucucauuugaaagcuuuuuuuagcacuugcaauguguauuucuacuguguucuggcauuuauuauuuuuuaugaugucaguagucauuuuuuuucuauacguuaaugugucauuuuucucugccuucuuucaagauuauuucuguauuuaaacuuucuaguaguuugugaugugccugguuguacauuuuuuguauuuuuccugguuggagaucaaacuuuuauuuauuauuucuccagaguuuuuuuuuuuuuuuuuuugccuuguguucaagacuaaaacuuuuuucuugcuucauuuuuuccuucuggucauucuuguauuccuguaauacaugugguaauccguugcuguguccuacaguuuaugaugcucuguuuaaaacaaaaaaaaaaucgauuuucuguuugucggaucggauaauuuuuacugaucuauguucaugccuacuaacuuuuccuucugucauauccaaucugcuauuuagcccauucagugauuuuuaaaaauauuucagauacuauauuuucuacuucuaaauuuuccauugcuuuaaaaaaauaauuucuauuucucuggugugauuuccuaucuguuuaaucauugccagcauuuuuuuucaaauuaauaaguuuuauuuuugauauuuauguucaucguuuuaucacuuuuuaugaccgagguuuagugaauaguuuuaaguuuuuguuaaguaaauuaguaggcccuccuguacucuggcccuccuuucuguguuagugguguucacaucaguuuuuuaaaugaaugauuuggugcuccugguuucuccaguguauuuuuuguuacggcuucugcuuuuguuuguuuguuuucagacaaggucuuacucugucacccaggcuggagugcaguggcaugaucacacauccucgaccuccugggcucaggugauccucccaccucauccccucgaauagcugagauuacaggcgugcaccaccacacgcggcuaauuuuuguauuuuuaguacagaugggguuucaccauuguugcccaggcuggucuugaacuccugagcucaauugauccaccugccucggccucccaaaguguuaggaucacagacgugagccaccacucccggccuauuaaagcuucugaaacacagucuacuagauugccuucaccaacccuuucucacuucuagcuuuaauaggcaggagugcugcuucagcaaaaagaagggugagagcaaguuuagaaauggcaguguugaaugaggugaaaugagaauagguaauguguaacagaucauauugagugaugauuaugggcuggcagcaucucuaguaauccugagcugcuuucugguacuuacaucucauguccacaccagcagcaaaacuugucacuuuaagccuuugaaauauacuuagaaucagaaccugguuacuucuuacccaucuacucugccaucacuuuguuccaauucaccauuaucauaguuugaacuguuggaguggugucuagauuuuuguucuucauuuuuccaccaagcagcuagagagguccuuuuaacacauaaaucagacaaugucauuucuuugcacacagcucauucauuucauggcaaaaaaggcuauauaugauaugguucuuuaucuuucugaucuuaucuccuaauacuaucaccuaucaaugcucugcuucagccacauugacuucuuuuuaaaaaauuuuaaaaaauauuaauaacuuuauucuuuucuguuuuuacuggggcuggcauaauaaaauacaaccgcaauuuuuuuuuuuugagauggagucucacucuguugcccaggcuggaguguaguggugcgaccucagcucacugcaagcuccaccucccagguucacgccauuugccugccucagucucccgaguagcugggacuacaggcgcccacaaccacgccuggcuaacuuuuuguauuuuuaguagagacgggguuucaccguguuagccaggauggucucgaucuccugaccuugugaucugcccaccucggccucccacagugcugggauuacaggcaugagccaccacgccuggccauuuuuuuuuuaaaguuccaaguauauuccugucuuagagcuuuugcagguaucgugcccucuguuguguaugcuuuccaaccucaauauuuacauggcugucuuccucaauuuuuucaaucuugcucaaauaucaucagagagaauuccccucaccuguauaaaauaacaucuuugucuacccuuuucauuuucucucccccuuuucuuaauguuuuauaugcauauguauguauacacauguguguauauauguauuuaaugguuucacucuaccuguuaaagaagaacccuuuuuguuucauuucugcauccccagggccuagaaacaguacucaaauacuucuugaaugcaugacugaauaaacuggauaaauauuuguguuuauaagggaaaucagugggcauauagcagcauuaggacucuggagaaguguggaguaguuagguagggguguguucuggagagaauaaguuacuggaguggacauguucaugcuaaagauuauuugugggcagauuacuugggcagauaguaauacaugaagucagaagccuuucuggauuauugguuucucuuugaauccaccaaggacaguuuuuuuuucucuucauuugaccccaugauauaggauuagguuucuuucuuuuucuguuucuucuuccuguuuuuuuauuuauuuuuauuuuuuuauuuuuuggcuucagagugagcaagcuuucuuucacccuuucuuggcucucugguuuauugucauagccaguccuuuccugccagcuugauugucuucccucuaguggcuggcucucaucucccuggcuucuuuuuugucaggaaggguguuguguaugugcacuuuaucccugaaugcuaagagaggacuugucaaacugacaguuggugugacugcuggcugccacuugacacggagaaugacaucuaaaagucugcauuugcagccguggaccuucaagagacucauagaagaggcuguacuuuuucagugagaaauaaccacaucuaugaacauuuaguauuuauaauauuaaaauguauccuuucacuaaacuauauuuagcccucauacuguucauccuaucuuauauuacugaucuuuuucaugugauaaauaagauuauguagaaaacaccaagauuuuucaggaguaguguauaauaaugaacaagguuuauuucauuuguuucuugugugcauuacaucauucauuucccucccauuuugacaucugcaauggcucccugauaucuacuaaauauaacuauuuaaccagcaucuaaggcaauucauaauaugccccaaccuacuuuuuaaaaucuuauuucuuaguccccucacagauuuucucuacccuauuccacugguuucuaaacagguuuuuuuugaagccucuuaggcauucccuuggaaagguaggggucaagucaccagauuucuauccucaaccuuuaggcuuuaaucucuuuugcauauuuugguuucuuuaaaauagggcucuauaacuaaaagagguuugaaagucacuccauuugucuggucagaugauuagucucuaugucuuucagucugucucugccucuuucuccuguacacauacucccuagggccuuauacuuaaacauuuucuuguggcuuuacuuuucuguguaguuccuucugccaggaaugcuaaugucuccaguugaucauucauauagugaguuuugcugguuagcuggaacagugugacaguuuuaaacauuuuauuuuuauuucuaaagaauuuccaguaagcugggaauuaaguguuucgcaugaucaaaacguuuagggauuaauauauguuuuguuaccuuaugacauuguaugaacgauggagaaagacagauuuuuacaaauguuagaaauguaaagucuugaauugggucauaauuuuuucaaugaaggugugaaguuuaaguuuagugggagagagugauucagcauacauaugguuuuacuuguaggguuuuuugguuuguuuguuuugggguuuugguuuugguuuugguuuuuuaauaacauaagcuguauaugcagccaagauagauuacauuauacauauuauuuuucuuccaucuuuaucaucaaauacugaguucucucacagugcuuugauucacacuagagauuuuuuuuuauuuauaaugcagauaaguaguauguuuuguaaugauaguucucauuucuggauacuuuuaaagcuucaguuuucaugucuuaguaauaggauguuaauuaugugauauuauuuuaucuuuaacauuuuucacuguagaauauuaauauggaaauguugcucagcagucugcaaaggacuguugcuaguguaaaacauuaagucauuucgcuuagaaaaucuguggcuagggccgggcgcgguggcucacgccuguaaucacagcacuuugggaggccaaugugggcggaucacgaggucaggagaucgagaccauccuggcuaacacggugaaaccccaucucuacuaaaaauacaaaaaauuagccgaguguaguggcaggcgccuguagucccagcuacuugggaggcugaggcgacagaauggcaugaacccggaggcggagcuugcagugagccgagauggcgccacugcacuccagccugggugacagagcgagacuccgucucaaaaaaaaaaaaaaaaaaaaaaaaaaaaaaaaaaaaaaagaaaaucuuuggcaaaaucacuggggaugauuuuaccucccaggaucauuuugauaaugucuggagacauuuuugauuguuacaaccuaguggcagcuggggaggcggaggaggcacuacuggcauucaguggguagaggccagaguuguugcuaaacauccugccacuaaauaaauguuuuuguggcccaaaaugucaguaguaccaagauugagaaacccugagccaaucuucuaccauaccuaaaaaaaaaauuuuacuuagaaauauuuuaauuuguuuguacaggcauacugauuuagucagccauuauccuaaugauuccuuuaaaaaaauuuuuggagugggaaaauaaagacuuuuucuacuuuagaaaagagcagaucuuuaaaaaaaauugcuuuucuuaaggguguaauugugaaauagcuugcuuucuuuuucucuuucucuuucuuuucuuuuuaguuggcuaucugaaucauugagaugaacugaaaauuagaucuuagcaaauaauucugccaacaguggaacucuaaggcucugguaucagcuuaaggcagcccagccuuacuucagaguccccaucgaacagaucguucaccuuguuggaugaauugcuucucucucaggauuaauuaagaaaauguuaauacuuuucuuccucuucuugcuuccuugaccccuaaacacaguguuaacagcuucucuaccuguacaucaacaauauaucaguguauacaccuucugaauccuucuauaucuuucuccaugcuuguccaaagaacacaugcacaguaguuuuggggucauuguuuuuuuuacagacuucucugagacauaccuuuuucacuuuuacuauguaaguuucccugguugauagagggcuugacuuuuuaauagcuguaauuauauucuauagaauagacagaguggauguucggaauuuacugaacucuucgcuuagauauucaacuguuuucuguuuuuuaaaaccauuuuaaacaauauugcaaauacauguauacuuuucugcugaauuuuuauuuaccaauaaaauugguuuaguaauguuuaguaccaagaaggauuaaugaggauaaccacaaauuauuugagcuucaacuuuuuuugaaaguuguauuugaccaaaagguccuuccuccacacaauuuugaagauaauguaauuacugcucaaccugaccuggauaguguuauuuccuuguuuaaagggggcaagcaaauaguuuuagcuaaaaugacaauauaacagaaaaccuguaguuccacaggaugaauaaagacagacuuagaaauuauauugguaaauauguuauuuuaagaaauauuaguuaaaauuucaaaagcagaucauucaaggcagcaacagaacccuuguuaguugcuuuauugauacagggauccuaauacugucugaaaacuuuuaacaaggugucaaauucagaauaugcuuuuuauuguuaguaaugucuauuuaucugaugauucauacuuaguaaaugcauaaauauugaguaaauguuuuagauucauugaucugcaaggcagaugguauaagaauagccuggauacaugaauucuaauccuacuugugcuguuguugacuaguaccaauaugccaaguuuucaccuccugagagugccuuuccuuuccuuauuguaaaauugauuguuucuaaaguguuuugauuauaaaaauuucugauuuauuaucuugcacauuguuuuaaagaaauggaugauaaaaucauauacuuauuuaauauugcauauuuccauuucccuggcucagugcagaguaaaucaacaacauugaaaagcuaguugggaaucggagaugauagauagcuuuuucuaaguuuuuagguccuuaaccaauauuugguaugagauucgcucaaugguguguauguguguguguguguguguauuuguguguuagaauucaucagacaagaaaauuaauuucuauuuuagauauuuuacaaagaaucacuuauuccuaggauuguuccccaagacaucugaaaucuuaauuugcauaucuauguggcaaagcuuuaaauuuaaguuauccaguaguuuaacauaaaaucauacugaaacacucauuaacacauuugaguauacuauguaaguucagaauauaaauuacuuaguacugagccaugcugcauuaaguuaaucuuuauguuguuagauuauuuuuauguuaaggaaacauuaucccagauucgguuuuucuagauacauagaaagggacauacuggauguuuuuauuauguugaaugaagcugugcauugaagcuauuauacuuaagaaacauuuuuaugacaguuuagcuuuuucagcugcuuucauuauguuguguuuuuuagaagucuauucaggguauuuuuaaugucuuaacuaacaauaugauuuuugagcuauguuucugucguguuguuucucaucacuauauggauagaauuaguuauauaguaacaaugccucugugcuccuuuaccaccacaaaauacuuauuuuauuuuaauucuuauuuauuaguugaauuauuuauuacauuaauuuaauucuuauuuucuuugauguuuuaugaagcagaguuuauuuucauaauugugucucauaauucuguacaauaauuguuggaggaguauguuuagugaaaacaaauuaaagguggaagagauacuauucuuccucagcauugguaauaaugaagcucaauuucaagucauauacuuuuuuguuauuuggguauugaauaucaguuuuugugaaacuaauauugcaaccuauacaguugaagaaagagauauuucugauguaaucuuauaaaucaggguguaggaaaauaaaaacuuuauuuuguagauuaaagcucacccuauguuacauuaaauuuuaauaacauugauauucugcuugcuuuaugaaaccuuuuauuacaaacaguuaugaauaugaacaucucauuugacuacugaugaacagagggaaaaaucuaaauuaaaacuuuaaauaccacuauuuaauuacccaaauggcuuugacuguguuaaagagugucugggauuauucuguuuuucaauuuguuuuaaugcuuccuugguaaaagcugauggauucccaggcccauugcugucacugaugaacuauauaaagauaaaugacauuaugguaaauuccacuuaaugacacauuuuuaauuuucagaacacagacauuuucaggcuagugaaugaaggcuaauuaccucaagaucagaacaaaauaacuccucauuucgaaagauaauagaaaagaaauguugcagauuaaugaugcuauuuaucuuuaaaggaaaaaaauuuuaucuuuauccagauagcauagcucccuaaggagcgugguuauaaaaugaaucugaagucgcaacuuaauagguuauuaaaauugugagugcaggcucuccugcuuuagucuuuccauaaauuuaaauugaaggucugcuuuauucaaaaaggagcagcuuguuuaugaggccagugggagcagcacacguuacugacaaaagaugcacuuaacuucauucuaaugucuugcuucuuuauuucucugaaugacugucaccuauuugaaaaaguauuuugaaauuuuguuaccacucuuaauugauaccuaaguggaagggccauacuuagacuuguuuaagauuaaaauaaaaaugaaugcuguaaauaaaagcuguaaagccuuuacugcacacauauaaaucaauuuguaauugauuuaauuguguguguauauuuuuaaacauuuuaauuuuguuauauaagaggaaaauaucuuggccuaugagggguugauuuuguggucacaguuggaauuuauguaggaauuguucaauaaaucauuauucacaguuaaaggauuagcaauaauccuuuugcuacacucccacacaacuaacaaaguagugacucagagaauauuacuugaucauagaggcuuuaaacuguuccugacauccuaaacuccugucuuuugcuguagguaauagaacuguuauuucuuuacuaacgaggucauauagcauuuucuguaauuuucauucuugucucuuagaaaguacaugaauugccuguauaugguucauauuucugagccacagaaaaauguuugugagcaugaaaggaaauaguuguugcuugcaucugauagaaauuuuauuauauuauugugagacauuauuuuauuuauaccuuuccaauuuuauuugcucuaaaugguuagaaaacauauguuuaucuuggccauacgcgguggcucacgccuguaauccuagcacuuuaggaggccgaggugggcggaucacuugaggucaggugaucgagaccagccugaccaacauggugaaaccccaucucuacuaaaaauacaaaauuagcugggcaugguggcacacaccuguauucccagcuacuugggaggcugaggcaggagaauugcuugaaccugggaggcagagguugcagugagccaagaucacaccauugcacuccagcgugggcaacaagagagagacucugucucaaaaauaaauaaauaaauaaauaaaaaguguaucuuauagggagagcauuaucucauugcccauggcauaauguugacauaaaauuuucuauuaagacauuucuuagaacagccagaaaacggaagucuuuguaauuuuaauuguaguaugcauuugauuuuauguuaacuguuaugaaagccucuuauuuuuaaaauguucuuaaguaguuuugacucuguagauuaaggauaauuucuaauaauaauuauuaaauuugaaauaagauauucauauuuacucaaaacuguaggaaaauacuauaaaaugcacuuuauccucuaucucacuuuucuuuuuauuuaaaauuucaauaauauuccuacaaggcucccuuuauucuuuauuugcuacagguguaucuaucuuacagugacuuaaggagagaagcugaugagaauucugaagguuauguuuuauaguuagaauccuucagugaaaacacagaugaauauuuuuucuuaauacuaaaauaauguguuuauauaauuaccuuauuucuaauucuuaacaguauccgugaaaauaaaaagaaauguuucaugcauaugagagaaauuucagcaauuauuuguaucuucuaaauucauuuuuaaauguggcaagcacugugucuauaagccuauauguuauuucacaauaauuuuuggaaauuuucuguuuuagucuaugugagucauguaaaaauuauaaaaacuuuuaggaacucaagcagccuucaaucagugaaagaacuguuuagcaugauaauacaaaaauaaaaccuauaguauuuuggcaccuuauaaagcuccccuuucgccucaaauuugauuaaaguggauacuuagaauguaugcaguacauguuuuccacaugguuauuauccuucagcugaaaaaaaauccgugugauuauuguuagaauaauauacacuaaaauguucuagagcauuaauaauauuguguccaugcucuugucuaauuuuucccaauuauugcuauuuuaaauuuccaacaguaucuuguacuuaaucuucauaugugaggaugaguuuauucuaaagacauuuacacacaacuuagagaaaaugucagagauugucaggguuauauuuuagagucagagguaauccuacucuggauaugaagauaaaucauuuuuuaaaaugugccaguuuucucuucaguaaugaugaucuugaaugaauauucuguuuggaaauucucugcuuauggccuaucaguaguuauuccucuggauauauacuuuggaaauucuauuuuaaagcaugucauuaauucuuuagacuuaaucaucuucuaguucuuuuugcuggacucugauauuaaaauuuagcaguagccuaugaaaaaucguauggaaaagagacaaauuuagggccauuaaauuccuaauuaugguuucauaacaaggaucacgagcuauuuacuguuuaccuccgugacaguucuggaauuuuguuuugauugucaaguagcagauagaucuaaguauaaagauucuugaaagggcaaaaaaaaaaucuuuguggauucaaauccucaaauccaacuacaauuaaauaauaaggccuuaucagaaguuaugaagcauaauaaagugcuuugucuuuccacuugauuccuuacugacuccccaaguuaacuauuauggguucaugguuaaggcacacaaucaggagugaaguucuaaguuuuaauuuuagcacuggcucaaguuuucauaauguauauaaauucauuccccccuguguuuauuuucuuaccuguaaaacuuagggguuuaaaugcauucaaauuguguccugggccaggcgugguggcucacgccuguaaucccccagugcuuugggaggccaaggcugacagauaacuugaggucaggaguucgagaccagcuuggccaacauggugaaacccugucucuacuaaaaauacaaaaauuagcugggcgugguggcgcgcacuuguagucccagcuacucaggaggcugaagcaggagaaucgcuugaaccugggagauagagguugcagugagccgagauugcgccacugcacuccagccugggugacggagcgagacuccuccaaaaauaaaaauaaaacgaauuguauccugcagagcuuuagagaugggaaagaagguguuagagaggggaacgucuagugggcagcucuguaacucugcagucuuuuuucuccuucccugcuuaacuagagcaacauuuuuuuuuuuuuuuuuuuuugagauugggauucucacuugagccagagaggcggagguugcagugagccaagauugcaccacugugcuccagccuggugacagagcaagauuccauccccccuaaaaaagaaaaaagauugggauucugcuuaagguuugagaaaaauguucuuuaaaaaugaaaacuaaaaacaaacagaaaacaaaaguuuuaaaaccacuuccagaaugggccaggaauugucaaacucuggcccacaggccacaucuggcccaaugcccaauuuuuuguaaugaauguuucuuuggacaaagccacgcucauucauguacauauuguccauuaugcagcagaguuaguaguugugacagagacuauaugacaagcagaggucaaaauauuuaucuagcacuuugccaaaaaaguuugcuaacuccugcacuagguacucgcucacuaauuuuauaccugaaaauuaauuccuugagauggcuuaacuucugcuauaugcacuucuccuucuuagacugcacacuaauucauggcuaauucuuuuuguuuuaaugcauuauuaaggauuaaucuucagggauuauguuuaaccauuuagccucuguauuuccuggcacucuuuuaagaauuauuuugugcuuauuauuuuuccuaagggauauaaaaauaaauauugaauaggaaaugguucauagcccauagccaguuggauugguaaaauuaaugcaucugaaaugauuauaggacauuuuaagauauaaugugguauauuuagaaucaugugaguccaaaaguuuaaauuguguaagucuaaaaguaaguuuaggaggaguucagagaaaaucaguguggcuggaauagucuauuuagcuuuucuuauuuuauuuuuugaugaaauguaacuugaacuggucucugaagacuaggcagaauuugaauagauaucaaggacgucaggacauuccuugggugaggaagguuuagugaaggguggugaagguuauugaguccaugggagaagugaaaaugaggugugguauuaauaaggaaagaaaggguugauuaccagaugaaagaguuugauguggaaaauacuuguaaaucacuuuauguuucugaguaaggaaguaaugaaacauacguacaaguaaucaguaagacuuguuagacagcuguuguucaguacuaugcucaguguuugagaagcuauguaggauauauauugugaucauguguuuucagggaucuuauauucugauuagacuguuaagauugguggucagucaaaauggaagggcaucggccaggcgugguggcucaugccuguaaucccagcacuuugggaggccgaggcgggcagauuacuugaggucaggaguucuagaccagccuggccaacauggugaaaccccaucucuaccaaaaauauaaaaaauuagccagguaugguggugcaugucuguaaucccagcuacuugggaggcugaggcaggagaauaaccugaacccgggaggcgaaaguugcagugagcugagaucgugccacugcgcuucagccugggugacagaauaagacuccgucucaaaaaguaaaaaggaagggcaucacaugauauugccaaaugugagugauugauagauaguacugugggaguuugaaagagcgagaaauuacugagagcuguuggaaucaugaaaaauuucuuguagggcuagcauuuuugcugggccuugagggauaaggaagacucgugaagguauaguuuauauaagcagacagaaggguauugugggcagggauaaugaagugagcaaagguauggagauaaaacauuguuuuauaugaagaacaaugaggagagaagucugauuuguucaaaauugauugaaagauacagugauaaagcucaaaaguaaggaauucugggggcaauuuugugaagaccgaaugcaaguuggcuaagugggauuucuuuguucucuugaacuuuuccaaaauuuuuuccccacacaaguaguagaguugucucuucaagcagaauguugcuaaauaaccuccauguguaaaagagacaaacgcggcguugccuuaaucaacuuggguugaagaauguggagcuuaccagguuccaccaguguagccacagaggcacaucaguagcacccuuauugcccugaggaacaguuugaagaauuuugcacuaagccuuaagaagcuguuaaaaguuuuagggcaggccuagagaaauacugguaacaugauuaauccacugguaugcaggauagagugggaggaaacaugggauaagaaaacgauuauaguauuagagauuuaaggaccugaguaaggaugguguuaguaagaauagaaaaggagaaagaagaauggccuuucaaagggaaagauccauaauguagcagcuauuauaaaugacaucaccaugguuaaauauuugaauaaacaauggcuauggauaaucauguagaacacuggaaauagagaaaauauuaauagcaaagaauauuuaaggcaaggauaguauguagagacaaaguguggaacauuuuaaggcaggaauagucaauauugaauuccacagagacuauggaaucuaauuuugauuugaggcauugguuggugagugcacaguuucuaaauauacaauaauaugguuucucugaauugagcaugauaguaacuagauuaagaugaguaagauuugaauagagaaaguaaacucaagaaaaagucaaagaaaaaaaugauggcucuguugauuaaauacagggaaugaaugggaggaacaugaaauacgaguacuaaaaaugaucuuaguggauuuuuuaaaaaguuuuuuuuuguaaacuaaagguauggaaacuaguggaguauguaaaugugaaaccaguaguuauucauuuacucaaauauguuguguuugcucuguguaaggcauugugcuagguucuauaaaagauucauaaagauucauuuucaauagcaaaaaaaacagaaccuuggaauaaacuuaacaggaaauguguggaguuuaugaaaaauacuauaaaaaugaacagagggauaguaagggagaguugaucagauggaagagcauacauuuuaaguggaugaagagacauuauugagaugccagcuuuccacaaaauaaucgauaaccuugggggauuguuuuauggcuugacauaaugaucuuaauauuugucugaaaaauuacugggagauuggcauagaaaauuaaaaaaaaaaacaaauggugacguguccugccagauauuaaauuugaugauaagcuuauaacaguuaagauaacauagaacaggccaagggauaaacagaccagaauaacagaguguguguguguguguguguguguguguguguguguguguguguguguguuuucaaguauaaagaagaguguaguacauuauacaggugagauuuuuaauuuggggaaaggauggauuaguuaguaagugauauuggagaaaaguuacauuucugcuccauacuauacaucaaaauaaauucuagauaauuuaaaauuugcuauuaauauuaaaugaaacuauaaaguacuagaaggaaaugugagugaauuauuuuauauuucaagaggacuuccuaaguaugacauaaaaaguuagaaacuauaguuaccaauaugacaagaauguucaagaaacugguaggacuuaacuacaucugcaugaacaccuuuugaaugugaacaaucauuaaaaacaaaauugagaggaaacagcaaaaaacccacaaacuaugugauuaauaaaagggcuuuuagucuaauuguauaaaguacccuuaaucuaauuacauaaaauagucuaagaaaccaguaaagaaacgcucuaguggggaaugugggccaagcauaagaauuagugguuccuagaagaaggaacauaaggaaaauguuuaccaucacuacuaauaaaaaucuaagugccauuuaaaucuguuaagauggcagaucaugauaaaaugagcauucguauacauauauauauguguguauguauguauguauauggcuaugaguuuuagugacuuucuugcugaaaggcaauugggccauaguuaccaaaagucuuaaauguggcuacugugggcacacugccuaugagguagcccugcuacgcaaggaacaguuuaaaaaaaaaagucuuaaauguaauagauacuuguauuugaauguuuacaguaggauuauucacaauauccaaaagguggaaacaacccgugucuauuaaaagaugcauagaaaaccauaaugugguaucuacauacaacugaauguuacucagccauuaaauguaaugaaaaucuaauacaugguacaacauggaugaaccuugaaaacuuuguguuaagugcaguaagccugacauaaagggacaaauuuuguaugagcucacauaaaugaaauaucuugaauaggcagauuaauagguaaagaaauauaugaaagguuacuggggguugggugggagaaagaaguugggggagguuacuuaaaggguaguuucuccuugguggugauaaaaguguuuugaaaauaguaacaaugguugcacaacauugugaguauaauuaaugauacugaguuguacauuuuaaaacgguuaagaugacaaaucuuacguuuuauauauuuuaccacaguaaaagagaaaaaugacaaaaaauaaugucacguuucacuuacaggaauuuguucuaaggaauaauagaguguauguaaggucuuuacuacagaguuggaaacaacccagauguuuaauaguaaugaauuguuugcugugguauagucuauaaccauugacagugacugaacaaauauuuaauagaauauuaugauuuaacaagugaaaauauagguaguaaaacagcaugcacccauuuuucauuuaaaaaaauuuaugccuaaaaaagacaauguucuauuaaaaauugaaguggucuucuuugggugauaggauuacagagguuuaucaaaugcuuguuuauacccugaaaauguaaaacuuagguucugguucuuuuuuauuuuuauucuuuuaagguaaaaggagauuuuugucuuuaaauauuaauaaaggggucacaaacaguauauuaauuuuuuaaaaggaaaaaacuuuuuauaauugauuauaccgcuugcgagaguuugagauacucuuaagaauucagguuaaacuuacaaaaucauuuuuaauacagagaucaaugaaaaauuauccaaagacauuagcuccauguacugguaauuguuaccaaaagccuuaaaguguacaauuuuuuaaaaucaguguggcaacuaucccaggaauuggaagucuguguuucuuccccuaagauucaggucauguguguauauguguguauuuuaauuuuuaaagaacauaggaguaauguagacuccuacuucuagccaugacagagucccagggacugaauuuacacuccugcuucaaacuagaaaagcagucuacaaaauaaaauaauuguuuauagacauuggauaauaaccaguauaggacacuaaucuuagaagggaaauaaagugacuucuguagcucuucccaccuuauugccuagagacaguuuugguacagggaaggcagacauacugagaucuugggcagguggcaucacacuacauugaagagauagauuuugaaguacaaggaggccaaggugucuagaauuuguggauaaaauuacuagagaguagugagaugcaucaggacagaagugaugagauccacaaaucuccacaaaacucaaugaaccucuugagagucugagcgaauacucaucugugcaugugugacaagaaauuacccaaggcugaagaaagaauaacuggaaaggagcagguguagcgauccguggagcucaugcgaaacauuuacaccuauacauuucucucuuagcagggcuuucacugcauuccauguuuuggcaguaaagcugaagaacauuuaagccagaccaaucaggaauucagagaaagaauaauucauuuuaucccuggauuauuauugaauuauuuuauuccuauugugaauaauucuauaaacauucaaguacagaauugaagaccaaucaggaauaaaaugaaagaagacauaaauuaccaucauuaguaaugcaaggaggaacaucacacagauccuaaauuuuauggaaaaucaauaaauucaauaacuuagaugaaauggacaaauuccuugaaaguuaaaauuaagaagaaauagauaaccuaaauggucuuauuaaagaaggugaauuguuagauuaaaaucuuccaguagagaaacauccaaguccagauagcauuaguaguauauuauaucacacuuuaaagaaggaauaauaccaauucuuuacaaacucuuccagaauauauaagguaacacuuccaaacuaauuuuauaagauuuguauuacuauuacacaaaacccaggcaagauacuaccagaaagcuacagaucuagauccuucaugaauauagacacaaaaaauuauuaacaaaauauuaggaaaugaauuauguaauauauuaaaagauuaauaugucaugaucaagugaaguucauucuaggaagaaagguugguuuaacgugaaaauuaagcaacauuauuuacuguauuaacagacuaacaggaaaaaaauguuuuccucaauagaugcagauaaagcauuuuacaaaguuuaucaccuguucaugauagauuaaaacaauaaacaaaagucuugcaaacuaggaguacaaggggcacuuucuuaauccaauucaaggaccuuuuaaaaaaccugcaacuagugacugaaugcucucacuuuaaaacugggaagaagacaagacagucccuucucagauacauuucuacauuguacuggaagucaauugucuggaagucauuguacugccagugcaauaaggcaauaaaaagaagcugaaggcagacgaaauggaaagaaaaauauuaaaucaucuuuaguugcaguugacauaaaaaucuaguuagaaaauuggagagaaucucaaauaagcuacuggcacuaauaaguuuagcaaaauuuuuuguaagaaacaaggucaguauucaacaacuaauuauauuucuguauacuagcaacaaacaauuggaacuugaauuuuuaaauaugccauuuucacaguaucaaaaaaugugaaauauuaauaguaaucauagcaaaaauguauaacacuuuugcagugaacacuauaaggcaaugcagagaaaaagaaucuaaauaaauggagaguuauaucauguucauggaugagacuuuauauuuuuaagguugcaauuuuuuccagauguaucuauuuauucagugcaauaucagucaaaauuccagcaggcuuuaaaaaaaacuuaaguugaauuuucuaaauugauuauaaaauguauuugcaaaugcaaaaggaucuagaauacaaugauuaaaaccgcaggauaguauugugaagauuaguauguagauguaugggacagaaaagaaucuaguagauuuacauaaagauaccaaacauuucaguugggaaaggacaagcuuuucagcaaauuggugcuggaccagucuauagccauaugccaaaaaugaaccauaucucuuccaucacacaacauacaguaauuaacuugggacauacuacagauuuaaauguaagaauuauaugaaaauucuaaaagaaaacaggauauuggcuaggcacgguggcucaugccuguaaucccagcacuuugagacaccgaggcggguggaucacgagcucaggagaucgagaccauucuggcuaacaaggugaaacccugucucuacuaaaaauccaaaaauuagcugggcuuggguggugggcgccuguagucccagcuacucaugaggcugaggcaggagaauggcgugaaccugggggcggagcuugcagugagccgagauugcggcacugcacuccagccugggcgacagagcgagacuccgucucaaaaaaaaaaaaaaaaaaccaggauaucugaauaccuuggguuauauauuuuaauauuugauacaaaaggcacaagcuauaaaaagaaaaauauaaaauuuggacuuaaucaaaauuuaaaauauguagacuucaaaggauacuuuaauaagcugaaaaugcaagccacagaccuggaaaaaauauuugcgaaggauuuaugucuagaauaugcaaagaacucuuacaacucaauaauaaugagaugaacaauccaaguaaacaugggcaaaagauuuauagauauacuaaaggagauauacaaauggcaaauauaagcuaaugaaaagaucaaaaucauuaguuauuaggaaaaugaaacuuaaaaccacaaugagauacugcucuuguccacuagaauaggucauaauugaaaagaucaaccauuucaaauauauggagaaugucaaguaacaagaacuuguauacauugauagucauaaugaagaauuacacagacuggaagagucuuuucuaaauauauaccuuaccauccaacccaggaguuccauucccagguauuuacccaagagaacugaaaacauguccacaaagugacuugaaccuguauauuccuacuagcuguauuuauaauugcauaaaaacuugaaauaaccugaauguucgucaccuaguaaacugauaagcaaauguugauuuaucaauuuaaaggaacaaauuacugaugcauuccacaacauggaggagucucuaauuccuuuuucuuucuuuuucucuuuucuuuucuuuuuuuugagacagucuugcucuguugcccaggcugagugcaguggggcacgacacagcucacucugccucccagguucaagagauucuugugccucagccuccugaguaucugggauuacuggugcacaccaccacacccagcuaaauuuuuggaauuuuaguagagacaggguuuugccauguuagccaagcuagucucaaauuccuggccucaagugauccaccugcgucggacucucaaagugcugggauuacaggcaugaaccacagugcccggccucuaauucuuuauacuaaguuauugaagucagauacaguggacuauguacuguauuaaucuuuuccuaugacuauucuauaaacgacaaaacuaaugacaaaucagaucagugguuaccagguuuaaauggaagaaauuuuauuaugaaaaagcaugaaggaacccuuuggaggcaugaaaauguucuguaccuuaauuguguagauauuacauuauaaauuacuuuaugcauuugauuuuucaaaauuuauuguaaaguucuguaaauuauaaaggugauuuuauuuauuuauuuuuuuuuuugagacagggucucacucugucaccuaggcuggagugcaguggcacagucguggcuaacugcagccucgaacuccuaggcucaaguaguucucccaccucagccuccugaggcaagcaacaccaugccuagcuaauuuauuuuuauucuuguuuuuaucuguagagacagcauuucaguuuugcccagacuggucuuaaacucaagugauccuccugccaugccuucccaaagugcugugauuacuggugugagccccuguuucuggccugauuuuuaaaaucugaugagaaaauauauugauauaagaaaauaugaauuuuuauaugaauauaaacaugaaugcuuauaugaauauauucauauaagaaaauauauuucugcauacuucuacccaaucacgauaguucaauuauaauaugugaaaaagagggaacuuuuuuuuuuuuuuuuuugagacagagucucacucugucgccugggcuaaagugcaguggcgcaaucucagcucacugcaaccucugccucccagguucaagcaguucuccugccucagccucucgaguagcugggacuauaggcgccugccaccaugcccggcuaauuuuuuguauuuuaguagagaaaggguuucaccguguugccaggcuggucucgaacuccugagcucaagcaaucugcccuccuuggccucccaaaguguuaggauuacaggugugagccaucgcgcccagcauguauuuuaauauauuacauugauaauuuaauauuacauugauuaauggcucacagcuucuuuguauaaauggcucaaaaagccaacaacaggggaguaguuaauucagguacauucaaacaauaaaaugcuauauaagaauuaaacaucaacauuuuucuaugaauaaaaugggcaacuuuuuacaguauagucauaugucacuuacugacagggauacauuccaagaaauguguaguuaggugauuuuaucauugugugaacaucauggaguauacuuaaaucuagauggcauagccucaugcacaccuaggccauaugauauccuauugcuccuaggguaugaacuuguacggcauguuauuguacuaaauacuguaggaacuuguaacacagugguaaauauuuguguaucuaaacauagaaaaagugcaguaaaaaauauggcauaaaagauaaaagugguauacuuguauagagcacuuacuaugaauggagcuuuuagaaccagaaguugcucuggucaggcagugaguaaguguugaguaaaugugaaaauuuacauuacuguaaauuuuauaagcacuguacacuuaggcuacacuaaauuuauuaacuuuuuucuuuaauaauagauuaaacuaugccaguuacaacauuuguaucaacuuuuuacuuuuuaaacuuuuugauuccuauaauacucagcauaaaauacacuuuguguagcuaugcaaaaauaauuuguuuguauccuuauucuauaagcuuuuuucuaaagauuuuuaauuuaguuguuuguuugcuuuuuaaacauuuuuguuaaaaccucauacacagaagcacacauuagccuaggccuaauaggaucaggaucguuaauaucgcugucuuccaccuccaaaucuuguccucuggaaggucuucagggacaaaaacacacacagaacagucaucuccugugguaaaaaugacuucuggaauuccucugagggaccuguuuuacuguuaacuuuuuuaaaaaguaaguagaaggaguacacauuaaaauaacaauaaaaaguauaguaaauaaauaaaccagaaacagucguuuauuaucaaguauuauguacugugcauaauuguauugcuagacuuuuaaugacuggcagugcgguagguuuguuuacacaaacaugaccccaaaccugugaguaaugcauuguuaaaacauaacagugacuacaccaucacuaggugauaggaauuuuaugggacagcugccauauacuuguuuuguuauugacauggugugugaucauauauugaauugggaagaaaggacauaacagcaagaucucacuuuuguugggaaaaaaugugggauggggcauuauuuuaugaauguauauauagaaaagauauuaaauaucaaguguuuauuggaguuagguugguagcagcuuuucuuuuuuuaaaauaauaaaauauauuuugaauuuucuacucaauauuuuuucucuccauuggaauauaagcaccaugagaauaggaauuuuuguuucuccucuguugcgauauugcagauccuagaacaguauuccauaaauauguguauaaugaauuaauuuuuuuaucuagcuggaccucagacuagauuuuuuuucauugauuuguuuuuguuuuaauuacauaguugugauuacuggaacuuuaugguucuaugugguggaauaaguucucuuuguuagucauauuuaaauuacucuagacuuuuuuuuacaccacuuacaaacguccuuuuggguuuuuuuguuuuguuuguuuguuugguuuuugagacagccucacuaggacacccgggcuggauugcaguggugugaucucucucggcucacugcaaucauuugaaucucuccaggguucaagcaauucuccugcgucagccuccccagcaguugggacuacagggugugcaccaccauaccccacuaauuuuuucuauuuuuaguagagacaggguuuugccauguuggccaggcuggucuugaacuccugaccucaagugauccacccgccucagccucccaaaguauugagauuacaggcaugagccaccgcgccuggccauaaacgucuuuggggcuuuaauuggaauugcacuaguuacguauauuaauuuggcaucuuucaauuagaaguuuaagacauuagaaugaauuauuuagauauuccauaucuuucaguaaacuucauggcuuuuuaaauaucagcuggcguauuacuuauuaaauauauuucuagauguuuuaauuuuguugguguugcuaucgagaucugauauacuuuguguuuuauauuuguuccugguuaauagguaagcuguuguuuuguauauuuuuuuauuaagccaccuuccugaaaauuauacauaguauuuaaaaaauuuauaacucaacauuaaguugauuaaugaaaaccaaaccuuuauaccuuaaacgauacauaauuuugugguagaggaaguggcuguuuuucuccauuuuuuuucacccuaauuguugaaagcuuccuaucacaauggucaaguauuuaucauuuaaaacugagcagacucucaauacuuugggggcacauuucaccuaccccaaggcauuaggcagaaaugcugaggaagcuggaagacuuaguacucuguucuuuggucagcaagugauaguugaccuauaauuaauuaauagaagaaggaaguacucucaguguuuugggucuuuuaucaaacagguauguuauucuuaggaucuuuucacuguuacucccuuucugcuauucuaaaauauaauccuggagucucuucuuuuuguugcugguugucacauuucugcaaacagcaauguauuguguuaauaguuauuucauuacagacauuucugcguuuugguuuacauguguucuugccuuauuuuucuuaaauuauuuaaaggagaggaguauguuuugugcagaauuguguugaucagacguguacuaagcaguuacuguguacagugcagcagugaaagggaaugauaauacugagcacuuaugugccaguucugaacaguaucgaugcggaaaccaagaaucugaaagaauaggugucuugucaaaauuuaggaagcuauggaauguccauuugauucuaaauucuauagucuuaagcccuggcuacacauuagaaucaucuggaauauuuaacaaaucucauaguuuuauuguacucccccucacccucaccuuucaucuagccaggaaauugauuucuacagauagggccuaagcaucugggugugugggagagacauauaauuuuuuaaagcuguuacaugauucuaauuugcugccuuggugaagaacaggagucagcaaacuaugccccauaggccaaauccaaccaaucuccuguuuuuguacugccuuggagcuaagaagggcuuuaacuuuuuuaaaugacugggaaaaaaaucaugacaugaaaauucuaugaaauucaaauuucacugucuguaaaucaaguuucguugcaaccaaagccuuugguaaauuuuuguugacaugucaagaaauaauuguugagcaacuuuuucaucacauacacauaaagagauaaagaaauauuugggcucagucccuucaaauugcaaaucauuucuucccuuucuguuuguucuuucgaugaaaguguaaauauauuuuuuuauaacucuuaauauuggagaggagaaauugcuaggccuaauucaguaaucauuugaacauguaagguccuagggguuugugucuucguguuuuauauugaccaauauuaauucacaugagacaguauucccagguuggugguguuggcuuaaggguuuaaaguaacaucgccauucuauuucauuuccaaaucaaauguuaauggauuccuauagguaagguaucccaaggaaauacuuauuuucaaaguacagaugcuccuuaacuuacagugagguuauauuucuaaaagcccauugcauguagaaaauauuuuaagucaaaaauuuauuuaauaagccauacccaccagacauuauagcuuagccuagcauaucuuaagcuuguucuuguuuuuauuuguauuauuuuauuuuagucuuaacuuguaaggauaggaauuaaaauaauaccaaaugcugucauuuuccucagcaaauuuuaggcauaugaccugggaaauugugaacuacuuucucuuuuggcuuuuggacuuccuguuggguuuuggguauaauaugcuuauaaagauagauuuuuauuaauugugauuggacuucuuacugagagcacuuucugaaaauguuaauuuucuuaauugcauaccaguguuaaauaaugagaucacaacuauuuuugaacaauuagagguuauguucucuuuaagaacugauucuguagucucuauccauaaaucuuuccucaccuuguuuagugguaaggucaaguaaccauuaaguagacugaaauauccccagaucaggcauucauucaccaucuuuuaguauugcaguggagccacagaauuacuaggaauggcagagaauggcacuacaugaaggaaugacaggagacugacagggucaagagaaaaugauggaggguuuuagaaacccaaaccaaaggaaagaaagaaaaaagaagguaaggaaguggggauuagaggguguuuuuuggugguuguuuuuguuuuguuuugagacggagucuuacugugucucccaggcuggagugcaguggcacgaucucggcucacugcaacuuacaccucaugggaucaagcgauucuccugccgcagccuccugaguagcugggacuacaggcgccugccaccacgcccggcuaauauuuguauuuuuaguagagacaggguuucacuauguuggccaggguuucacuauguuggccaggcuugaacuccugaccucaggugauccacccgccuuggccucccagagugcuagaauuacaggcaucagccaccacgcccggccaggauagggauuuauugacucacuuaggcauuuaucuguucucagcauagcuggaucauucuagaucuauucuagagguccaagcauuaacacuagcucauccuguuucucagaucuauuguucucugugcugacuggcuucauucguaggccuucuguaguaagaggaaaauggcuuuggguacuuuugacuuccauguccuuaacaccuaugucucagacagagauaguaucuuuuuugauaauucugguuaaagcacaagaaguucuuucauugguucagcuuggauuauuccugguccaaucaguggggucugauguuuggauuggaugggugugaaugguguacccaccucccuaauggggaugcagugaaguauagggugguuaaccaucccuuaucaccauccauacccuauggauagauuuucugauaagaaacacagaagaaaggaaaugaugcuaaagagaguaaauaguuaacuguuaaaagaccaaaaccuaguacuugugucaucuaauagagaauccuauguacauuguacacuuccuuuuuuuuagaaaaauuaaaauaauuuuaaauagucuuugugaaagcuucaaagauucuuccaggccuuauguguuuguccuuucagcuuuucauuauaacuuuaugaaaauauuuuagccacucuuuuaacaauuuauugaaugucugcuaugucguuuuaccugcagugucauuuaaucuuuucucaaguugauaauuuaaaaaauaacuuucuaaguuuuauuuuuauuugauuauguacaauauauucaauucauauuugugggguacaguaugauguuucaauacauguauacacuguauaaugaucaaaucaggguaguaguguauccaucaccucaaacauuuaucauuucuuucuggcaaguacauucaaaauguuacauucaaaauccucuuuucugguuauugugaaaaauauacaauguaguauuauuguuaauuguaaucacuguacuuguacugugcaacagaaaacuagaacuuauuccuccuauccaucuguucuuuuauaccuauugacuaaccucucuccauccagucuuuggccagucucugguaaccacuauucuacccuguacaucugugagagcugcuuuuuuaaacuccguauaugggagaaaucaugugguauuugucuuacugugucuggcuuauuucauuuaauauaauguccuccaggcuuauccauguagccaaaaaggacaggauuuuauucuuucuuuucuuuccuuucuuuccuuccuuuccuuccuuccuuucuuuccuuccuuccuucuuuuucucccuuccccucuccccucccuuccccuccccccuccccuccccuccccuccccucccuucccuucccuucccuucccuucccuguccuuuuuuucuuuucuuucaagacaagucucacucugucgccaggcuggagugcagugacacaauauuggcucauugcaaccuccgacucccuguucaggcaauucuccugccucagccucccgagcagcugggauuacaggcacacaccaccaugcccagcuaauuuuuguguuuuuaguagagacaggguuuuaccauguuggccaggauggucuccaucuccugaccucgugauccacccaccuuggccucccaaagugcugggauuacaggugugagccaccgcaccuggcccuuauucuuuuuuuaauggcugaauaguauucauuguguaucuauaucacauuuucuuugucuguuccucuguuggugggcagauagauugauucuauaucuuggcuaaugugaguagugcuacaauaaacagugcagauaucucugacauacugauuucauugucuuuggauaaauaacucaaugggauugcuggaucauaugguagcucuacuucuaguuuuuugaggaaccuccacacuguuuuccauaauggcuguacuaauuuacauucucaucagcauuguauaaggguucccauuucuccacaucuaugccagcauuuguuuuuugucaugauacuggccauucuuauaggugugagaugauacauuauugugggaagauaacuuuauuguauagaacuagauuucuagacaauuuauggaaacugaugaagaccauguuauauuuuaaaauauauuuuaaccaaggcucacaggguauuucucuaccuuuuuuuuuuuuaucugaagugcuaucagauuuuuuuuuugcucuguugcccaggcuggagugcaguggcgcugucucggcucacugcaagcuccgccuccugcguucacgccauucuccugccucagccucccgaguagcugggacuacaggcgcccgccaccacgcccggcuaauuuuuuuuuguauuuuuagcagagacaggguuucaccguguuagccaggaugaucucgaucuucugaccucgugauccgcccgucucagccucccaaagugcugggauugcaggcgugagccacugcacccggccagugcucucagauuuuuaauuccuaugcauagcauacaguaaaccucaucuggaagucccauacacggcacagugcaggcugcucaauuuuucugccuuggaaggaugaaaagcuaaguugaaaaaucauuuuaucaguuucacuccaguuguuacauuuuggcuuuagaaauauccuucaucuccugcaucucauaaucuccugccuuugagguugugucauagauauuauaucacccaagugcuuucaauuugaacuucuucaagaggggugccuaugucucagaaguuucccguagguccuauuuuacaguuauuauuucaguuccuucuacgcuagcuuguugaagaaaguucucuaaccaaaggcaauucuaauugccuuugaaaccaguacuagucaagcuguacaguaguuuuaugaagacugagcacucaaccuggaguuccuuaaaaagaagacacaacaggaaggcccaagauacccuuuugcccuucaaaaugaacugccagugccccugcuuucaugccuugagugaacauauuccauuagaacaagacuguacuuuugguuuuacuuaagaauaacucucugagaaauguguuguuuagcaauauuccuuucaaauucacaagcgcuaauugaaauuacucucuaugcuaucuuucuagcaagacuuaagguuucaugaauagauagugauccucuucucauguuucaggguucugucuucauacucuguucuccuuccuuuccuccaugucuuuccccuugacuguaucacuuaaaaagcuauucuuuaaaauuagugauauugcuucuaauuuauauauuucaucuccuuaaccguacuguaaaccucucugagucaggaaguauaugucuuguauuuauuuuguauuuucacacaauggucacuuaguucaaauaauucauaaauuuuuggcaucuagguuagaauggcacaaaauaaggcauaguucuugucuucaaagugcuuuuaaccuuuagaagagaugugacaugcaaguuuaauaugcaagaguuauuaaagagagcacaaucaguuucuccucaggaaaacaguggggacagaugguauuaagagccaugccuuaguagcacuggauuauugggauauuuuaauguguguauuugcuggaucacagcauuauaaaggagacauuuaaagaaaacacuaaugaucguaaucccuucuauguauaauucuugguggugggcaaaacucauucccguuguuauuucauuuucguuucauuacccuuugaaucaacggaucacauuuauuaugaacauauaaaaaucucaccuauuuagcuuucagaguuuuguuuuguuuuuccuaauugccuugaugaucagaaaacagaaauaucagagucuugaccucucucugccaugaucuuuuguguugaguuuagcacucuugaagaaaggagagauuuguuuauagcaucugcccugacaagucaguacugauucucuauccugguuaaccagauuuauuagugacuuucuuauaauacuauuguaacauuacuuuugcuuuccuucuccaccucaugcaaagagaaaugaaguaggaacuuuuugcuuguuugacauauuccugauuuuuuuguagguuucucugaggugauguagcuuuuuuggacaguacaccugcuaugauauguaauaguuuguacuguuuugcuaagugauuuuucuuccuuuaacagaaguauauuuuaacuguuugguuucuuuuuucuuuguguuccaauauucuuugaggagaauagaaaauggaagaagaaaccuuaguaaauaaguuuuuuuuguguuaccgagaaacuguuuaauaauaaauguuucccgauccacuugauguccacuuuuuuaaaaaauggccuuuauugaaggcaaaauuugguuucgauuuugcuuagaugaaauugcauuauuuugcuauuauucaggagacuguuucucaccugguugaucauuucaacuguuucuuucugugcuucaaaucaugagaaucccauuugccccaccgcagacuuggcaugucgaauaaaugugauggcagcaauuaacaucacgauugcaaugaaaauguaaaaaggaaauaguugcaaaguuguaguagggaaaacaaaagcuggaaaagcagcuuuuuauaaauaauuaugaaauuauuuucauuuuuccuacauaggauugaaaaguaaacaaauucucugguuauuuuacauguugauuguuucugccauauagcuuaggacucuauauaguugugguuaguuuuguuuuuacauuuuaagaacaacacaauaaauuggagucaucaguguucuacauagaugaaaagaaauuuauuauuagaaaaagccaaaggacuuaaaauguucccuuacuuacacauaaauuuaaguauauuuuuuccuagcuaguaggucauuguguuauuauuguguguugcagaaaguauuucacuuaaauuugaaaauaauuauuaacuggcuaguguuucauuuuuuauuuaaaagaacauuaucuaaauauuuauauaaagcaaagcagucauucuuuucauccuaaguguuuacuaguuuucauuguuuaauauugauuuuccuuuuuguugguauuagauucuuauuacaaugcguuugcucuuugcccugugauguugcuuuguuggcuuguucaucuacguuguagaccuagaugaccuucauguucuaguccuuugaguuuuuuacuaggcugaaacaaaagaaagcgauugguugcuaguaaaagaacugaacaaaggcagacagggaggguuuuaagcaugggauacugccuuagaaaacagcagguauaucucagcucggucuaugaaaaccagcuucuauaaggcuaggccaccacacugucauuuuuuuauuauuggccaucccuuagucucuguacacuguugaaaaagugaugauucaucacaggauaguuagaaauaauuggccuguucaaacccuuuacaguuggggaaguugguuuucuacaucauauaaaccugauguccauuaugcauguauauuugggacacagucugccuuuuaacugcacugugcuuuaccuguauguuuaauucaggaugagauugguuccuaaagcuuuuaaacaaagacuuuuucuuuuugcuguuuuuaucuuuuaauaucaauauugaaugaaaacauaugggaaccauucagagauguucaguagacauuaaaauaaaaaggaaaauguuugacaguuucccuggguaagcugcgaggcauuuauguagcaaaaugauguauuaaaagccaauuauuagaauaaugaucaacauaaaaccugggcuuuauacaucauuagaagguugucuguugugguugaggguuuggggcaguauacauuugagucugaauacuccuccuuauaagugacucauuuugugaagagaauacagaaaaaucuucaaaaacuuuacuuaccuuucccaugauugguguucguuuuuuguucagguccuguuuuucucauaguaaaauaacucaguauauauuuuuggcuuuagauuguuacuaauuuaaucuaguuucucagaauauuaaauuuauauuuauauguuuuaugugccauuaaguauuguuagagaauuuguauagagguuaauaaaagagaguugcccaaauucuaacuacauuaaucugauauuuaauuaguuguguguuagaaggaagauaaaucaaauuuuacuuauaccuauuaauaaugguuacugggugaauucugguaagguauuauguaaaggccagagaaaauaaaauauugauguuuaaaaaguuuguggauaagaaaucuuuuauuuuucuugccacuuaagauuaaaccaaaagauaauuuuuuuacccucacugaauaaacucauuuaaauagggaaaaucugaccgcauuucauccuucaauuccuaagauaaaggaaaagaagcagcaggaguagcaaagguugggauagagauggcauacuuuacgucauuucuuucaaaagggauggaauuaaacaaaaaauuuuuuuucuagcuaaaaggccaucauuuuguguuuguuauuguuaagaagccacccaacuacgauuaaaaacauuuaauaugcaauaaaauauugacguaaaagaaauagccaagagauagauauuuguuaauguggauauacuuucagauuuuuaauaauacuauugaaauuuuauaaaguauugaauaaaauuucacuuuuaaaaaauaaaaauucauuuaacaauaauuucugagauuuaucuaggccucuuaccacacuuggaccucucauuuaaucaaaggauugauauacacaauaagugugcacauuacaauaagguaucugggucaaagauauuuuucuuguuuuuuauuuugauguuuauuuaagaauuuugcuuauaauaugccaaaccuuuagcuauuuagauaagucccagucauaccuaaaauuuuuacuuagagcugaguauuuggugugguauugaccuggguaaugagcguauaacaaaauguuauaaaugaaaagcuauuucugacuuaaacucuugauucuucuacauuagugcuaguaaaauuuauguauucuuaguuccaaguaguggaauuuuauacauuuuauaaugccauagcaaagcacgauuggaaaugagaagugcugucucuuagaaguucucucauauuucagcuaaaacauacucagcaaaaaagauauguaaauuaaaagaaaaucuccaauuuccuauucugaguaaagcuuugauuuuugcugauucaggaaguaagguugacauuggagcuucucauuucaucuggaauaaucacuuuuuccuuuugaaaagucuuucauuuuagcagcaguaucuucuaaaacacuccauuuugcauggaugaaccuguuuuucucuagauaacacagaaaauacaacuaucauaaaugguaaccugcuuucuauaguauagcuuuccugagugcccagugagauacuaaagugccaggcuguucauucuggagauuucacugauuuuucuagcugcaucccuauucuaaccccccaaauaacucccaaaagaggaauuuuauaacuuccaaauugacugcuguaauaaaauguuuauccccuaagucaguaguggcucaucagcuuaggaucauucagaauauauaauuccaguucuucuugaaacauugcaccauuuuuuucuguuaaaauagguuuugguuuaucuuagugaugcugauauuuucucagauuuuccauuaguauuuuuucucccaucugaauaauaaucugaauaaauaaugaacuggcuuuuguuauagggguaggugcauagagcauccaauagcauuccaaauauuuggcugccaaauaaggaaaucauaacugcuuauuuguauuaaauuaguauuaaauaaaaugauuaacauuuuaaaauguuuugguauaaucuacaugcaauccguuaaaauuuccaaacuaaugucagauucuuuauugcuuggcuuucugccaaaugauguucaaaggaaauugaguuuuucucuagcaucuaagguaaauggaaauguaugugauguuuagcuuugacuagagaguuacaaauggauccauggaguuuugguuauauaauuuauaugcuauauguaugagggcacuuccuugcuucccaugauacuugggauggugcugucaguggagcaaauguaugcuuaugccaucuuguccauaauauguauuucuguugcuauuugaacuauuaaugcuauguaauaccaaguacuuauaucagaaauuuguacucuauguagauagugcuuuugaacuucuuucugauaguacauauuccuguauuaauacaauaaagccaagcugacaggaugacauagugaagcucuuauuaaaaauguguucuaauuguugcugagauacuauuggaaaucuagagcuugcugccucaaguuauuuuaaauuguguauuuuauauuuacauuuuacauuuacauauuuuaucuauuaagaauugcuuuuaaauuaaaagcuuuacauacgcuuaaacaaaaguaugaaaguauauuugaacuucaggaagcaauucuuuguaucagcacccugaaugguuuuguauuaaggaaagccagauucagugacaaguuugacccucacaucuggaauugccauuagagaaaagcaaucaucugagucauauguguauacuuaccuaugacauaagaagcacauuuauuuuucuucuuuuuuuaaaagcauauuucuuucauuuuagaaaaccaaaaugcccagauuauuaugauuaacauuuaaguuuuuuggcuaaaacauaguuaagaauuauggcaggaaauacagaauuauuucugagcaaaguuuaugacauccaaauuaauacagcuuuuaaaggaaucgauggauaagccauuugaaauuuauauauauuuguuuuauguugaugucauagaucuaccguguaaaauuuaaacauuaugaaaacagauuuuaaauauuuaguaaagccuucucuggaaaaugcuaaaccuuuguuuuaaaauuauaucuguagauaucuggucacuaauacugugaaauuauuucagcauugaguauugccggcuacaagugcuuuggaaacucuuuagcuguucauuuuuggcaaaaucuuacuuuuugaaaagaccuuauuuuagaggagauaucaauauugcuuucucaguuuuucaaacuaccauuuuguaauuuauuaguaaauuguaagugccacagaaaccacugugcaguauucaagguccuugcauucaggguuaaaacugaguuuauauacacacauacuaaacucuuacaaagccagggaacaacuauucaaacugcacuguggacuaugcuagaggaguuagcaugcuuucuuugcagacaugguugauuugaauacaacaacaaaaaauuguccagacugccaacugaaacccuugaaaacacuuuucaaucuguagauacaacuguaucagcaaaauguugaucaaaguucaaguggaaacauuaacuagucuagcuagccuucugguguuuucauugguuaauucacaaagagcaucgcacaguggauuuuuacguaguaguaacaauuugcuguaaaauuguauggucugaggauaugaccguagaguuugucuucugugucuccaaacuuacuauccuguacaucuugacucauuuuauucauuuuucacuucauuaaacaauaaggauuuaccuuaaauuaagcauuuuuuugguauguuuauugucuccuagugguccuuuguaaugccauaugguugcugcccagcucgacuuacaaacuuacucuuuuugcuucucauacuagccauuuugcaagccugagcugcuuugugguacaggucaaguacuuauggaguaaaguuaagugaauuuuuauugugcaggaaugucuucguuuaaagaaaaaaaaaaaaagaaagaaagaagaaaaagacugccccagcccuuguuuuuuaaauagaaacauuuuuuauuuuagagcaacuuggauuuccuacugaauauaccauaguauagugaggguuauauuuuguuuuaggcagaaugguuuuuaaaauagcccaauuaauuacauaaauggaaguuaauuuauuuuauaaaacaguuuauuuuaaaauagcuuauccauaugaguuauuuaaaagggaacuaacucuuaauguuuuuaaauaugauuugauuuauaauaaacuuccuggaagugagggaggccuuuaaucuucauguauuaagagagggugaauaauaaugaauuauuuuugccaagacaguuuuuuccuguuaaaacccaaguaauccugccauuuucacauuuuuccuuuuguucuaaaaagaagugguaaauguuuugcacuguuuguuggcuauggcugugucaugaggguucuaccaugauugaucagugagggccacuguguauuuuucauauauauucacuguggaauagaauccaguguugaauuuuuuuuuaagucaguagugaagaaugguggagagcauuuguuccauugaauaauuuauaauagcuaauuuccccauaagaagccuaccaaaacaugauagauauaucucacuuggaagaaaaguugucuguaaagugaaucaaauccuauuuuaauauaucauaugaguauauaaaccccuuuuucucacugauuuuaugggaucaaaguggaaauuauucuuguagaaaaugacuugguuuuuaagacaaaucaaauuuuuagaaaagacugauuuucaaauacaguaauauguaugucagauucugagugcaaaguagauaaauauuuuagauagauaaaauuuuauauuuggcauaaauugaguaacuuuaaagauaaacuuuauuuuuuauuuuuauguuuugaacacaguuauagucaguaguuucagauuuucauccucuccuugaaauguuucaauagaaaggauauguaacucuucuuuaauguucaauauucuaguacuuuaaagaagaagcuauuuuuaaaaauuaaaagacugaaauaaaagaaaggaauuuccauuuaaacaguugaaauugugauuuuaaaauauacuagcaaauuauuagauaagcaaauaauuucuuagaagccauauaacaguaaacuaaauucaauccaacaaacuauuguugagcaccuaccugugcagaguggacaauguuaagcaguagaaauguguuauugccuaagaguaacuaguucguagccuaagagagagucagacacauaaauggauacuuacaauacaaaguguaaguaccuugauagaugaaaauauaggacaucauggggacgucuaggacucugaauucacuuuugggaaaucagguaagacuucuuuacuccaagacuucuuuccuccagaagucuuaucugauuucccaaaacugaauuaggaccugaagaauaauuaaaauaagcuaaacagaggaaggccuggaagagagagaguguuguugcagguucagagaauagcagguauauagcccuauugcuauugcuuaagagauuuauguauaauuugguguggcuggaccauagguuuuaaagguaauggagaauagugagacauuagucuggauugguaaagugagaccagauuaugaagggauuuauaagaacgaucagaaaaaucaagaauaucucaaagauauuuuuaguaagauagugacaggaucauauuuacaauuuacaagucaguuuggcagaaggcaaagaauagcagggguugggcagaugauggcaagaucaaacuuaaagagacugauuccuuucuaaaauagaugagaggucaugguacuguucuucuggauagugaauacuagaggagaaucaaguuugaaaguggacaaauaauaguuuguuuuuaacauuugauuugaggugcuuguggaugaucuaauuugagguguccagaaaggaacuggauauaugaauauagagccaagcucaagagagaaugaagcuagauauauagauuaggaagguaaucagcaugagaauguuaacugaacccacaggaguccacaagggucuucagggcucuccaucuuuagcaucagcguaugauaaugauuuuguuaccuaauucauuauguuucaaaugugaaugcauugugaaauauuuaauguacuauaccaguauaggauauuauaaacuauaaugaagagugcauuuacuaaacacauugcuauaaaacugguguaguaaacucugggccaguguggaccaucauuuggggcaggaaaaagaaucauguauuuuuuccccuuuucuaaauugacauauuaaaaguuguacguauuuaacauguacaacaugauguuuugaaauaugugcaguuggcucucgguaucuacagauucaacuaaccauggguggaaaauauauuugcaagucaacuuuuuguaucgauggguucuacaggacugauugcaggagcauccauagauuuugguagcugaggcaucuuggaaccuuggaaccucuggauacugugggacgacuguauauauugugaaauggcuaaauugagaugauuaccauauguauuaccucacauaccuguuuuuugugaugagaacacuuaaaaccuacucucuuagcaauuuuuaagaauacaguguaucguuaacuguacucaccauguuguacaacagauaucuuuaacuuauucuuccuaucuaacugaaauuuuguuaucuuugacagauaccuccccaacccccucuccaccaaacuccugguaaccaccauuuuauucucuacuucugugaguucaaauuuuuuagauaacguauauaaguggacauaaauguacuuuguggauuuuuauauucugucacuuagccuuucacaccucacuucacagcuuugugaaggagagguagguauuuuuauugcuguuuccaguuuaaaaauguagugauaucaaguaacuuuccugaagucucuuguugcucacuguugagugacaaaauaaaacuuugaagagggaccuggguagagagagaaaugagcaaaaaaccauuucaaugagagaucagugaccuuacugcauuuaaguguucuuagacaggaauuacaccauuuuucaaauguauuguuuauuuaaaacuugaauaccccaucuguaacucuguucuaggugaugugguaucaguaccagaauguuguacuguuucugaaaauuauuuucaguauagcaguuaaggacauuaaggcuucaaagccauugguccaguuuugauaagaaaugaaguuggaaguuggguguaguggcucacaccuuuaauuucagcacuuugggaagggccaagguaggagaauugcauuagcccaggaguuugaaaccagccugggcaacacagggagaccccaucucuagaaaaauaaaaaauaaaaacaauuagcugggcaugguggcaugugccuauagucccaacuaaguaguucucugcuaagcccgggaagucaaggcugcagugagccaugauugcaccacuguguucuagccuggaagacaaagugagacccugucucaaaaaaaguaaaaguaaaaauaauaauaauaauaauaauaaagcuggaaaucaaggauauauuuucaucaucucuucacuugacaccaagacaagucacaaaccugaagaguauugccuauuuauuccuauuuauuagaaaacaaaaaaaaaguuguuuuucaacucuuuuaucuagguaugaauguguuaaaaauuauuuuuaguguuuuauauauaagccagcauaaaugauaguagaauacauuuguauaaugcuuuaauauuuacauacuuugacauauuuucucauacaacccuuacaguucucagaggagguagucagaacagguauuaaccuaauuuuauuuuugaacaaacagguucagaagguaaagucaguuuguuucagagcuagaacuuuuccuauuauaccacccugcuucuagaugugcaaucuguuuaagaauuaaaguaauuuaaaaugguaaauuaaaaugauguuauugcaguuauuuuaauuuccugccuggagcguuucaguaguagugguuccuguauuaucugggaaguuaaaccaaauguucuuuuauacucuuuuagacucuacaacuucaguuaauccagauuuccuacccaauaacauuguuugggagccagggaucucugguugcccaacccuucuaaguacuuagaagcucuuagaaagaauguucagugaaaggcagugaaaaggccuguuuuggauaccuacugccuauagcugaaaccuguuaggugccuucaugugaaucccugaagacaccaugaugaaauugauaagcaugucauaauucaaguaaaaacuuauuaugagugcuagaugauagccauauacugaauacuuuccugauuuuacugcuuuugccauugcucaucuaucuguagcuggaaugcuuugucucauaucagacugccagaacuaaauuccaccagccuucaaagccagcccaacugauaacuauuuuuguaaagcuuucccuacuuacucuaacaaguaaugauguaaaauucuuagaacaaucugucauagucucaaugcagaugucacauguaacuuuguuauuaauauuuuaguuacuuguggauaucucauaucuucuuugguuucuuuguuauagaacauugucuucccauaaacuugaauauugucccuuucccuuagaaaagggaaaugugggagagguggggagaugguuacaucaacccaauuuuugcuucuuaaaaugggcuuuuguugaugugagucuauggucccauuuauuguugugacaauaucuugguagugggaauuacuggguauguuggagaaccucagaagggagaauggucauguucuccagugccguaucugaauaucugaauccugcucuggaacacaguucuuauucucaacacuugauccuauucucuuuaucaaacauaguuuuuaccucguucucuguaagagccaauucccagccccauaaagccaggaaauccagcaauaaagaauuguucccagcagcauguuuuguacuuauauuuucuucuucuuccuuuuuuuuuuuuuuuuuuuuauuuguuguuguuuagacagcgucuugcccugucgccacgcuggaguccacugcaaccuccgcauccuggguucaagcaauucuccugccucagccucccaaguagcugggacuacgggugcgugccaccacacccagcuaauuuuuguaucuuuaguagagaugggguucaccauguuggccaggguggucucaaucuguugaccucuugaucugcccuccucggccucccaaaaugcugggauuacaggcaugagccaccgcgcccagccaguacauagauuuucuaaaguguucaacacucuuaucaauucagauuccaccauaauuuauaugaucaaucaagcacugcuuuguuucucuguaggucuccuggaauacaacauagucagagauguguagaguaugguccuucuggguuugccaaauuuugugcugaaggaaaaugauggcuccaccgcucuuccugccuaacucguagaaaggcagcaugguauugugauagaaacaugagcuuugaagauaagcagucagauucugauuccuguucuucuaauaguccagccuuguaaagaucacuuauccucauaguuagcaagacuuccucauuuaaaaaauucuuuccucauaggguuguugugaagacuaagugaauuaaguucugugaaaaaaucuagcacaguguuuagcacaugaauaguuuucuccauauauguggccucucuccugggaugaucaccuugucccaguuuguccaggguuucccuaguuuuaucacagaaagucucauguguacuaggaaucaaucucucucuuucucucucuuuuuuuuuuuuuuuuuugagauggaguuuuugcucuguuguccagauuggagagcaguggugcaaucucagcgcacugcaaccuccgccuccuggauucaagcaauuuuccugccucagccucccaaguagcugggauuacagaugccugccaccacacccagcuaauuuuuguauuuuuaguagaggcgagguuucaccauguuguccagacugaucucgaacucuugaccucaggugauccgucugccucugccuccugaaguacuaggauuacaggcgugagccaccacgccuggccucucuucucucucucucacuugacuuuucuaggcuuauuggccauuccuugaauaagguacagucaaguuuuacuuuagacuuuuaaguagcucagaauagaguuccuuagcuuguugguuuuuacuuauuuuuuucauuaauguuucaagguauauuaugagguugcauuauuuaauugcuuuguugauugagccaggcagaucuuucauuuauuagcuggccugauaucagggcaggaaagcuuaugaguuacuuuguaaagugaugguuuuauuaaaggugguaauuuugaucagcugaccuauugguggguucugauuacuuuacagaaguggaugguauugacaagccuccaucuacuuggaaguuuuaaaauguguucuuuuuauuaaaaggacuucauccugugaaacuaguuucuucaaauugaaguucucucagucuaggcaugaugaguuacaaaaaugauuguuuguaguauuuuggaauugguuuccaccuuuauauaaacucaaaugucaauuuaauguguucaguaagccaagcaaccuuucuaaugaaacaaguauaauuaugauuuauuuauauuuuuauuucauuucucauuuuuuucagcaaucuuuccuguccucaacuauguuuccuuuuuaauuuaaaaaaaucaaguagaaaacaaauaucuggcuuuuuugucaaugucauggucuuaugucaagaucuugaaagguaucucuccaaauuauuguucugcuauaguuauuucuaucaaagaaguccucuuguauagcuauuuguugaauuguguaccuacugaauuagucaaagcucuagcuaaaaccauuuuuuucuuuaccucuccccucccccaaaacuugcuuuuguuauguauuggcuugcuaauccuuguguugagcaguaucagacaucaccuuucuugggggcaguuaguccacucuuccgcuuucuuugucagagggcucccuuaauaggagaagucaacagggaggacaaaaaggauugaaaguuguauuuaaucagggucagagaggugguguucagagugacgggcccacaggcaggcuggccuuuuaugcuugccgacgcagauggucccagagcauucagcuaagugaagagaaagcugcccagugaaagcuauuguaggguagcaucguuacaguugagaaagguugccagggguaacuagagaguaucaccaguaucgugugaucacuaggcugugccauugaaaauguuagacugaggauuguauugggucccuuggcaucuugauguucauauguaagcaguauuagcuuacauuaguguuuuuaauuuaguuuuuucuguuuucuucccuuuguucuuucccugccuuuuuuaauauauaaaacauagacuuauuuuaauucacaauuuuguaaaaccuucugaaaacauaccauuauuuaauaauauaucucuuauaggcuuuaugguuugguauaaacuauaccaaauuuuugugaauaaauuggauuuaugaaaaugagguguaauauuucucguuuaaacagcucuaaguugauuuuccauugcucugaaacugcccuaguauaucccaagauggguaguuuguuuuucuuugugauuuuaaguaacuuauuuuaaaauauguuaguauuuaccugaaaacaguagauagcauugagugcaggguugugaccaagaacucccaaauauuuaugaaaucuaucuucaauuuuugccuaaggcaaaaguaaaaauaugcaucccaaaugagccagaaccaaaauaguguaacaaucauuggucucaauuuaauauacuuaauauacuuugaauaugauuuuaauaugccaguuuuggaauuccuuaauuucaucccuucuauugucccccggauauuuuaagaaauuacuuauagucacauacaaaauguaaacacaguagucuccugccgucacuagaggaaaacacauagagauuucuauucaauguaaaagugaaauuugaaguguaacuaacguucaaggugaaaugauaauaacuuugcaaauuauuguuuuaacuuagauuaccagucaacccaauuuaagucacccuuacgucagucagagcugauuuugacuuaauacugcuuucucaccuguugagagaacauuaagugaggacaaacauaguaccauccuguaauaccaacauugguauuugagagcuaaucaucuccaauguuauuauuuuguguuagagguaacuuuuagaaauuggugaauuucaaguggagccaggcuuuaaaaugccuucugagacccccacuuaauaguucugacucuaaauuaauuucacaccuuuauugaaaaaucucaaauuuauguuaaaaugagcuguuuguuuccuuccuuucauuaaaauacagcugagucauuuucauuuaaaacaacucauauucccauaaauaagaacauuugucacaaaaaguuaaugaaucugguaaaauuuagaacuaagauucuaaaaggucuauagauacggcaagaaaacuguuuuuuggaaaauugaauuuuuauuaaaaaaucaacacaaugugauuucccuuuauuuccugaagaauaauaauuagauuaugcuauucuuuuaucaucauaguuuuuuuuuaaaggaaaaucauaauaugaucaucuaaaagacuuagggaaaaaaauacaucuguaucacuuauggugagguuggcuuaccaggauuuaugaauaaagauuguagugucaaugcaaauuuuaauuacauugcuucuuuaaugaaucuugauaagucuaagacauugaaguuauagcauuuuaugguuauuauuuuuauuuuaccgauccacuuuuucuuuaucuauguacaugauacagaugugacugaaacacaugguaaaccgaaugaccuugaagaagaaaagaacaaauuuccauuucauguauuuucauuuaaauugaccacgugacacacacagugggaccagggagauucacauaaaaaaaaauuuacauuaaacuucagcagagacuuccuaucacuuuggucuuugauucauuacagguaacaugaauaugagagggaaugguacauauuuaguaguuaucacaugucaucacaacauagauuaaaaaacaaaaccguuuuuaugauucacaaguauagauaugaauguuaccuccuugauacaguuuaaaguugacucuuuaaagauaguccuuuuauacaauuaaaccauccuaucaacauauauuuuaaguauauaaauuauuauauaugcacuuauaauuuuauacuggaaauuaggagcuaguaaacuaauuucaguuuugccaguuguuuaaauuuuucuuuaacgugaaccaaaaccuuuuucgauuccauuauuauguuaguaauaguaauauaugaguguuaccagaacauuaaugauuggaauauuuagcaaaacccauuaaugauggugugaguuaaggacuaucccuauauuucagguauauggcaguuauggugagaacguacaaccagaauaaucacaauuuauuuguuacagugaauuccauuuuacgaagaacuggcagguuuuuuaaucugaacaauauucauaccaacuaacauacuuaagagguacucagaugcuugcugaauaaauguaguuuaagauaauacuuuugaaaguuggcugacauaagaaaaaugguaaucuuuaaugggaaauugcagccuuugguguuuauuuacaaagaguugggaacuuuuuaaaugcuguuaacccuuuauauugguuugaaucucaucugggauaauugagaaggcucauugucauuuugaggaucccagacucccacaaaaaaaaagaugagagugggguguugacuagagagcuccaagugauaaaaucuaggaaagaacacuaaaaaaaggcgucagaagguuuggguuuaagcccgcuaauauguguuuauuacuuaccuauaaaaagauuacuuaucuauaaaaaggugaucucuaccuacuuuaagaauuacuacauucaugaaauuagaguaaguaugugaaaguacauacgaguugaguauuccuuauccaaaaugcuugggaccagaaauguuuuagauuuuggauuuuuucaaauuuugagauauuuguguuauauacuuaaaguggagcauaacauuuccuuugagugccauguuaaugcucaaaaaguuucuuuuuuuuuuuuuuuuggauuuuugaauuagggauacucaaccuguucuuggaaaucuguaacauaugguaugcauguaaauugaugguucaaauaaucacuaauacuacucacauugcugccacugcugaugccuuauaacuaguaucagaagagccucuugggauguuuauacuguagucuacccuuaucuuuagggaauacauuccagcauucccaguggaugucuaaaacugcagauaguacugaacccuguaugcauuguuuuuuccuauacauacauacaucccuaugauaaaguuuaaauuauaaauuaggcacaauaagagaacaacaagauagaacaauuauaacaguauagcauaaugucaguuaaugugaauguggcacuguacucacccuucuuguguugaugugaaauuaugagaugaaguaaggugaauaauguaggcauuguaagcauugugauguaguauuaggcuacuacugaccuugaacacaagcauugugauaccuuaacaguuaaucugauaacccagauggcuacuaggugacuuacagguagauaagguauauagcauggauacacuggacaaaggcaugauucacauccucauggggacagugcaagauuucaucaugcuacucagaauggcgugcaguuuaaaacuuaagaauuguuuauuucuggaauuuucauauaauauuuuuggacuacagcugacuacggguaacugaaacuguggaacaugaacccaccgauaauggaaggcuacuguauuuuaauauuugccaacacugagcauuugaaaugagcuacuuuggcaggaaagauuauaaauaauugaguagauaucaauggaugagcaucauagugcucuaucagcccuuugggagaccaugaguaaccuaucauuugguuuuagcucuuugucuugauucacuuuaucaaaaugggacuauagaugacuugugguagguucuagagugcaagaaaugagaaaauaagugaaugagcuuugcccagccacagauucuuaacagugcugagggaauuguccugaggucuuugcaaaauccuaaauuaaugauuaucacuauaacagauuuuucuuuacuucuuuccauguaacauguauuuucuuccaacagauauuuuuaauugacuucuucagaucaacauuaguaggugacguuuuaauaagcauucuacauuguuuccagcauuuaccugaugaaauuaggauaaaaugccauuucugacugguuacuagcuuccaaacagcagccuuguagaaccugccauucagauucaugagucagcagaauuuauaaauuaugauaggucauggaucuuuguuuuuuuccccagauugucaaaaacacaugccaaguguugugcagcuuuauguacucuuucuuuauauacuagccaacagccuacaaugguaguucucaucguguggucuguguaccucugggagucccugguuccuuucagugucccuuucuucaaggucaaaucuguguugcuaguaauacuaagaaguuauuuaccuuuuucaauguguugacauuuccacugaugauaaggaguaaggaguaaaaguucuggcuccuuagaaugaaugaaggcaauuacaugaaaccuuacuaauaauauucuauauguuauuucuacaugccuguaguuuuuuuaaaaagcuaguuaguuucacuuaggaauguucuugaagcaauaaaaauaauuuuauuaagccucaauacucuaguacaugucuuugaauauucuguaugaugaaacgggaaguacuguacacacaaaauaaaacucggugaaccaguauuuuccacaugacccauucauuauguuacaaaauuaugcaugagugaaaauuucauuuacuguccaagagagaccaauuuuagauuuuacauuguaacuaacuuuuaggaaacuaucaccuguuaauuuuggccuaguguaaaagaacaguuuccauagguaugguaaaaagcaauugaauuacuguuuucuuuuucaacugcauaacuguguaaugccagauaaucuucauaccauaggggaaaaauacuuuuuuucaacccucauagauucuucauuggauauggauaccuauaacaaaagacagaaguuuauugacauguauauuuuauauauacaugggagacacccauggaauuaguaguuuucaagguggcuuugaauagagcauuuucaacaaagaacaguaaguuuuuagagaauacaagacugaggaaaaggacuuugaaucuguagccguaguaaauuuuggaagggcaaaucaauauggcggguagaggcuaguuggugaagcuuauuaacacagauucuuuuccaggcuaaaguugucuucagugguuaaccuuuguuucuccuaguagagaggugggcaggauaccuuuugucuuugcaaaucuaugucuugauuuaggcaaguggaaggcagagagguuucuugcaucugcuccuucaaaacuaccuucaguagaacaauccuuccuauuuugggguagcauauucugguuucccagaacauacuucagucaaaacaacauaucacagcagauuaaauacagagccagauaugacaacucaacuauuuucuaguaagccagauauggaaagacauuugaaaauacaaaacaaugccacucuucucauuucggaaaauagauuuuucauagaaguuucacuuuuauuuauuuuuuauuuuuaaauuaguggagaacuauuuaauuuuuuuuuuuuuaguuuuaaugucuaguaugggagauacuaauaguaacagaccaaauaaacaaaggcucuuugaggcucucaauuuuuaagaauauaaagggauccugagacuuaaaaauuugaaaacugcuaagcucucucucacugugugacucgccugcucgcccuuugccuucugccaugauucuaaguuuccugagcccucacuagaagcuaagcagaugcuggugccaugcuucuuuuguauauagccugcugaagagugaaccaaauaaacccucuuuucuuuauaaauuucacagccucagguauuuauagcaacacagagauuaaaaucuuauuagggcaagggguauagcugguccuaaaauuguaagauuaggaacuauacuuuguauucuaguucauaaguauaaaagcccuggaugagaaauugaucugaggaaagcuuuauugcaaauuaaaggacucaggagaauagauaucgcugggcaauggaggauaucucaucauaccccccuugagcaguuugcuuuuaucaugacuuugagcacuauccuuuaugucucuguuccucaauuucuccaguuauaaaauaggaccauuuuuacaucagcgccuccucucccugucuuacagggguuugacaaggaucaaaugaguugcuuuaaagagaacaugugagauaagauaucuccucacaguagguuuccaggauccuguccaggaugaucacagucagcaugggguuaauacacagauucaagaggcauaucaaaggagaucugauaagauuuagugacuggaugaauacagggaauaaacagaaauuaguuaaaaauuauucuaaggagccagaugcuguggcucaugccuguaauccuagcucuuugggaggcugaggcgggcagauuacuucagccuaggagaucgagagcaaccugggcaacauggugggacccagcucuacaaaaaauacaaaaauuggcguggcacaugccgguagucccagcuagcuccuugggaggcugaggugggaggaucgcuugagccugugagguugaggcugcagugagccgugauuguucgugccacugcacuuuagccugggugagagagcgagauccugucucuuaaaaaaaaaaaaaaaaaaaaaaaaaaaaguuuguucugagggcuuaauugucaauauuuuaguaacaaauuggaggaauuggagagaaaagcaaaaaauagauauuuaaaaacccaggcuuuuaagaucaggauuguaggauuguagcacagaaguuaaagaaaaguggccagaaaaauaauuaaggacaaaacagguagggcauggauggcuguuuaagguuggcuuucaggaagcagaggaguuuuguaagacaauaggcaagcaucgaaaagaaacuuggauuauuauaacauguagcagaaaaaaugaaaaacaaaacaaaaaaaacuuggguuagcgucuaauggucggggcugguuauacaauuugugggauacagugugaaugaaaaugaaaugcaggccuuuguucaaaaagcaaggggaaaaguacaguuaagagugcuaauguuuaaagcuuuuuuccuuugggaagaaaaacaugguagaguuaauagcaauaaauaaguaaacacaaauucaaaauuauguuuguggguaucaugcuuuuauaaaagauaguaaauaaauaauaccuuaucacugugaaaucuugauuaaucaugacuuucuggcucuuuuuucugcaaauucauuuuagucaucaaaauuuauacuuuuauaaaguuucauuuuuaauuuauauaauuggaaguaaugucaauuauguuuggcaaaugcaagauuacaaauauuuuuugauaauuuuugauuuugaggacaggccuuguacugaugccacuguuaagaacauuuuauaggcugugacaacauuaggauaaauuucugauaaauuauuucaaaaucuaaauuuagaacaucuagagcuaauuuuuagaacaauuuuucuaaaagcuuuaacucuacaaaucaguucuguguauagauuuaauucuaaguguagauuuauacagggguauuuaaauauucuuucugcuauuucuuguaacuuggaaguuguacaacuuccaagaaaccaaaugacuucaugacuuguauauaauucagaaugucuguuugugcauccuaccucauaucuucagguaugaagauauggaaacauuaaauuuaaaauaauccuucucauuaacaguugguucuucauuaaaacaguugguucucauacaaaaauauuguucuuuucaaccaaaugugacaaucuuuauauucaauuucucuuucuaaagcuauugcuauuugguuugcaauguugcagugguuuauaaaacuggagauuauaaaugccuugaugaauucugauauauuuuuggugccaugacuuggauacuuugcaauaauaugcugacaaagguuuuacucucugagcaccaacacuuccuguccugguccuuaggcuggagaguuaauauuugcgcauauacuguuaggauagguuccaggaagaggaguacuuuggcuuuccacuguauauccccagugcugagccgcucuuucauggggcugcugccaucauugccauugccaaucugggcucaguccuggccacugccuugagugcccuguguuguccacgucugucccagguauucacauuugggcccaggcagccaguccagcugcuuagugcauaugcugacacuugacauauuuccucuguucugugcuccauugucccacuggucuucaucuacaaaguacaaguucaaagucauuaacaaguucaagauggcgacaaaggaccguucaacuaaauagaggccccuuuugagagcaagcccaugugugacugcacaaguuacauaccugguaagcuuacucugcccauuuauauugccgaaguacuaagacuacuaaacugccuuuaaauugcucuguucaggacuucccuaagaugaacuauuugaccuuaaugggaccuauauaguuguuaggggcagagacaugguaguuuucaugcagguauucagugaguuuguuuuaaaacaugcuaccuucuuaguaagacuugauacuccucuaggagccuuauggaagcugaacucccuggcagccaggacuguagcuauugaaucugacugggguucuaagaggaaggcuuuugaaauggaguucagacaaacugcucuaucaaaauacucuuguugauuuaguuugcuguguuuuauucuauaucuuucuuuuaauuaccacuuggauuuuuauuauuucugaucuuuuuuuguuuguucguuuguuuuuugguugaaggaaagggaucauagauuauuauuuagcucucaccacuggcugcuugauauggauggccuacuguuuaucaaugccgauaaccagaguuuuggugguuguugauaccauauaugucccccuuaaucuuguaaucuuguaccuaugugagagacauuuuuaaagaagaaaaucaagaaaaaugucucauagccucauuugucauuuuuuucuucuuuaagacgucaacagauuuuuuuuagaggaaguuucucuaacuaaaugucuuuuguccucuguaaaauggacaagaguugaaacaagcaauguauaugaaagguaaagacgucaaagucaacacacagaccccagauugcacucagccacuucuuugcuucccacagcauuucuaugcuguaaaaugcugucuucaaugaacuagaauuggaguuacuguuugauccuccucuuauccucuuaaccuuggccaaagauauuuacauuaucacuuccuaacugaugugccacaucuauugcaaaaauaaguuguggugagcaagauacugauuccuuguguucucaggguggccuggcaggagcuucugggucaguugucugaaggugcccugcuccauuugcccuaaugugcucuauaaacaccuuuccuugaacacugugacaugaaaaaggcuuggaaguacuacuuuaaacuucaaaugaaaaacucacaaggaagugaaauuccguaauuaagcaauuaccuuuuaaccauuuauguaaucaguauugcuuuuguucuuuuucaguuuuuuucuccuaauuuuagucaagguaaacaucuaagcagcaaguaauauacugaugaaaauaaauuuugagauuuguaaucuaguaauuugucuucugagucuuguguuaauaggaaccagaggucuuaguaaaugagaacuaugauucugggugcuuaaauuguuuuauccgcacacucauugcgugaaagauuucagccuauaaggaagaaauuaugucagucuagagucuccucauuguagaaaaguucccauuuuuauacuuuugaugauaacaaagcagcuccauuggauugugguugacaauagcaaucuguauguuuuugcuagcaacauacagaucauaaguagaacauauuucagaguuacacaugauccaagagaaagugugccgaauuuugaacuugguugguagaaaaaggugauuuuuuuuuuuuugguaaagagauuuuuuuagauaaacucuaagaaaguaguuauuuacagaaaguacacugaaguauaaaaagauaguaaacauagucauaaugacuauaguugcuagcuauauauucaguuuaucugagggggcaggaacuuuagcaucaucuuguuuuaugaacucuaauuuacuuaucaauaauuuuucuuacuaguuacuuguugcaauaacuuauacuauuauacuucaugugugguuuugauuucuuaauggcaguaucuucuuuauuaguugacuaugggaaauauacaaguauaguguccccuuguuugcaaagaaagggauucgcgucuucacaguuuacucacagcugcaguggugagcugcccucuccuggucaucuaugccuuccagaacucccgguggauaccagggaaaaucauacauuuugccaaauaaauggauguuuuaaucaucuuugaucuuaacauuauuuugugacacuguaguauaaagcucugcuguagcuccuuacuuuucaugucuuaaaagacauuguugacagaaaagaugggucaucuuuuuucucccacguucuuguaggcauucuauccaccugagauuuuugccccauuacuucagucuuaauggacaaauuuugugccacccuuguuuacuaaauucuugagauuuacuuagaagauguuucuuaguuugucuauccacuuugggaaaaagagauuuucagaacugucuuaaauaaguggauuacccaagauguucuuuucauagaagauuuuuuguuacauauuuucuuaaaaaugagcaucagauuuucucuacuguuaauaauucauguuguacaugaguuuacuggugauucuucuuaaaaccagugcuuauguuuuuauuuuuuuaauucucuauucuucaauuccuauuucuuauaagcccauccuuauuuuagacucuagacuuggggaccuaugggauucgcaucaguuauggugcuuaacaaaacuuuaauaccagaauuuuagaaucuuacuuucuuguugaaaguagcaguuuaucccagccuuuuccuauuauauaccuuauauuuuguauauacucuuacauuuucuauauacccuuauauuuuguauuuuuaaaauggaaggaaugaaaaaaaaaccugugguuuuuaucguauuucccauuuauauuuguaccuugcuacuaguugcuauuucuauuaagauuccuagaaaacuuuuuaugacauguuguuucuaaaguucauauauauuguaguaacucaguauaacucauuauuuacuaaggaagcauacuaauauugcauauccucuuuaaaauccuacaguuaagaacaaaagacuagaagacaucaggccuuuucauuuauuagucauuuuaccuuuuagacaauuuuauguaauuauuuuucacguggcaaauuucauuguacacuacacacauacguuugcagaaggggugcaaaguuuuggauacauggaaauuucuucuugaguuagcuagaauuucuuuuccuuuuucaaguuaagacagaaaacccagccaaucaauucaguuuugauagauuuuaaaacccuaaucaauacuuuaaaauuacuuaugaagcaaauuauuaagaguaacuucuaaacguagaaaacaugaaaaucacauccaaauuguagaaagaaguuauuuacaacaaggucagggcgugugccacuucuuccuccagccaagaccuuuccugaacuuggugaucauggauaaacgagugcccaagagucuuuaauuugauauaugcauuacauuucuaagaucuuaaacuaauacuaucucuuugcuugucuuugguguugagauuguuuaaaccuuucaagaccugauuuugaauccuugcugucauuuacuaguugugugacagacuugcccacuucuccuuuauaauguggagguaauauuccuacaauggaugcuugugaaaauuaaacauuaauaagaauauuaaaaugcauuuuguaagccaauaaauggcauacaaauguaaauaguacuuauaaaauaaaaugcguuuaauuuuuuaaaaauauaugacauucccaaaacggaaaaagguauuacagugucuguuaaaccagacuuaauggaauacuugauuuuucuucucauaaucaaccaauuacauuaauguaucaaaccuguguacugaugaagauauuuuaaauagucuuuuuuuuuguggagggcagagaauuguguaacuuuuauguaucccacugccuuuuuuauuguguauugugaacacaccacagcagaauuuaaauaguuaaauauuuguugccucauuaaauuguggcuuccuaacuuaacuucagauugcagaggacuagaaaaguaggcauuuaauauauuauuuuauuuuacgaguuuucuugauacauaauugguuuuggauauauuuccuccuaaguacagagcuagcaccauaaauuacaagcaguaaccagaucuuuuuauaugccucacuuuauauugcuuaggcaaccuucuguaugcuguuuucucuaguccucuccauagcaguuaaaccugaacucucaucagagaaguaaaaauuuccuguaaaaugaguuguuaaaagcuauauguuugaaguguaagagcaggcccuucuaauguuuaggaguuagcuugugaaaaaacaagcuuuuaucuauguguucuugcauuucagucuguauuucugaauuuauguauguguguggcaguguaggguagaugauaaauuuuguagccuaggaaaccuguaucccaucaggagagaaaacagauguucuuccuccugguuaagaacuacaucuauccauuuagcaauuaugaaucucuucccuagguaauacucuuugagaaaggaaucuuucagcagacaggaucaagaagcacaugauucauuuuuuacauuaugggaaugaauccuuuuacauuugccuucuccuuuuucaugcuuucaguuuaaauaaaaguaaguagacguuccaguuuaaaucacguuccaguuuaaauaccuuacaggaugaaagguauucuuuacuuccuaggauccuaggauuccuaguaaagggauucuuucuuacuuccuaggaucagcgaauuggagacacugucagagaucacgaaagaaaguucgucauuccucccauccccaauccaguucaaccaacuuguuucuagccauguuuuuauuuaauaguuucugauuuuagcuuguuuugauugaaauuauauuauccaagucuuguuuauguuucucugaaaguggccaaauacuguuuguucuacuuaaguaguauuugcaucuuuuucuguccucaugcuaccacuguaguugaaacccuuaucucuuaccaaaacauaaucugucaucucguugcuucucuaaauuucuuccauauugcuguuggacugaucuuccuaaaauagaggucucaucauggcuuucuguuuuccagcgaccauuuuccuuuuucaaagguauccuauugccuuuaaaauugaggauaguguguuuagccuagaauugacaccccucaguguuggcccuagucuguuuuuuucaggcuguaugccauagcacuccuucacaugagccaaacuggaugguucaggcuuugauacuucacuaccucuuuucucauccucaaaucagucucugucuuugugauacccaucuucucuuccuucauccccuccccaaaucccugcauguugaauuccuacuucuuccucaagaucuuagcauaaugccacuucuacuucuucuuuaaggucagacauagaaagaaaagaguaggaacuguauuuacuguaucaauaugguaaaaacaacacuuuaauuccuuuuuuaaacuaaaaugauuuaaccuacuucauuuauauaguucauccaaaaaaacagaaugaccuucccaaaugcaaaugcuuaauauguaaaguuuaguuaccauauuaaagaagauucugcacaccaugccacuuagguaucaagaaaugaugguauggccaaaaugggcaaaggaagaaugaacuauuacagacaaaacuaugaaacucagaggagcucauaguacaacuguaaauuuauuuguuuuuuuaaauuuagggauguguaaagagcuauaaaguucuugacaggauuugauaaaucaucagggaaaguaguuaaugcuuuaggguaaaacauuuuaaaauacagcuuuaaaaauauauaaaaauagagcuuuacacuccuguuauuaauuuuuaauugucucuuuaugaugcuaagcauguuggcacuagacucaguuuuaaaaaugucuaccagcuuggcaugguggcucaugcuuguaaucccaguacuuugggaggcugaggugggaggaucaccugagcccaggaguuugagaccagccuaggcaauauagcaagacuccaucucuacaaaaaacagaaaaauuaaccagguauagugguacacaccuguaaucuuagcuacuuggggggcuaagguuggaggauagcuugagccgggaugaucaaggcuguagugagcaaugauugcaucacugcacuccagccugggcaauggagcaagacucugucucaaaaaacaaagucuaacagugauguauauguuauaccaguguuauuuggaagauaacuugagacuuuucccaugcauacugaauuuuugggaaauaaauuuaaguuuuucuguauaaauggucaaaaaaauguuauauugagagagagagagguauacuauccggaauacagucugugggauaugccuguacaauuaauuuauccauucaggcccaguuucaaaggcuuuggaagauggguugcaaaguuuauuaauccucaucauuucuuggcuaagauaauuaguauaauauaaaaagucuuugauucucuauucugaugaccuguuuugauccuuagagacagaacuaaggauuaaggugagaugaaucuucuuaguuuacuagccaaaacaguauacucagcccuagaacagaauucucugucgcuuguauuuagcauucccucuugcugaaaguguucuucucuuuuuauauuuaugauuucuauuaaugaaauugcaucucugucucccauuugguggugggggggagacaggggagaagaacagggccuugcucugucucuuagccuggaaugaaguggcaugaucacagcucacuucagccucgaccucgaccucccaagcucaagugauccucccaccucagccuccuggguagcugggacuaccaugcacggcuaauuuuuucuuuuuuuuuuuuuuuuuuuuugagacagagucucgcucugucacccaggcuggagugccguggcaugaucucggcucacugcaagcuccgccucccagcuucacgccagucuccugccucagccucccgaguagcugggacuacaggugccugccaccacgccuggcuaauuuuuuguauuuuuaguagagaugggguuucaccguguuagccaggauggucucgaucuccugaccuugugauccacccgccucggccucccagagugcugagauuacaggcgugagccaccgcgcccggccuaauuuuuucauuuuuuauagagacagggucgcaccauguugcccagccuggucuugaacuccugggcucgagggauccucucaccuugaccugagauuacaggugugagccauugggcccagccugcauuuucuugaaguugaagauuuccucugugaucacaucaacccaagauucucuuucucuaagcccuauuagcauuucuuauaaugccauucaaguaccaucacuaacuugauuggaaguuccucagagcagggacuguguuucagauuuuuuguuccccacagugcuuaacacagagccuaauacaaaacaaauucugugugaauuuuuugugaaagcucuugguaucucuaaugugcucucaaaaccaacuacuauuauaagauaauuagauuuuacucacuaccagauuucucuaccuggccaauaagguuugcagaaguuccagaccuaucagguguuuauuugcaaagaaacaaaguaguaaacuucaaaagucaugaauguacucuugagcccuguccucacagaaaaaaaaaaaaauaagcaaaauuucuauuuuuuuuuuugagacagagucucgcucuguugcccaggcuggagugcaguggcgcgaucugggcucacuucaagcuccacaucccaaguucacaccauucuccugccucagccucccaaguagcugggacuacaggcgcccgccaccaugcccagcuaauuuuuuguauuuuuaguagagacgggguuucaccguguuagccaggauggucucgaucuccugaacuugugauccgcccaccucggccucccaaagugcugggauuacaggcgugagccaccgcgcccggccgcaaaauuucuacucuuuccgaggggcuaaugcuguucucagcugugaaacuuuauuguugucaauucuggcauuuaauucugaauagggugccaucaccuucacuacucuauucauguggucuuucaacaaauguauugaauacuacuguaugcuauguuagggauaagaagugacccagacugcuauaagggaaagauaaaacaguaguaugagaguguauaauauucuaacguaguauggaggccaaggaaggcuuuuauggugacguuuaagcugaaauccaaaagaauuaacuagucgaaauggugaggcaaagaguguuuugauccaaggaaauaacaugugcacccuaucuacuagaagggaugaauuauuugcuugcuguccugaagguaggccauuguggcuugaaagagugugagagagagcauguagggcaagaugaggcuggaagaguaaguaaagaucagaaauuucaggcauuguaggccauguuaagguuuugaacguuauuuuuagagcaguugcuaaugaaguauaugaagcagggguuauaggagcagauuuccauuguuaaaagauagcuaugcuucagaaaagagaauggugagagggccuguaguaccugcagaaauaccaguuaagaggcuacugggaggcugaggcaggaggaucacuugagcccaggaguuuagccugggcaacguagugagaucucaucucuacuaaaaauuuuaaaaauuaacugaguguugcagugcgugccuauagucccagcuaccagggaggcugaggcaggaggaucgcuugaacuggggagaucgagacugcaguaagccaugauuguaccacugcauuccaaccugagcaacagagugagacucugucucaaaaaaaaaaaaaaaaaaaaaaaaaaaacaaaagaaguucuaggcaugauaugauaauguuguuaucuuagguuagugaggugacagugaagaaagauuauaacugaauuauaauuuuuuaaaguaaaaucaacagaacuugguauggaacuauuuaugggagaugaggaagagaaaaacaacuccuagauuucugauugugcccugcguaugcuaaggaaauacucagaagggaccaguuuuaggaagugcauuugaggcaccuaggccaguugaauuugaguggucaggucaagaguuuuauaucugugaaucacaagcauagauaggcaggcuaacuuaggguuucaguuaucugaggaaaauagagggcuuuguuguuuuauuugguagccauuagcuauguguguaucuggucugaauugagauguguuauagucuaaagacugaaaaaaggcuguaaagcauguuauuaauaauauuuuacauugauuacauguuaaaauauuuuagcuauauugugcuacauaaaauauauuauuaaaauuaauuuuacuuguuuaacgugacuacuagaaaauuuaaaauuaccaaucucacauuaguggcuugcauuacauuucuguugggcagugcugguauagaaaagcaagcuuaggauugggccuugagauaucccaauacugaaugucuacauauuaucagagucaaguucuuggcauuuucgugugaaaagacucagauacacuacauacacauaaagucuuagcauugaaaagaccuccuaggaggcugggcgcgguggcucaugccuguaaucacagcacuuugggaggcugaggcagguggaucaccugaaguccgggguucaaaaccagccuggccaacauggugaaacccugucucuacuaaaaauacaaaauuagcugggcacauuucuguaaucccaacuacuugggaggcugaggcaggagaaucgcuugaaccugggagguggagguugcagugagccaagaucgcgucacugcacuccagccugggcaacaagagcgaaacuuugucucaaaaaaaaaaaaaagaaaagaaaaagaccuccuagggaauuuuaauguuucaaaauaagaauuuuucuuuucccacaaucuccucuuuaaagaggccaucauugaaaguaguuuccagcaauaauaaaaaaaaaaaauaguaguagaagaggaggagccauuacuuucauuucuguucauucugaagaaacagagaugacucuuucuguauaacucaaauucuuaaaagaaacccuugauauauagugucaauuauaugaacucuaccucaggguaccuaaaaaaagaauguuugguuacccgaaugagggggagguuuuccuuuagagagaaguauuggugccaacaaaugaaaaaggaauaguuugaacaccacauuuugcaacuccuaaugaaauaauggauuuaaagaauuaucgauggcugcuuauuugacaaaaagagacaccugacauugugccacuucagagaacacagugcuuaccuagaaguauucuuuccaaaauuuaaaaaaugaucuaaucuacauauaaucaggcuucuagauccaacuacaaguuuauaggaaauauaaagacuaucucaugaaaauacaaucagcaaaauccagaauguguuaaacucuacaggauaucacuucauuucuuuaacaaauaauugcauggaaaagagggagguggacugaagggaagaaauauggaagggggaaacuacagauucagggacuuaguuuauuacaauggaccuuuuugggaucuuauaaagcauauauauuuaucagguaauuauagaaauuugaacacugaugaacaucugauuaguuauuguugguuuuuaaauauaugauauuguauuaugguuacauuuaaaagaguccuuauuuaucauuuguuuguuuguuuguugagacauagucuugcacuguugcccaggcuagagugcaguggcacaaucucggcucacugcaaccuccgcccuccagguucaagcaauucucaugucucagccuccugaguagcugggacugugggggugcgccaacaugccuggcuaauuuuuguauuuuuaggagagucgagguuucaccauguuggccaggcuggucucaaacuccugaccccaagugaucugcccgccucagccucccaaauugcugggauuauaugcgugagucacugcgcccggccauuauuuaucuuuuagacauagcaugcugaaauuuuugcagauaaaauguuuugcuuaacaauaguucaguagaggacaaggguaaguggguagggauacagaugaaauaagauuggcugugaauuaagaauuguuaaagcuggaacuuugggaguuuauuauacuauuuuuucaacuuucauauguuugaaguuuuccaaaauagugaaugaguaagaacacacacagacauuauacagaggggaagugucauuaaugauuuuaucuacuauaccuuuuuguaucagaagaucuggagaagaaacagaaauauuaaaguuuauuuccaugaauaaucccuuuacuuucauaaauaucugcugggccuggugauuugaccaguaaaugggauuuaucuuuuuguguagccaauaaauuggcucuuuaaucuuuucucauucacguuaacuuucucuuacccuguaaaguguguugaauuuaauguuuauuauuccuaugaguuggggaauugguauaaaauacauacauaaaacguguaagaaaaauuauaaauugaacaccuauguaaccaucacccgggucaagaaauaggacccuuuacauguuucaaagcugugugguaaaaaaaaaaaaaaaaaaaaaaagaaagaaaggaccugggcaguacugcugacgcacaucccuucuccaccacauacuucauuccuccccucuuucauauauaugugaauauucaucacccuaauauuuauggaaaucaaucacuucuuugcuuuuuauuuuuucucuucucuuaacgguauaguuugucuucccucucguguucuucauacuuuuacuguauauucauguauguauaauauuauuuugcacauuugcagacuuaauuagcacuauuccguacguauucuucuaaacuuaucugcacucugcaucccauaggguuuccuuuauacugauauguguagcuguaauucauuccuuuuuuaacuacuguauaguauucuauuguaugauugcaccaccaauguauucguucucuuacugauggacauuuaaauuuuuggaaguuuuuugcaguuauaaacaaagcugcuaaggauauucuugugcauaucucuuggugcauguauaugagaguuucaguagagcagggguuggcaaacuggcccacaggccaacugccucuguuuuuauaaauaaaacuuuuaaacaguuauucucauuuguguauauauugucuguggcuguuuucggcccauaaugguagaguuguguaguuggcaacagagacauuauggcacacaagccuaaaauauuuacuacauggcccuuuaagaaaaaguguccuggcugggcgcgguggcucacaccuguaaucccagcacuuugggaggccgaggugggcagaucacaaggucaggagauugagaccauccuggcuaacacagugaaacccugucucuacuaaaaauacaaaaaauuagccaggcaugguggcgggugccuguagucccagcuacucaggaggccgaggcaggagaauggcgugaaccugggagguggagcuugcagugagcugagaucgcgccacugcacuccagccugggcaacagagcgagacuccgucucgaaaagaaaagaaaaagaaaggguguccugacaccuacucuuagaguguauagcuuggaguagaauuauuagaucuccucagcaaggguaaucaucaacuguacuggacuuggcaaaguauccugcaggaauuauuauaugaauucuuaccuccuggucaauauuuggugguguuaaaauuuuguuuugcauucauaucucacuauuuauauugcuguuucucugauuacuagucaggcugaacacaguuucaaauguuuauugaaucuugcauauuuuucuguugauugccuguucauauuuuuugcccauauucccuauguguuuuuuuucucagagauaugugggaauuuuuuuuauauguuccagauaugaacacuuuguuggucauaugcauuaccaauauuuccucccaaccuguggcuuguccuuuaaguuuucuuagugaugucuucuaaaaaaccagaacacuuuuuauuggaaauaauuucaaauuuuaaaaaguugcaaaaauaaaaaugguacucuuaacccauuuucuguuuagaaaaaaacaaauacagcuugcugccagugcauuuuucaucaggacaaaugagaaauuggcauaccuguguagccuuuauccagucacuuauuauuuacauuuuacuccauuagcuuuauaaucauuugugugcuugcucacucuucauguauauguauguguauauuugaauaugcauauacacacaauucugaaccauuugagauuagagcacauauauuaugcuuggcuuucaugaguguauagugauauaauuuuaugaaaauuaccauaucuaauuucuuuuuuuuuuuuuuuuuuuuuuuuuugagauggagucuugcucuguugcucaggcaggagcacaguggugugaucuuggcccacugcagccuccaccucccagguuuaagugauucuccugccucagccuccuaaguagcuggagucacaggugcgugccaccaugcccggcuaauuuuuguaauuuaguagagaugggguuucacuauguuggccaggcuggucuugaacuccugaccucaagugaucugccugccucagccucccaaaguguugggauuacaggcaugagccaccaugcccagccucuaauuucuuaaugguuccucuuccuguuuaaaaguuuuuaauguuaauguaguuauuuacucaaucuuuuccuuuauggucuguaucuuuuaaauucuuucccauaucugaguuuuaaaaauauuugcuguauuuucucauaugauuguuaaaaucuugcuuuccauauuuaggaauguaaucuacuuuguuuuuuuuuuauauagugagagaugaauaccaauuuuguuuuaucccauugucccagcaccauuuauugaauaaauuguuuccuuuguuuauagugacaccuauaugguguaucaaguuuaugcaugcaggucguugggcuacgugauugacuguucauguacuuagaucacacugucuuaaaaauuagagcuuuauacuaauuauugauaucugccuggcaagucuuucuagcauguucuucucaaauuuaacauuuacuuugauaaauaguuacauagcaacaauucauguaaucaucacauacucaaaauacaagauauuaccagcauagugaaacccaugcucucaggauguugcacccuugcaguaaccuucuccuucucccaacaguugggccuuauccugacuuuuguggcaguacuuccuugauuuucuuuguaguuuugucacugauaacuucuccuaaucuauauugucuaguuuuccuuuuuuuuuuuuuuuuuugagcuuuauauucauggaugcauccaggagauauaauuuuguauacaucaggcuuccuuaauaaaacauuauaaagcugugguucauuuuuuuguuuuuuaguugaugugggauauuuuauuuugugacuauaccagaguuuauucacucugcucuaagugagcauuuuggcuauuguuaaccaguguuucucuuaauaugcauguuuuggguuaauuucagguaauacauguaggaguagaauuguuuuucccuaugguauguuuaucuuccacuuuaacauggaauggcagacucuuuuuucuuuucuuuuuuuguuuuuugaaacggaguuucacucuugucacccaggcuggauugcaauggcgugaucucagcucacuguaaccuccgccucccagguucaagcgauucuccugucucagcgucccaaguagcugagauuacaggcacccaccaccaugccuggcuaauuuuuuuuauuuuuauuuuuaguagacacggaguuucaccauguuggccaaagcuggucuugaacuccugaccucaggugauccgccugccucagccucccaaagugcugggauuacaggcgugagccacugugcccagcuggcaaacucuuuuuucaaaguaguuuuaucaauuuacauuauaaccaacaauguaugagaguucccauugucugcauccuugcgaacacaugauauuguuaguauucuuaauucuguuuugguagggggauaguaguauuuuauuuuggcuuuaguaugcauuuaccagaugacuaaaugaagucaaauaccuuucauguguuuauugaucacuuagauauccucuuuugugaaugaccuauuuaagucgugcuggaguuucuacuucuuuggcuuaauaacuugaagggguuauuuauguauucuagacaugcguucuuuauauguuggacagauaucuccuuccacauuguggcuugccuuuucacucucuuaaugguguuuuuuuguuuuauuuuguuucuugaugaacagaaguacuuuauuucaauguagucaaaaguuaucaaauuugaauucaugcucaaucauuacuuaccuacuaugugaccauggccagcuucgagcuucaguuuacuuaucuguaaauaggugguaauaauauccaugucauuggguaauugagaagauuaaauaagauaaagcacuuauuauagagcuuuuuaccuagcagucccucaauagauguuaauugccuuccucaucauuuagggugcucauuuucauacugucuuuugggaaauuggguaguauucaugagcuauuugcaaaugaauguuuuggaaauuagaaucucauauaauuauccuaggaauuuagaagauugccuaaaauaguaaaucauaauuaauuugcccagagaacuaaaauguaauauuuucucugauguagaggauuuacacugaauaugggauccuuguauaauaaaacucaugacuggaguaucuuauccaggaaaugagaagagauaauaaaaaauagucuaacccuucuacaugcaucauauuuuaaaccaagaguaguucucuuugccuccaagagaaaacaagguuuauuaaauagugaaaaauugcuaaucacuccagcccaaaguaccuucucucuccuaggaacauuuagugccuauugaugauuuucauuuucccauauuucaucauucaacaauaauuuguaggacaucucuuacuaugcuuacuaugcaccaaguauagacucauucuuugugugaauggagcuaagaaugaagaguggaagauuuuguaaaaaagauuuuaauuauaacaccaugccaaaaaauuucaaaguucugcuacugguaauggcggaauuguucauaauguaccaauuuucccacagguaauucuacucuggaugaagcuuauacuauaaauauuuaguacauaaaaucuaaauguuuauauacacacacauaauugaaagcacacuuuaaugcuucaaaacauaaucuggccagaccuggauggcucaugcguauuaucccagcauuuagggcuguucagacaggaagauugcuugaggccaggaguucaagaccagccugggcaacauagugagacccccccaucucugaaauaaaauaaauaaaauaaaauaauaaaauaaacuaucugaaggcacuggagaccaaaccaaagugggcagaaacucacaggaagucaacauuuagaauaaagaaaaagcauuugaugacuuuaguuuuaguauuuuaugcuugagggcaguuacuaauggcuacaccaugggggugauuagaacucggaaaucccaauucuuacugauuuggggaaucagaaaauagaggcuacuauagcaccuggaaagugaagggaaauucucagagggacaucccaaguucugcauauaaaugauugucaaauauuugauccuugaacaaaacgugaacauucuucagaggaacauaauggaauccauagccucuaaaaaguaucauucacaagauguagaauacaauccaaaauuaccagauauaaauaaaaagaaacuggaaacuuugauguauacucaagaaaaggcaaccaagggacacuaugggaugacccagauauaguaauuagaaaaucaaaaaaaaaaaguuuuuuuguuuguguguguguguguguguguguuuuguuuuguuuuguuuuguuuuguuuugaggcaggagucucacugugucacccaggcuggagugcagugaccauuuacaggcauaaucuuaacucacugcagccucgagcuccuagacucuggugguccuuucacuucagccugccaaguagcucggacuguaggugggugccaacacaacugacugacaaggauuuuaaagcuguuauuaguuaugacuaugcucaaggauauaaaauggcauacaauaaaauaaauaugaaacuugcuggagaaauaaaacuauaaaagagaacuaaauggaaauuuuagaacugaaaaauguaauaucuguaauaaaaauucacugugugaccuuaauaacagauugaaaauaucagugaacuugaagauccaaaucacucaaucugaaaaacagaaagaaaacuuuaaaaauaaauucaaaagagcagugccccagugacucauugaacaauauuaagaccuaauaugugucauuggagucccagaagaagagaaggaaacuggggccaaaaauauauuuaaagagauaaugggagagaauuccccacauuuagugaaagauguaauuguacauauugaagagauucauagccaaauugaugaaaacuaaugauaacaauaaaaaucuuauaaauaguaacagaaaggaauaauaauaaaacugagaguugacuuauuagaaacaauggaggccaaaugcaguagaacaccaucuuuaaagugcuuagggaaggagagcuuuggggaaagcugggaaucaagaauucuacauccggcagaaauaucccacaggaaugaaugccacaugaagauuauuuuagauuuuaaaagugagaaaggaccagaugcgguagcucacaccuguaaucccagcauuuugggaggccacacggcagguggaucacuugaagccaggaguuuugagaccaaccugccugaaacccugucucuauuaaaaaaauuaaauuuaaaagagaaagaauuuguugccagcuacccuccacuaguagaaaugcugaaguaaauucuuugggaugaagggaaaugauauaccaagucaaacuccuguuuucaaaaaggaaugaagggaaaacuugucuuauuuuauccucuuuauuuguuucaaauguauaugauguugaaagcaaaaaaaaaaaaguaacauugggugauuuauauguagauauaauacauauggcaacuauaucagaaaggacugggaugggcagguaaauagaaucauuuggugacaaguuuuuuacauuuuucauaaauuguaugauauuaacucugaaauguuaauaucugaaaauguaaagguauauuucaguucuuagaacagacacuuaaaaaaaaaagacaaaaaaacauaaggacauaaaccuaaaaugcaauagagaaauuauauuggaaucuuaaaaauauuaaauuacuccaaaggacgaaaggacggacagaguaauaaaaagcaguaauugaaagaucuaaauguggacauauugauaauuacaucuggccagguccaguggcuuaugccuguaauccuagcacuuugggaggccaaggcaggaggauccuuuaagcccaagaguuugagacaagcccaggcaacauagcaagaccuuaucucuauaaauuaaaauauauauauauauauuagaaaaacauaauuacaugaauuguguauauacagaacacuccaauuaaaaggcuaaaaauaagcaugugaaagcuggaguagucauauuaaucagguaaguaaacuuugagacuaggaauaguaguaacagagguaaacaaggauguuucccaccgggugcgguggcuuaagccuguaaucccagcacuuugggaggccgaggcgggcggaucacgaggucaggagaucgaggccauccuggcuaacacagugaaacccugucucuacuaaaaauacaaaaaauuagccgguccuggcgucaggcacuacuuaggaggcugaggcaggagaauggcgcgaacccgggaggcggagcuugcagugagcuaagaucccacuacugcacucuagccugggcaacagugcgagacuccgucucaaaaaaaaaaagggauguuucagaaagauaaaagggucaaguaaacaacgaagguacuggaaucagaccuucaaaauagauaaaaacaaaauuugacgggauuaaaggaucuccucaucauagagaaguccacaaccauaauuggaaguuugaauaccugucucaauaauugacagaaguaguagauuaaaacuaccaguaaggacauagaagaucagaguaauacuguauguaauaccacccaccuugacauaauuggcauuuauagaacacaaaauccaauaauuauagaauaugcauucuuuuccaguauacauucagcaagauagaccauauauaugguggaccauaaaauaagcuucaaaagauugaaaucuuagacuuuguucuuugaucauaauagaauuagaaaucaauaacaaaaaaucuggaaaguucucugaucacaauagaauuagaaaucuauagcaaaaaaaaaaaaaucuggaaaguccccaaauauugggaaauuaaauaauauacuacuaaauuaaaaauucauuaaacuuuuuuuuguuacugcuugauuagcuaauuguuacagaugauucucugauuuucucucugucucucucucucucuuucuuucucuuugucuuucuuucuugagacagagucuugcuuugucacccagguuggaauguagaggcacaaucaugucucacuguagccuuggccucccagacucaggucuuuuuuuauccucuuaauuuguuucaaauguauaugauguugaaagcaaaaaaaaaguaauaaugugugauuuauauguagauguaauacauauggcaacuauaucagaaaggacugggauaggcagguaaauagagucauaugguuacaaguuucuuaacauuuuucauaaauuguaugauacuaacucuaaguagaguuaauaucuacuagagcuaauaucuacucccauguauaguuccuaaggucccuccugcuucagccuccugaguagcugggaccacaggcguacaucacuauggccagcuaauuuuuaaauuauuuguagagacagugucucccuauauugcccaggcuggucucaaacuccugggcucaagugauccuccugccucggccucccacagugcugggauuacaggcaugagccaccacaccugcccucuaauauucuuuuauuaaaaagagagaaaaauacacaaauagaagagauugugacauagaggugaaauucucucaguuuuguguguguuuuccucuugaguuuuucucccauauuuaggaaaagaugaauuauaaacucuuuaugugcaacuucuuuaaauauagcauauaugagucuccacuucguauauagugucaagcugguacacaaaacagauucucagaaaauaaacuaagaaaauauuccucaagucucuauaaauacauauuuuaucacaugugauuguacuauaucaaucucauuuugaaucucauuuugagagaugcacuuacacuguuugguauggcguuuuguauuacaggaaugcuuuucaggacuagcaguugcuaagggaaggaaaugcuuaagcuugucuguaaacauuaacuucagcauauacacauuaauaauggcuuccccaccuguaaccaaccuacuuaccuggcagguuuuauuuccuaggcuaaggauuuuugagaacucuaucauaaaacagcugaauuaugaccuccuuugguuuuuacaauaugcaaauacagcuaaauacucguuaauauucugcauuuaaauucuucuucuuaauaaagacaugcacuuuauuccugcucccacguaugguuccuaaggucccagaguucagacuuccuuacaauuuuuaauucucuucuaucuuaaaccuuuugagagcugagcaauaagcuuuucauuuucuucagaaucagcuccagucucaggauuuugaggccaugucaguagaguaagaauguacccuccauguuuucuaucaaaaauaaaauauuaacuuguuuaauaguuucaguuuugccagaugaaaauaauucuggugauggcugcaaaacaauuugaauguacuuaauaccacugaacuguacacuuaagaaugguaaagaugguaaauauuauguuuucuauauuucaccaugauuuuuuaaaaguuuaaacaaggccgggcaugguggcucacgccuguaaucccagcacuuugggaggccgagacaggcggaucacuaggucaaggagaucaagaccauccuggcuaacacagugaaaccccgucucuacuaaaaauacacaaaaauuagccaggcgugguggugggugccuguagucccagcuacucaggaggcuggggcaggaaaauggcaugaaccugggaggcagagcuugcagugagccaagauccugccacugcauuccagccugggagacagagugagacucugucucaaaaaaaaaaaaaaaaaaaaaaguuuaaacaagacaggaggaucaccugagcccaggaguucaagaccagccugggcaacaaaaugagaucccaucuuuacaaaaaaaauuuaaaaaucagcagggugugauugugugcuccuguggccccagcuacauggaagcaucagugagccauguuuuugccacugcacuccagccuggcucuggcuuaaaaaaaaggcggggggagugaggggguaagaaaagagucaagaagaccugaaucuuuuuuuuuuuuuuuuuuuuuuaaugaaaauggcauuuguuccagaggcaagaguagccuccaaauuaguagaaugccagauggagaugugggguggggugggauggggagaaagguguugaagcaacucaaucaugcuacuacuaauaguuccucuuggguugagacuuaggaugguauuaaauucaauuguuuucuuuucuguuguuuuuauacccgugugugcucuugauauuauauugaguuggcguaguugcuugcagucaguagauaagaauaguaaugggauaauauguaugaaaaauauugacagcacaauacuuuucucuuucauggaguucagacauaauuugggagaaauaaagauagguagucaaugucuauccagcacauccuaaaauuuauguucauuguuguagaaaaauguauauaaucuaaguucccauaguuucaggagaaaacaaauuguaaauuaaacuuucuguauuuuugcuccauaccccaagauuuuacauaucuacaucuaacuauagccucuucaaguacuccuauuguuugaaaacagaaaacuuuaaaauggaaaagugggcuccuccuuuuguccuuucuuacuugaauuuucuauuuugaaaagaauaauaggggagaauuucacagggcucuaauuuauuugaccccucuuuuuccuguuuuccuauuaugacuuuaauaauauacuuuuauuugaaaauauuucuaagagucacuuuuuuggggagaagaauuaguaugcaguuuuguuauaggcaccucaguuagaucauaguaauaauggugauauaagagaaaaacaauucugacucuuauaaaauuaucagaagggaaauuuuccaguuuauuaaaacagaaaggacaguugguuugguuuagucaucaaaauaaacucugacuaacuagauucccaaguucuauauugugcuugaauuuuccauugggaaugaaacauuccacugcccuuuuuacuguuuaacuuaagcugcugugaacacucagagaauggcccuguggcugagcugcuuauuuuuuuuuuuuaaucuauucauuuuauacuuucagacagauuuuucccuggggugaaacaaagguuaacugaaauuuccucuguuguguaccugaacgaaucagcaguucgagaaggaaaucccauugaugggccaagagagugacaggcucuauuuaaagaauucccccgacugugugguagaccagccaugccaugaauuuaacuguuccugugguccccauacuuguacccaccaaaaaaaaagagagagagagagaaagcgacuuuguucugcaaacguuggccuaagcuuugaaaaccaugagccauugaguuuugugaauucaaguuagacaguaacagaggccaagacucuaagcgaacaauaucugaaaaggaaguacacaaaaacagguagaaacuguuuaacuguuuuauuucucuguguauauacauauuuauguguguuuauacacacaaaaaaauaccuuuuuugcauuuuauguagccaguccuaauuacauuugaucaauaguguuuguuaaauuuuuuuaaauauguaacaaauaugaagguuuuucuuguuuuuacagcuuuuuugcuccauaaaaguauccugguuuuuaucaggacauauuauauguauuggaaaugaaagucagcacggugugaguuuaaaugguuaaaaaaaaaauggauuuuuauauuaccucugcaggagcuucuguuaggaccagcucauguauuuuguauuuuuucuguauaagggaaacugcuuuaaauaugaaaagaugguaucuuaaguuggauuaaacauccguaauucauguguauuuaaccucaggacuugugagccuuguugaaaaauccagcuuuaaaccuucccuguaggccucaauagugcauacugcauugggauuauaaauagucagucuguuucuggaguguagguuaguauguauucccaggaggcaugaacuauuuacauuucuaacaaauguuucacauauguugcugauucauauuucuauguacaaauuuaggcuuuaauuuuuuuaauuuccuuuuuuauuagaaguuuuguuauaaaaaguuucuuaaguguuucauucuuucuagcauggguggcuuaaggagauuggaggggagcguuucauuuauuuauauagagauuuugauguuuugaaagacaauagaauuaauagagaaaauuguccagauauccagcgcuuggauuuuuguuugagaaguuugaggaagcagaugccauuugaguugguuucuauggaaaaauuuaucuuagagaugauguagggcuauauuuauguucacaaaugagaaauugaagcugagagaaagagaaaauguuuaauacauaauuacucaauaugucuuggaagaaccuagguuuuuauucauaccugguguuucuuuauaaacugccucucuuuuaucuugagaugguauuuucgaaauuauuucucuuucucauuuucuucuaccauuuccugacauuuucuugucuuuuguucuauucuucuucgucucuuauuuuucuauauugguuguacuguaaauagguugcuagcaacacaccuuaggagcaggcuuuuggggaaugggucuaaguauuccauuuggccuauaauaggcuauauuguuguuuuggaauauaauuuugaaaaaaucaaauuuauauuuauccugcuaguugaucaagcuauaaaucaaucaauacuuacuaguugcugcuuauauaaauagaagaguuaaccagugacucagacagaugacaauugacuauuaaagauuuuuuuaaauuggcauauguuuaggaaaaucacuuguuucuucaaaauuuauucauuaagcaguauuuuuugagcacuuacuaugugacaaacaccacacaggugauagagauacaacagagaggaagauggaacugguuccugucuccuuacauccugguguaauuauauaauaaaaguuaaccacaaguagaaacuuggggcauuauuuuuguaaaaucucagucaaguuucucucuacauagaagacuaguauaacuucagauaccaucauucauauccauaucagaauauaguccuauguuaaaaguagaaagaugcaauuuuaaacauguuuucccauuaguaauugucaugugguacaugaugaaaugaaauuguugaaaugaguaccaguaauuuuauuauuagagaaagucagaacacuauuaauaaaauaauuuagggagauuauauagcauauugguuaagagcaugguuuggauguaaacauggguuugagcccucuagucugccacugagaagauuuuugguauuaaaucaauuauuauucauauuuuuaugaauucauaaaccucaccuguucucaucugugaaauaaaauuguaauaccuaccuuuauaagauuguuaugagaguuaaauuagaaauacaggcugggcauaguggcuuaugccuauaauuccagcacuuugggaggccaggguggaucacuugaaaucaggagcuugagaccagccugggcaacaugguggaaccccaucucuacuaaaaacacaaaaauuagcuaggugugcuugaauucucagcuacucgggaggccaaggcacaagaauuugcuugaguccgggagucugaggcugcagugagccaagaucacaccacuacacuccagccuaggcaaaugagugagacccugucucaaaaaaaaagaaagaaggaaagaaaagaaaaauacauaaauguuuaacuuaguaccuggcacagaauaagcucuuuauauguauuagcuguuuuuauguccuauauucuuuuuuuauuaauuuaaucuugauucucuuuuucccucccucccucccccccguucccgcccucccucccugcuucccucggucccucccucccccuucccucccucccucccccccucccccuucccucccucccucccccucccccuucccucccucccuccccucccaccucccucccucccuccccccuucccucccucccucccccuccccccucccucccucccucccuccccccuccuucccucccucccucccucccucccuuccuuccucucugcuguuguugaaacagagccucucucuuucauccaggcugaagugcagugguguaauuacugcccacugcaaccucugccucccgggcucuagcaguccuacugccucagccucccaaguagcuaggacuacaggcaugagccaccaugcccagccaugauuuucuuucucuagaaaagucuguuaguggggauuugaacauucuuuuuguauuauacauauuuucuuugaggugucauacauuaaaaucaauuucuucaaaaaucaggaugagcauuuguacaaaaguauacagucaacuaggaugagguuuuuuaaaaguuguuuuccuuuuaacauaaaguuguauguaauaauuuccaaucccucgugccuucuugcuuccuuucuggcaaucucaacuucaaaucaguaauacuuauuauagguacauugguaccuauaauaacaaagcgacuuuguucugcaaacguuggccuaagcuuugaaaaccaugagccauugaguuuuaugaauucaaguuagacgguaacagaggccaagacucuaagcaagcaauaucugaaaaggaaguacacaaaaacagguagaaacuguuuaacuguuuuauuucucuguguguauacauauuuauguguuuuuacacacaaaaaaguaccuuuuuugcauuuuauguagcuaguccuaauuacuauuauauacuuauuauagguacauuuauguagcuaguccuaauuacauuugaucaaugguguuaaauuuuuuuuaaauauguaacaaaugugaagguuuuucuuguuuuuacagcuuuuuugcuccauaaaaguauucugguuuuuaucaggacauauuauauguauuagaaaugaaagucaacacagugugaguuuaaaugguuaaaaaaaaaaaacauuuaaccauuuggacuuaaagaccuucugucaauauucugucuagaggcugggugcaguggcucaugccuguaauccaagcaguuuggaaggcugagguagguggauggcuugagcccaaaaauuugagaccagccugggcaucauagcaaaaccccauauaacacaaaaauauaaaaaauuagccaagcauggugguacacaccuguggucccagcuacucgggaggcugaggugggaggauugcuugagcccaggagguugagccugcaaugaggcaugauugcaccacuacacuccagccugggugacauugugagaccuugucucaaaaaaaaaaaaaaaucuaucuaucuaucuauauagauagauagauagauuuuuuuauagguagauagauuuuuuuuuuuuucuggagcuaaauugaaacccaaguagcuuugggggcuuguuauccaucuaauauacaaauucuuccuucuauaccaagucaugucuugccauaauagaagguagaacuuuuaaggagauaggguaccacauuauggugaaugaauauuucuuuuguggucaaaaucaucaaacauuugucuauauuuacugccccugaauucucuccuucaguucucuuuuuaauccagccagguuuuugcaucaccauuccauccaaacuucucuuaauaggaucaccagugacuuuccuaauaaauucaagggucaguucucagucuuuuucuuaccugcccuauugguggcauuuaccauaaucgauaacaccucuucuuugauagauacauuguguuuaguugguuacggggcacugaccuauucccccaccaaguuuccucucaccucacugguuacuccuaaauucuugcucauguucuauccuuucucuacacucaaacccuugguacucucacccaguccuguucuaaauaccaucuccaugccauaauugacaaauuuuauuuccgguucagaucugucucugaaacuuaagacucauaauccaguauccaauggcauacuccacaucuucauuugaauauuuuaauacuauugcuaauccagccuguccaaacuaaauucaucuuucccucaaaacauguuccucugcauuuuuuaguugcaguaauuaucauuuuaguugcugaggccaaaaaccugguagucaucuuuuacuguguucuucuuuuacuuuuuuuuuuuuuuucugagguggagucucgcucugucgcccaggcuggagugcagugguguggucucgggucacugcaaccucugccucccggguucaagcaauucuccugcaucagccucccaaguagcugggauuacaggcgccugccaccacaccuggcuaauuuuuuguauuuuuaguagagacaguguuucaccauguuggcccggcuggucucgaacuacugacuucgugaucugcccgccucggccucccaaagugcugggauuacaggcaugagucaccacgccuggccucuuuuacuuucauauccaguucuucaacaaaucuuauuagcuuuaccuccagauuauauucagaauuccucuacuucucagcauacccacuacuccacccuggucagagguacuaucuuuuuuggacugaauuauugcaguaacauucuaacugaucuccuugcuucuauacuugcccuucccaucuauuuuuucuucucaguggagugauucuuugaguuauaagucaaaucauauuacucuuacgaguuuuuguuucacucagaguaaaagucaaaauccuuauaauggccuacaaagcccuucauaaacuaauaccucuguacucuuaucuucacauucccuucauuuucugcacucuagccauacuggccugucuccgguuccuuaaacacaucaggaauauuuuugccuuaagaacuuugcuuuggcugugccuacugccuagaaugcucuuaccgcagaaguacauggcuaauucuuccaucuccuuuaaguuguugcuuaaaugucagugaaggguauucugucuacccuauguaaaauuauaacccguacccaauuuccauuacccugcucuacuuuuucuuuuuuccaaagcucuuaugccucucuaauguacaucauuuacauauuuaauauguuugguuuuuaauuguuucacuuucccacuagacgauaaguucuaucaaggaaagcaaugucuauuuuguucauugauauguauaucccaagcaucuagaauagugcuugcaaaugauaguaacugaguuaauauuuguugaauaauaaacgaaugguaaauauugggaauaauuguaauguuuaguuuaacccugaauauaccgucagguuuauuggacccaauuuuaguuugaaaauuuuuuuuuauuuugaguguuucuaacuauuuguaagaauugaggccaggugcaguggcucaugccuguaaucccagcacuuuuggagaccaaggcgggugaaucacuuaagcccaggaguucaagaccagccugggcaacguagcaaauccccaucuguacaaaaaauacuaaaguuagccaagugugguggcaugucgcaguaguaccagcuacuuggagggcugagaugggaggauuguuugcacccgggaggcggauggagguugcagugaguugagauggggcuguuguacuccagccagagcgacagagugagacucugucuccaaaaaaaaggaauugauaguacauacuuugauucuuucuuaaacgucuuccaaagacuagagaagaguuuuacuuuucuucacaauaaaacuaauucuguuucagaauuacuguguggguacauuggacccuuuuauaaaucuaagauacuucauggccuccugccauaucuugaaaaacuauacuguuucaucauccuaggaauaauuuuaucauuacuuauucauuauuuccaguuguacugaaaaagacuaaauuauuaauuuuuuaaaaaaacagaagaaugaugaaauugccuagaaggauaaugcaggagugacaugaaucaucacuguuacaucauccuucacuuuuauuauugugcugccuaaaguauugcauuaucuuucaagaaugugcaguagaagucuggagacacacugucuuuauaaucuucuuucacuuucauugaacaaggcugagaauucacaauuuuauauuuuccacacaaaauggcaaauaggaaauugacaaaacauguuuucacaauuuuuagaugaaucagaagaugaaugcaaagaaacacguagucuagguacuagaaccuaaugauguaaugaacuucaucuuuuaaguaauucucagacuacgauuuuucaguggauauugguagauguuuuuucuaaaacucaagaacugauaagugaaugauguauuucuguguaaaaaaaaaaagcagaguauucucauaguuacucauucaacagaacauuguucaucacacaauauaugacaggaaucugaaucauccugcuuugauaaggacaugugauuuuuuuuauauuuuaugauauuugugcaucuaaauuuacuucaucugguuucuaucaaaugggcaaaugcuguagacagguauauaugcaggggcgauuagaaggaaauagaugauauagaaaugaaaaauuuuuuuucaauugaucauucugauuguugcuuaugaaucuaaaagugaaaauguuuuacaguuuuuuuguuuuuguuuuuguuuuuuugagauggaauuuugcuuuuugagauggaguuuucucuuguugcccaggcuggagugcaauggugcaaucuuggcucaccgcaaccuucaccuccuggguuccagugauucuccugccucagccucccgaguagcuaggauuacaggcaugugccaccauacccggcuaauuuuguauuuuuaguagagacgugguuucuccauguuggucaggcuggucucgaacucccgaccucaggugauccgccugccuuggccucccaaacugcugggauuacaggcgugagccacugcgccuggccauguuuuacaguuauuaagcaaagaagaaauauauuuaaaaucugauaugaguauuuuuaaacagauguaaucuagguucaugcaugauaauugaugaguaguugcauuccacauguugcauauuucagguauguuuauggaauaauaugcguuugcugucuuuauagucucauuaaaaugucuuauaaaauuauuuuucauuaucucuuuauucuucuauaaauuaugaaaugacuuaguuuauuaaaaggucccauuggacccagauagugaauggugaaaacuauuuuuccuaguauaaaggagcaggaauauaaugaaaaggcacuagagaugugaagaugacuaaacuuggagagaugaaguacugguggcugguaggguaguagguagacuuuuuaggccaaguaaaugaaacaacuaaacugcuauuaaauucagaaaaauuaaaauguuguguaagaagaaaaauaauguacuucauucacuacauagucauuauauaaauugaauauaaauuuaaccugaggauggagggagaagaaauucagauaggguguuauaagauaauuaaauccucuuuuauuaugaauuuagaaauuagauagauaaauccauuaaaaaaaaacagaaugaacaugauuuagaaauauucaaguaaauaccaaaagaaauagcaagagguguaagugguugccucuugggaaugggagcuggcauaaggaggagagaacugguauuguuucuuacaugguauuuuaguauuuuuagaguuuuuaaaaaccauguguauugcuuugauaaaaauuaauaguaaaauaugaaacuggauuuagagagaaucucgcugguauguaucaaaugaaauugaaggcacagggaaaacagucuuagaucucaggugaugaacaacuguaaugacuggaagggggaaccaaaguacuggcuuggaaagacauuuuaaaggaauauaauguggaauuuuaagaccuauucugauuggacaaugggagugaaauauuagguuaagaugcaaacaaaccuguuuugaggcacucauaacaauaggggagaagguauuuaugcccauuucaaguggaguuggaaugguagguugugcuuuggauauguuauagcuugcaaugaauguaauauaaacauuugugauauauccuguaaacaguuugaagugugagccugaacauguuugaucuaaggucuggaggaagaugugaagcaaaucugaccuaaaaaaaauuauaggaaaaaagcaaauuguucuggauuuguuucaccaaggaacaaguaagcagagaaccagacacuggagaaaaaaaggagucaggaaguagacaaggaaauguuaaaagaaauaauaggauaacugaaagaauguagcuuccagauugcuagcuaucagcagauagauagaaacuuuuauacagccuuuaaaucuucccuagaaaccuuuuuaaaaguagcuucuugauuagauuuaaauggguuuuauuuaugcuugucauuuuacagauauuguaaauauacauaugguauauuuucuuuuugccuuuuguggacaguuggagguggggaacaggcauccauagucaguauauuuaaaggaagaaaaaacaacuuccauaaucuuguuauauugacuguuucuguugauacauuuucccuuucuuucuuguuucuuaguaugauuugagggucauuuuaaauuucugaauaaauauuuuguaagccaggugguucacugacugaacguuugggacagagguaaugggagaugaggccuucucucucucucuccauagacaaaggccuuaauaugacuaauaacuuagcgaaagcucuauaugacccucugcuaagcaccuguauuuauuuccucuuucuucuuccuccucuaccucuaaaaaaagaaauccccauuucuuuuacacacauguuaaaaauaaaaaauuguuucugguaaauuuaauaugauuuaaaauaagaugaacauuuugaugcuuuacuugcaaauucugcuauuaaaauguguuuuauuuaaacuauugccacuuauacagugaaaaauuuuaaugacuaaaacaguuuugugaccaauguuauaauugaaaaguauaaauuugagaaaaccaagacagaaaaagggagcaguuucagaagaauguaagugaauaaaguggcuuagcccucaggggauuugaauguggcauuguguguauuucaaaaguuuccguugaaaacagaugcugcugaugaaguugggaauaguaacuucaucuguggcuguuucaguugcuuauuagaagugagaaagaucccaagggguuuaucugguguaguggaguuaggcucaggaaaggauaugacauaaauaucuggcagcuuugucuguguggucuuuaauccauaaacacugguuagguacaagcaugauuaucuauaaacaugcaauuaucuuauuucauguggauucuguuucuaccacaguguuauuucaguaauggcaggguuguuuuuugaaguccauuuuaauucuuaagaacugguuauuacagaaauuguaaguuuuuucccuaaacaaagagaacugucuuacugaauuuuuauuauauaaugauaguucauuaaauuauuuacuggcuuaugugccccaauucagaacaguacuuauucauacaguuguccauaugaauguuuccuuuuuugcuuuuucuuuucaauuuuauuuucugauauuauucauaguauucaaguuauucugauaacuggauagauaaaauagauauggucucaguccauagagcacuuugauauagagagggaaauaaaauauuuauugacauagcccuuaauacagaguuuaaaagugcccaggauccuugaaaauauagauaagaugcuuucagacuaugacugaaggagaauuuacuucuacuacuagagggaauucaaaggagauagaaauguuauuuaauuaauuaauucaguaaauaugaauaccuaugguaacuaagcaaucaugcuuugauguuuggaagauauaaagauagaaauuacacaguuaaguccagauauuacaaaguugugagugaucaucacugcuuuugaagggguaccagauaagacuucaguggaggugaguagggacuugauggccauaucccaauuccaaguggaugaauugggggugaauucagguguuccacagaauaaauguauaggcauagcugcagagaacaacaggaaacuggggaaauuauuaggcauagcuggaacauugggaccaggaaaaugaagcaagagaaacaaguaaaggccaaaucaugaaaguaaaggccaaaucaugaaaggcacauuguauaguauacaaaggaauuuuauguguauccuguaggcagcaagggaccauucagggcagaauguauucacauuuauauuuuagaaauuacuuaaguagcaguggaaugaaaagcagugugugauaauagaaauagucagaagauauuucauaaucuggguaagauauuaagugguccugagcuaaaaucguggcauugaggcuauuuuggauacccuauuuauaguauuugauaugaaaagugagagagaaccugaguugagcuuucugguuuggaaaacagacuauggugcaagucauugagauagaagacauacaaggaaggaaaguagggguuuuguuuuuguaucuuuaaggaagagaaaauaauuccauuuuagugaauaugaguuugaaauaccugugagacauccaagaaaagacauggcuagagaagcaaauuugguaguucucacuaugggcauauaugacauaaucugggagaaaaguuguagaagaaaauggguaaaguauggaguauaccaaguaacuagugaagaggaaaccacaaagggggacaagagauaggaaagcauuuuguucuaucagccaagagaauuguaaaugccuccuagaggucaagugagaaaacugcugaauauuaucuauuuacuuuagguuggugcaaaaguaguugugguuuuugccauuacuuucaaaggcauaaaccacaauuacuuuugcaccagccuaaauacauugauuuugaggagcugagccuuaaaagauauucaaaguuugcaaucaugaaaauuguacuggguuggguggaaaauugggcaaaagguagacaguguuggagaucaagggaaugccaugaacaaaaguacagaacuggaaaagcacauuacagacaugaccuuuuguuuuaaaauauuacaaauguaaaaaagauguauaaaaagaagguguggacaauaaguuuuaugcuauuacuuuuaugguauaacugcccaaauacuuaaguuaacuggugggagaguuauuuacaaccuuuucuacuuuuccuuuuuucuuuuuuuuccuuaacauuucacuauguuuuagagcauugaaagaaugccaucucagaucagggagaguuuugguuucaugaugcaaguacaggaauagauauugagaaaguccaaaguuuugguuccuuaaggauuacagguauauaccagcuauuguuucuuuuuuuuuuuuuccgaaucucuaaccaugagcucacagucuauaauguauaggcacacagauuauuuggggauagaacaguugcuaacagaccuacacacuuaguuuuacuuacuuacuuuauuuauuuaucgcgaagguugucaugcgcugucauccaggcugcuggcacgcaguggcggcaguggcaccauguuggcuuacugcagccucaaccuccagggcucaagcccuccucccaccucagccuccauauuagcugggacuauaggcaugcaccaccauaccuggcuaguuuguguguguguguguguguguguguguguguguguguguguguguguuucguagagaugaggucucacuauguuaccuaagcuaggcucaaacaguccucccaccuuggccucccaaaguauuggaauugcaggagucagccacugcaucuggcccacacuuguuuuagaagcuaucuuacauauaggagacuguuuuagugauguaaucaucauaaauuaauuuguuauaggcagaauucaguauugcuuuuuaaauagcucauuuucccaaauaauauauacuuuuuguccuuuuuaaaagcuuguuguuaauuaaauuagccuucuauuguuaaaaauucaauuaucaugguuauuuauuuaacacagucaugcuuuuuagguagcauuagauagcacauauuauucuacuauaugguaaauucuuugagggcaagcaccaugucuaagacaucuuucugucuccaaaaaugucuuuuacaugagagagauucaguaaauauuuauugaaaauuaacuugacacuauuaaauggaaacuuuuuaaggaaaguugcauuuacauucuuaaaucaccauuaguggcaaauucaccauugauuuguggaauauuaaauucuaguucauuguaugcugaaucauacauaccuaccuuuuggugaaauauaauaaugaguuuuacaauuuuagauguaacaaauuaggauaucuggaaaauguaaggcaucuauggcuuccuuauaagaaggagcuauauggaaauuaggcugaggaaaugauucuuagucucuggcaccugcgguguagauaaccaacuggauaugcugaacugagcccucugucucaauaaucuuuggugaucuuuggaaauacauuuuacuagcuacuaccuucugucagauugucccuaaaggucaugauaaccagcucuguaauuaucuguagcuacucucuuaguaaaggaaugacgaucuucagcucuucuaacacagccaaauguaagcagacuaaguauaacuaaagcuuggggugaacuagcuucuaucuuucagaaauccagcccauauucuuccccagaacguuugaaaugugaaugcagucugauaucaguaaauagcuaaauuaccacugcaucuccaacaaaauacaagucgcccuuuuuugcccuauguuggaaagcacacacauaaaaaagugaacauuaguguaagcauaauggacaggguugcuuugaagacuaaaugauguuuaaagcaauuuauagcccuggaucaccaugcacauauaaagauguuucucauaacuacuaugcaguaauugucuguauguguaauaaagauagcagaauaguuccacaaaugggggcaaaguguaaaaaaauagacuguagguuaugggucacccccaugaccuagucaccucugaccaggcccaaccuccaacauuggggauuacaauucaacaugagauucggccaggacauauauucaaacuauaucaauaucaucaccagaugaauagcuaaacaaauuguuauauccauacaauggaauacugcuugauuauaaaaaaaugaacaaauugcuaauacccaacaacagggaugaaucuuaaaaauauucaggaggaaaugagacagacacaaaauaguacauaacguauaauuccauauaugugagguccuggaaggggcaaaacaaaucuaucgugagagaaggcaaaucagugguugccucaggugggggauugacugcacaugugcacaaaguaacauuuugggaugauggaaauguucuacauuugauuuuuauagugauuacccagguguauacauuugccaaauugaauccuacuguauuuuuacauagguacauuuuauuacauguaaguuacaccucauuaguuuccuuuacggcccugccuucuguaacuuuuuuccuucucucccuaaaauugagguauuauccauucuucugaauuuaccauagcauuuguuuggccuucucuuacucuuucuuucuccuuucguuugucaccuuguccucuacuaaggcuauaagcucuuuacaucuuucuuuacccucuagcaccuugcucauuuaaucuuccaauagauguuuguuaaacggaguugauuucauacaaagaaagaauuaccagcuacugcuuugaucacggcucugaaauuugaacagaaucacaaucccaguuaucagcaagaacaacccuauaaaagcagcuauggguugaugacaggcauucuuagggcagucuuaauuuuacaauucagggcagucccauuuaacauucuauggcauugggugguggacacauggaagaugaguguuccugggccguauggaaaguccucuuuaaggcgaauuaccuugugcuaguugcaaaggucuggaagauuuaauucagguaaauuacacaacgugacaauguauauaauuccaguaaugagagaaaauuagaaucagaaauucaguacuagaaggugccaccauggaugccauuuauucuaacccauugucauacagacccagagaucuuaaguauccugcccaacaccacacagcaaauuagcggcacaguuaacucuagaagccagauuucuaucaaguaccauacccagaauuuaacaaguuggagaauuugcuguuuguggaaguucugaggaguugcccuagacaaagcuuuccuuggggugagauuuugaguuuagacacaauagguaaagaucaagggcaggaagcugcugucauuacuagguucaaaucaaaacuggaaccuuggagccauggcagggacaagaauugccuuauguguuccuggugaugucuuugcuucauauaccacuugagaaauacugacuugaucuauuguugaaacuuaguuuguauacuuguugaugaauuuucuauaguaagaauaugaauaugcuauaacuuuuugaggaguuguuaguacaguugacccuuaaacaacacggguucgaacuucauaggucugccuauaagcagcuuuuucucaaccaaaaauggauugaaaauacaguuuucauaggcugugaaacccacguauauagagggccaacuuuuuauaugugcagguuccacagggcugacgggaacuugagugugcaaggauuugguucuaccaggguagucuuggaaccaaucccucauauauacugagggacaacuguacacaagaauauuuuugaaucccacaggauuguuaaaacaaucugaauagagucgaucucccuccuucaaaccuuccuuuuuuacuguuuucuguuuauguguaaauuuggagagugguaacaguugccauuuugcauuucauugguuuuauauuucauuuuuuaagaacaauuuuaagucagucuuauaguuaacauaauuucaaguggucauuuugaauuuuaaugaugaaagacauugagauacaaaaagcagcuuugaaaguuguagcaaagcaugcuucauacauggauccuuugaaugaaagaauaauagcauggaugguugaugaaggaauagaagcugcugcuauuuaauguauucuucacucucaguacauggauacagccuccaaauguuacaaagaaaauaaucaucagcacagcaucucugcauaccuguggauuggucuuuuuguaaagcagccucaugguuuucuuagaaaaguuuuuuauuuaaaaauauaucucuagacacuuacuccugguaggccugggaaaauguagauuacuucaugucucuucaaaagccuuucaaagaaacaagucaagcuugauuuguguuuuugagauagaggaaaguaguaagguaggaggacagaggaaaucuuagcuuuaaagggagaaaaagaucuuucaguccuuuugucaacacuuuaguuucugcauuagucauaggucccuucccccuuggccauggguggaccaaaggaauagcagccauuugcacguuugugaaaggacaguggaaagaaaagaaaauagcugauacaagaaaaugugggagauuauuucccccacuagguuuuuacaguuguauuuuuagauuaaucagugguuucuggauauuuggccuccuuuuuuuucuuuuauuuugcuguuuuugauguuauaaaauacagugcuaagaaccuaacccuauuagugagauauuauucagagucuaauuuuuuuauuguuauaaugaaagucauguagaaugcaaagcuaguggacacaguuaauacucauauuugguagaaauacuuuuccucuaccaagcugaguucaaauugugggccugcaaguuaacugauacuggacagguuaacuggagaaaagauaagguuuauucacacuugaaggagcacucaauaucaguaacucugaagaagaguuuagaggguuauagaaguaagggguuaugccucuugcuguggcacaccacagaugccagcacuuugggaggcugaaguggguggaucucuugagcucaggaguuugagaccagccugggugacauggugaaacccugucucuaccaaaaaaauuauaaaaauuagccuagcgugguggcaaguuccuguagucccagcuacucaggaggcugaugugggaggauugcuuaagccugggaggcggagguugcagugagccaaaaugguaccacuguacuccagucuuggcaacagagcaagacccugucuccaaaaaaaacaagaaguaaggggcuauauaccaacuuaacaagaggggguagcuuagggagucaaaggacagaaagaucucauuuacacaauuuuuuuguuaugucucagugcccagugucagucaucucccuccuguggauccuccuggaggugugagaggguugugacagcugccucaguaaagcucugcuuuagucagauaaaagaaguuaagauuucauucugcaucugcuguuguauuuuugggcccuucacugauuuuuuuuuguuuuaauauuuguauguagucugaugcuuuucaauguauuuucacauaccucauuuuauucucacaggacuuuuuaggcagacagggaaaauacuauuaucccauuucacaggucagaaaacugagacucagagagguuaaguauuuguccagggccacauaauuaauaacagagccaaaauaggaauuucagguauucaacauuucucaguguaccuuugggguccaauuugaguacucauaaauuguguaaucuauugucaaucuauaaguccuuuaaaagugccacgguuaaguaauaauuuauuuguuuuguaggagaagaugguauaaacugguccaucagugacaaagacauugagguaaaaucaaauuguuuuuaaaauucagaauaauaauuuccuuugcuucauaguuuauuaugauaacuuuuggaacauuaauaaguuuaaguggcuuauaagaaaacauuugauuuuagcauaugagugauuuaacucuucagaaacuugguucagccuugaguuuugucagugaguuaauagcuguaaucauccaguccccuuucccuuucuguuucucuccugcggugaguccucucagcccauauggccugguaccacuaaaaagaucaacaccggaaauaacugcuucuucaguguaaggaaaugguuagucuauuuuuaggauguggcagguguuugucuuugucgauuauuagccuuaauuguggcagaugcuacaaaaagagaauaauuuuauaacuugguuuugggagauagcuagauuguacuuacaugugguccacuuggccaguucagcaaaauaacaaauaaaagaugaaaacuuuuuuaaagauggaauucuaccaaacaagcuaaagcaugguugggauuuacaguuccucuuuagauauuccauaugauaugcauuguugguacucucuuacaagauccuagauuuagauuagaauaugggacaguuagaauugggucacucuguaggcagaauggaucuuaaaaggauuccaguggaaagaaauuaucucauuccuuuauuucuauaaaggaagacuggauuaucagucuuuuauuaucauccagucuuguaggcaguaacccugugcuguucaaaagaauggauauauuggguagcuguacuaacuuuacaaaagacaaagucauaaaaacaccauucccuaacucaaaauuuaaguagcccucccauucagaaaaacaugguguacauucaguuauagaaaucagcaguggcuggccgggcgugguggcucacaccuguaaucccaacacuuugggaggcugagguggguggaucaccugaggucaggaguucgaaaucagacugggcaacauggcgaaacuccuucucuacugaaaauacaaaaauuagccaggugugguggcgggcgccuguagucccagcuacucggaaggcugaggcaggagaaucgcuugaacccagggagguagagguugcagugagucgagaucacgccacuucacuccagccugggcaaaagagugaaacuccgucucaaaaaaaaaaaaagaaagaaagaaaagaagucagcaguggcuuugacugaaugcuaccgcggugucuaagugaugcaugucaguaccccugcucgaucugaaacauaaguagagaaagauuaaaaaaaaaaaaucacauggagaaguauaaaagacucagcaggcgggaggggcagacaaaaagcaguagaguuaccuuuauggcaccuccuuuuauguuuuucuaccucuuuuuuuuuuuuuuuuuuuuuuuuugagaugaaguuucacucuuguugcccaggcuggaguacaauggcacaaucucggcucaccacauccuccgccucccaggcgcaagcgauucuccugccucagccucccaaguagcugggauuacagaccugcgccaccacgcccagcuaguuuuguauuuuuaguagagaugggguuucuccauguuggucaggcugguuuugaacucccgaccucgggugauccgcccaccucggccuccgaaagugcugggauuacaggcaugagccaccacgcccaaccucuaccucuuuuuaagagaacaagagagaucauaaaguuccccuguggcuagguucuaaguugaacagauauaacuaauaauucucuugcuuuaucaagguaauggaacugacuugaagcuugauguaucuuuauuugcuuauaguugucuuuaacaagaguaguagauggcuuuuauuuagcagugaaacaauuuuuuuaauucuugauuuuuuuuucccuuaggcccagauagcuaauaaccgaacaccuggaagauggacccagcgguacuauucagccaacaaaaacauuaucuguagaaauugugacaaacguggucauuuaucaaaaaacugccccuuaccacgaguacgugaaauaugcuuugcuucuuuccacauuuguaaacucaaaaucucaagggugaggcugggcacgguggcucaugccuguaaucccagcacuuugggaagccgaggcagguggaucaugaggucaggagauugagaccauccuagcuaacauggugaaaaaccccgucucuaccaaaaauauacaaaaaauuagccgggcgugauggcgggcgccuguagucccagcuacuugggaggcugaggcaggagaauggugugaacccgggagauggagcuugcgguaacagagaucacaccauugcacuccagccugggugacaaagugaaacucugucucagaaaaaaaaaaaaaaucucaagugugaaacccuauaaccuuagaauucaaaucuuuuuauaguauguguguuaaauuucauguagcuuacagccuagugucggagaaauaauaauaaauuuggagucagaaaaauguggaaucaauuuuaacuuaucauuacuaguuguaugggcaaaucauuuaacccucugugcuucuuguuuucuugucuauaaaaugaaaagauugaaucagaugauuccugagaccccuuucacuucuaaaccuuguacuucauaagauagcuuauuucaaugugagauaauuuuuaucguuagaaaauuauaauuuggggcauuuuuaaauguuuauuaauguaaguuacguuaagcagguacaucaaccuuuggaacaacacagaacugaagaucuuagacguuuccugaccagauaauuagcucuuaacaaacauuucuuccauuucuccuuccucuuccaaaugacugcuuuucaaauaguucagacaccucuuaugcuccuuuuuuguucuugcuucuccagucaaaacagcuucuucuguaucuguuccuccuaugacuuagcuucuagauauccuccucauucuacuuucccucuuacauaccuuucauuuugucaauauuccuauaagaagaggcauaaggaauauaugccagcugcuaguauguacagacuaagccuuuuuggcaaacaauauacauacaguguuuuggacauuuuguuugauuuuuacaguugugcucaggauucuaccuuuauugggaucucaaauuagaaaagauuuuuuuaugggauuauauugaaaaacaaauacuaaucuucuaccuuuugagacugaagagauuuuauguuuuuuucgccacauagaaaguucgucgcugcuuccugugcuccaggagaggacaucuccuguauuccuguccagccccccuuugcgaauacuguccugugccuaagauguuggaccacucaugucuuuucagacauuccugggauaaacagugugaccgaugucauaugcuaggccacuauacagaugugaguauccugcauauaacuaauuugucaggcuuuggagggagugugcaaguuuguaauuaaugugcaaguuuauaacuaucagucagcauaccuaaaggaauguuuacuccgugagauauauauauauauauauagucauguccauuuugucacugaacauguauauaaagcagugcucuaaauaauauagggguaaggagccuacugaaucagaagacagcaucaagagauagcauuaauaaauauuuuaagcccauucuagcccuuuuucuuuauaagcuuguuaaauaaaggcugaauuuaaagagguaauaaauaacauguaaaauuuguguauucauauuuauuuauuuauuuauuuauuuuuugagacauagucucacucugucacccaggcuggagugcgguggugcaaucucggcucauugcaacuucugccucccggguuccagcgauucuccugccucagccucccgaguagcuggggcuacaggagcaugccaacacuccuggcuaauuuuuguauuuuuaguagagacggggguuucaccauguuggccaugcuggucucgaacuccugaccuuaggugaucugcccgccucagccuccuaaagugcugggauugcaggcgugagccacugcaccuggccuauuugugcauauuuaaaugaaaauauaugcacaauuagcaguuauauacagauguuuaauggaagccuauuuugaugcuucuuuuuuuauuuuuauuuuauuuauuuauuuuuugagauggagucucgcucuguugcccaggcuggagugcaguggcgugaucucagcuaacugcaaccuccaacuccuggguucaagcgauucuccugccucagccucccgaguagcugggauuacaggcacgugccaccacaccuggcuaauuuuuuauuuuuaguagauacgggguuucaccacguuggccaggauggucucgaucuccugaccucaugauccgcccgccucggccucccaaagugcugggauuacaggcaugagccacuguacccgaccuuuuuuuuuuuuuuuuuuuuuuuuuuuuuuuuuuuuuuuuuuggagacagggucucgcucugucacgguggcuagagugcaguggcaugaucuuggcucacugcaaccucugccucccagguucaagugauucuccugccucagccucccaaguagcugggauuacaggcgcccaccaccaugccuggcuaauuuuuguauauuuaguagacagcaggguuucaccauggucaagcuggucucgaacuccugaccucaggugauccacccauuucagccucccaaagugcuaggauuacaggugugagccaccacaccuggccugauucuucuuaucaaugauuuugcuggucuaauagucuaaggaaagaaggacaaggcagccauuacuuuaaauugcagcauauuaaaaaugcuguuuuggacacuauuugcauuguauuguuguaaauguauauggaguuuagucauaauuucaaagaccagagggcuguugaaauaagcaaauacagcuuugauguggaauauguaguuuucuacauucaguuuacccuaauuccuaaugagugucucauuaagagucuuucauuuuaggucuuaauugcguuucuuacuacauaguaacauauguuuauuuuauauuaacagcuaaucaguacaaagucauuuuucauccucauaccuaaguggcaauucuaauugauuuaagggguauuuaugaaaggggugucucucauucucuuuuuuaaagcauuacuuaccuauuuuuuaaaauaauaaaaguacuuuaauauguacuuccccaaagucaugauacgaaagcagaaauauuuuucuaauuuuauuuauauugaaauacaccuauagucuuuuuucuuacagcccuuuuuaaugcaugucugaaauacaccuauaaucuuuugcucaauaaauuaguauggcuuucuguugaaaugaauuucagauuaaaacagauuagaguaugaguguuugguauauauauguauuucucauguaaauaacaugacaauuauuuauuguaauuccaccagcaaauuuauacuuaaauuguuacccauuuuuuaaacaaacaguggugcauuuaauaauguuuugguaagucauauuuuauaaauggaauugugaaauuaaaagacguacacuuaugucuggauaaguauugucaaauugcucuucuaaaagauuguaccaauguaucuaccuaccagcaguguuaagagaaaugagcacugcacucaucaacauuaaguauuaucagucuuuaaaauuuuuggcuggucagaccaaaaaaugauauuuuauuguuuuaauuuguauuucuuugguuauuaauaaagugguauaugguuaauuaauuugaauacucuauucucaaggcuauauagauagaaguugucauuucauuccaaaguacuuuagucuuauuuuuuaguguuuaccaagucuuaaaaaugauaaauccugaauuguccuagcauuauguuguugucugcauuaaguugucaauuauaauuuucuuagcaagauuuucuaguuuggcaguuaucuuuaauagcaucuguuuuuuuuuuacuguuuucuuccaaagagcucugacaaauauggucuuauuugccugugauaaagaaggggaguaagacauuaucauaggcaauuuuuuaaaaacaagaaacuguacuacagaacaguuaaaaauuacuuguaaaagguuauauaaucaucuguguuaauucuauaggccauuccucuuaacuucuugauuuuggccucuaauauauguuaaauuauuaucuaaaaugagaauuaauaaucccaaugaauguagguuuuuuuaaauaagauuaaaaucaugguaugcuccuguaauaucagcugcucaggaggcuaaugcaggaggaucucuuaaucccaggaguuuaaaaccugguggcucacacuuguaauccuagcacuuugggaggccgaggcagguggaucacgaggucaagagaucgagaccauccuggccagcauggugugaaacccagucuuuacuaaaaauacaaaaauuagcugggcguggugguacacaccuguagucccagcuacucaggaggcugaagcaggagaaucgcuugaaccugggaggcagagguugcagugagccaagaucaugccacugcacuccagccuggcaacagagugaaagucuguauccaaaaaaaaaaaaaaaaacagccugggcaacauagugagagccuaucucaaaaaauaaaauaaaauaggguugggcugugaccagcuucagagaaggcaguacucuuuuccccaaaucuaccaguaucuacuauauuuguuguaauuacauggcgaagguucuggaagcuggucuuuguagccuacacaccugguguaggauucccucgcagcccagucaagccugggcucuacugacuccuuguggcaaggcucauaguccuuccaccaccccagaaacuucaugagaauucacauggaagccgagucauucuggccccauguuguuggaacuguacaugcuuuaggucugucuugaaaccugggccuccacagaaaauuuguuuccucugcagcccuaucaaaugcuugcugcucaucuuccgugacccugaaucuuaagagaugauaucagccucuuucucacaugccauggcugcuuuuaagucauuacucaacccuuuuuauguaaauaccuuuggcuuauuuaaggcuuauacccucuagcaauacuauccucuaccauucuuugucauuuucaucuucccaccuacuggacuuucugcucauucacagaggauuucuaaccuuuuauaaauugacgauauugagaaacuuccaaggcugggcgugguggcucaugccuguuacccagcacuuugggaggccgagguaggcagaucacuugaggccacaaguuugaggccagccuggccaacacagcaaaaccccaucccuacuaaaaguacaaaaguuagcugagugugguggugcacaccuguaauuccaacuacugggaaggcugaggcaugagaauugcuagaacccaggacgcagagguuucagugagccgagauugcaccacugaacuccagccugggcaacagagugagacuguuuccaaaaaaaaaaaaaaaaaugaaagaaacuugcccuuuuacuuuauauauucccauagucacacaccuagaccucuguuuggccagauuaccagauauauguaugcaaagagaauuuguagugaaaacugucgagucauauucaaauccuuucuguaaugaaaagcuuuuuccuaaaaucuguuggaaauugcucauugguuaacuacuucuguaaaaguauuugguugaaauuccagaguuuuaugaggugaaggauaaaaagauggcucaaggccuacuaaagucaaccugcaucauuagucccuuucagaagacaagaaccuggauuauggaaagaauccuguuucugaaucugcuauaguuucucuccucacuugccaacaauuuuuaaauauacagagaauuuuuaaaugucuguauaccuuuagcuugcacacagaaaccuauucugugagcuaucucugacauuuccaagauaacaacagccauacauaauuguguguuuacugugcuggaggagugcuucauucaccacuaugcccuuagcauauaguagguguucaguagauuuaauccucauaagcaggauaugaaguguagguacuauuuauuacuccuauuuuacaaacugaaaacugagacauuacaagguuaauaagucuaaggucuaaaagcuaaaaugaugcuauacuuuaugacuauguggagaaagcuuacauauuggcaaucaaggaaucaucaguuuaucuccuacucggaggaucucucaacuuucuuucuuaaauaugcagauauuauagcucuaauaagcaacuuuaauauaacacucaugacauuggggcaacauagugagacucccacucuuuaccaaaaaaaaaauuuaaaaauuagccaggcaggguggcacgcaccuguagucccagcuacucgggaggcugagaugggaggauugcuugagcccaggagaucaaggcugcagugagcugugaucacaucacugcacuccagccugggugacaguguaagacucucucuuuuuaaaaaaaaaaaaaaaaaaaaaucaauauauuauaaaacacauaaagaaaaauauuuuccaaacaaaaauaaauuuuaccuuagguugucagcacuuuaaaaaaccccuggggaucaagaaagcaguauagaauguugauuuucagauacagagccaauucugugauaccauagagcuuuacugcucacaagagaccauugcagcuucagcaaucuuuauuaauuguucagauugccauccuuuuuuauuaaagcauaaugacugaguuagucagugucagauauaaucaaaacccaaaccuccuaaauuuccuaccuuuauucagcaauuuuuuucucaaauucccugcucaguguguuaucccaguccaugcuaaauaacuguuaaagucugauuuuuuaauacagugggagaaaauaauucauagaacauauuucacuugauuccuuuauuuauuuauuuuuauuuuuaucuuugaaacagagucucacucugccgcccagggugcagaggugugaucucggcucacugcaaccucugccucccagauucgagcaauucugccucagccucccaaguagcugggauuacaggcaugagccacaacaccuggccaauuuuuguauuuuuaguagaggugugguuucacuauguuggccaggcugaugucgaacuccugaccucaggugaucugcccgccuuggccucccaaagcgcugggguuaacaggcgugagcuacugcgcccggccuuuuuacuuuuuugaugcuagaaaaaugcucccauaucagccauauacuacaauauuuuucacagugcaaaaguuuauuuuaaggagaacucaguuuaaacuguguaguauuuaacauacacgugagugcucaaugauguuucuucaauaaauauauauguaaaauugaaaacuaaugucuuuuauuuagauuuuuauuaaacuuggagauuuccagcaggaaauacaaagcaucuaguacaaaucauuucauacuugucaaauccagaauggagaguuacuagagcauuauuuuuguaaagguaauuauuuaagaaacagguauuuauuuuauuuuuaguguacuccaaggagcacugaguaguauucauaugauuuccuccccuuauccuuuccacagucuuacucagauaugacuggccagaaauaagaauggcugaaacauauuauugugcugaauaacuaagccaagauuugaauuuaaagacuugcuuaauucacauauuuuguguaauggcgguucuaccuuuauucaaaaacaucuccaguguucuaccacccaaauaaacuuucuacauuuguucauuuagcaaaaauuugcugguugccucuuauaugccagacaguauuccaaguacuaggggaaaaaaagaugaauaaaacaugaucccugcccuugaggaacucagaguauaauaggaaagguggguguguuaagaacaguguaaaguguaaugugaaaguacaucaggguggugauaaauaaaagagucuuagaagacucuaaacuuagugacuugcagaugaugcauaccuagaaaauguagaaagugugacguagaccuaagaagggagccaaguaacugugucuuuuuauuuugacaugauuauagauucacaugcaguuuuaagaaauaauauagagggcugggcgcaguggcucaugccaguaaccacaacccagcccuuugggaggccaaaucuggaggacugccugaggccaggaguuagagaccagccuaugcaauauagugagacccuauaucuacaaaaaacauuuuuuuaagaaaugauaaaauuaagauucagauagcaaauaaucaugaacaagcuaauuucccugcucaacuuauuugaagagaaaccacugauauauucaaaucuacuuaaugaaaaugagaaugcauaaauaagaauaaauaauuaaaauuaaaaugccgccuccccaacaaaguaacuuagauguguaaaaucacgaugugaggaaggaaugaaggggaaaagaaaaacucaucucugaaaaaacuaaaacacuagaauuauauuaucgugauagauugguauguacuuucagauaaauauguaguucugcugacagugugcauuacaccuaccuuuggaaauaggaaaaucagacuuugguuagauauauguacuuuguuccacccacuuuucucaacauuuuaauguuauuuauagguaauauuggagcaagagggcaggcugcaauugauugauugucuuacaaaauuguuguauaggcuuaccaaauguuuauuuaacugagagaucagacuacuucaagaaaguuaaguugauuucuauacuugaaggucuccuccugucuucuugauguacacaaaacucacgauaauguuagugaaaaucgcauacauguucauuguucagggaguaaaucccaaaaucaggaauuaauaauuuauuggaacuguuaccaagccaccuaauaaaugaauaucugaaauuuucaugguugcaaauguaugugaccuuauguaaauaauuauguucuacauuuuaaacuugaaggcauaugguacaguuugguucaauguccccacucaaaucucaagucgaauuguaauucccaauguugagggagggaccugguaggaggugauuggaucaugggggcagauuucccccaugcuguucuugcaauaguaaguucucaugagauuugaugguuuaaaaguguauggcacccugccccucauuugcucucuuucucuccugccaacgugaaggugcuugcuuccccuucaaccuccaccaugauuguaaguguccugaggccuccucagccaugcuuccuguuaagccuguggaacuugagucaguuaaaccucuuuucuucauaaauuaccccagugucagguaauucuuuauaauaaugucaaaauggacuaauacaguguauaacuuagcacauuuaaaguuugaaggagaaaccaguucuuauuuuaaauuguacuaaaugguuuccuuucuagucauuucuaaguaaccugaaaauuccuccaaucuuuucaacucuccguauaguacauaccuccuugucuaguauuagucacuuugaguggacuuagcagcuuacuagcaagcuuaucuugucuuuauagaaaauguaagaauaaauguguagaagauagagauaauucccauucugcagacccuuaccuuucaucaaaggaagggaaauauugucuacuucuagccugccuuuauaaacuuuauaagcucucaacauuaaaggauaaauaaacuuuaguuuuucacugagaaucuuauggcacugaggaauggacugacuuacucuucaguccaaucacauuugggaagacacaggucucugauguauaaagcagaaggccacuaagaauuuuauuaaauuucaaacuuauuauaugccaccccuuuuuaaaacuaaauccagguauaaaaguccaucauguagacuugaauuuuacuauuaaauccacuaauacgaacaaauucugggacauaauuaucugaguuaugaauugagagugaaaauaagauccucauuaacaacucuaaggcuaaaagauucaccaaaucuuacagaauaaggucagugcugcugaccuuuauagaucccuggauguggugggaguugccuauaguccuaguacgugggaggaugaagcaggaagaucacuugagcaaaggaguucaaguccaaccugggcaacauagcaagacccgaucucuuuuaaaaaaaaaaaaaaaaaaaaguauacauuccagacagcuuucugauuggguuuugaaaaucucccucaaauuacacagcagugaagcaauguacacaacugggaaagcuuuuuaaccucuaaaacuauucaaagacuuacuuauagggaucuguuugccagcauacuaaucaauucuguguaugauuuuguuguacuaaucaauccuagguaugaucuggucgaacccaauaugcaguuauucaucuugaaaaaacagcuguuuucuucaguugucuacuaguuaaaauaauuaggcaugccaucuaaaagguacacacaguucgucuugaaaacuuacaaaugccuguagaaugauuauauuucaguuaaaaaaaaaaaaagaaaaugagcucugcauaaucuacauguauaugcuuguguguguauauauauacauauauaaacaaugauaaaugggauaaaguauacauaccaggcucuuaacauugcuuuuccucaucagacugggauuggguuagaaaagagggcugagaaacacaauuagcuugccuuuauuuguauuuuuauuguauuguuucauuuguuuuaaaaagagaguaagauaauuaugcaggauuucaguuuaauaguaagcgugaucuucguuuguuguaaggcauucuacuaauuguugacuugauaaaaaaaaucauaagcaauacuaaacuacuuugagaaguucaagacacucaagcaaauuauauaauaauaaauauuaugagcuaaucagccuuuuaguuauagaacauaaaaauaauucucucuguaaucauggauauuaccagaaaaauauacauccuaagaacacuaaucauuacggugagguaguuucagauauaaaggaagacauggcucaauuuuuaaauuauuucaucaguguuaucuaaacuuuuacuuuuuuaagcccauuauauuuuagacaggaaccaguucuaauguagcaggaaaaaauucuaaaguaagcuacagggucucaauauuaaaccuuucucucucacccugucaucccugguuuagggaugcuuauauagaacuuuuaccuauagguaaaugcaaaggaaagguaaaaguucuauauaagcaucccuaaaccagggaagguaguaguggguagcaagggugaugaacugguuccugucuaaaauauaauggacuuaaaaaaguaaaaguuuagaauaacacuggaugaaauaauuuaaaaauugagccacgucuuccucagucucaaaaaaaaaaaaaggguuccuuuuuguuuguuuguuuuuuguuuuugagacagagucucacucuguugccagacuggagugcaguggcgcuggagugcaguggcgcaaucuuggcucacugcaacuuccaccuccuggguucaagugauucuccugccucagccucccaaguaccugggacuacaggcacgcacuacaaugcccagcugcuuuuuguauuuuuaauacagaugggguuucgccauguuguccaggcuggucucgaacuccuaaccucaagugaucugcccaccucagccucccaaagcgcugggauuacaggcaugagccaaugugucuagccaagaaucuuauucuuauaagaaucuggcacaaugaaagggucuuuuaaugguauaaauaacaauauccagugauuuaaaacaacucuucauaguaccugggacuacaggcacgcacuacccugcccagcugcuuuuucuauuuuuaguacagaugggguuucgccauguuguccaggcuggucucgaacuccuaaccucgagugaucugcccgucucagcgucccaaagugcugggauuacaggcaugagccaauguguccagccaagaaccuuauucuuauaagaauuuggcacaauggaagggucuuuuaaugguauagauaacaauguccagugauuuaaaacagcucuucacaggucucuguaauuguaacucuuucccuguucuuaacaaaccaaaacuugauggucucucaaguuuuccauaaaugaguugaucagagaccuaugcagugcuuggcaaauaccaccugagcugccaguacuggugggauuucacauaagccucuuuuuuuuuuuuuuuaauauaccaauagaaaaaaaauugcaggcauauauaaagaauugguagaucaaaaaaaauaauaauaaucagagaugucuccaaaugaaaugaauuguuuguagaaaauaggaaacuugggaaaauccuaacucuuucuucacagauaaugugaauagagaagacagacgaaaagcacugcugagcaaaaugaugaagaaaauuauggacaaaauaguucacacucaauuugagugagaaaaagacccauagugaaauuucugaaugucaaacaaaaauuauacuaauauccagagagaaaaacacacaaaucagauucacaucagacuucuccuguauaguacuaaaugcugaaaaguaauggagaaaucucuaaagccuagaagauucugaggaaaaaagaugauacaaucuguugcucauuugugaauuuaagggaaaagucagagaaaaaaauuagcaacaaugaacagugaaagcaagaaagccuggaauaugugucugaauacuucuugauaaucuguuuuuuaacuuaauauaaguauuuccugggugcaguggcaccugccuguaguugcagcuacucaggaggcugaggcagcagaauugcuugaggucaggaguucaagaccagcccaggcaacauggugagaguucaucucaaaaaaagacagaaaaauauaaauagagcaaauuuuauuuuuuaaauuauaguaaugugguuuauagguaauuucaguaaaauaaaagguuauuuguuucaauaaucagaagaaaaguaagacaaaggaaacucacguaguauaacauuaugggagaaaaugggagcaagaaaguauaaaaaacaaaaagcauaaagaaugagaaaaaucagaccaaauacaucaauuauaacaauaaacauuuucauaguagauuaaacacucuuauagauuuaacugccucccccacuccccccgaccccccccaaaaaagccuguuuauccaaagagaccuuuaacaaaaguaauuggcagaccaugguuugggaaagauuuuuguaauauguaugauggcacaauuaucuguaauauauaaaaagcucuuacaaaucaauauaaagaaaggaaaauaauaauacccaauguuagggaagcuguacuauuaaaguacauuuggaugggcuuucuggaauucagugauguauaguugcaaagauauagcuauaagaauguuuauaucaaaguuguuaauaauaaugaauacuagaugcaacccaaauauuugacgaugaggaugacuugccuuacaauauagucauauaaugggauuuauucagccguuucgaaaaugauauaaaaggccgggcgcaguggaucaccugaggucaagaguucgagaucagccuggacaacauggugaaaccccaucuguacuaaaaauacaaaaauuagcugggcaugguggugggcucuguaaucccaacuacuugggaggcugaggcaggagaaucgcuugaaacugggaggcagagguugcagugagccgcgauugcaccauugcacucuagccuggacaagaagaacgaaacuccaucucaaaaaauauauauauuuuauauauauaaaugauauugaaauauaaauaaguugcuaguacauuaaguaaaacacacagauuacaaaacaguaugugaaguauaauuagacuucuauauauauguguguguuucuauauauguagauuugcauagaaaaaaguuugagugggcccugugugguggcucacaccuguaaucccagcacuuugggaggccgaggcgggcagaucacuuaaggucagaaguucaagaccagccuggccaacauguugaaacccugucucuccuaaaaauacaaaaauuagccaggcguggcagcgcacaccuauaaucccuccuacuugggaggcugaggcaggagaaucugaagugggagaaucacaagucagagaaucacuugaacccaggagguggagguugcagugagccaagaucgcaucacugcacuccagccugggcaacagagugagacucugucucaaaaaaaaaaaaaaaaaagaguaaaauauuccaaaauauuugcucuuguuaugucaggaauuauagauguuuuaucauuuuuugcuuuuuauuucuauugaucuuuauuugcgaguucuauauuagucauucuaauagauguauacugucuaucuuauuguaguuuuaguuugcauuuucuaauggcuaauaauguugaauauccuuucaugcacgcacuuaucauccuuauuucuuuggugaaauauuaacaucccuuccuaauuuuuaaugaguguuaauuuucuucuuauuggcuguugauaguucugucuguauuuuggauauaagucuucaguuggguaugugauuucaaaauauuuuuuucuaguccauaguuugucuucuuauuuucuugacgguucucaggcagagcagaaguuuuuaaauuuaaugaaguccaacuuauaaauuugaacucuuuacccaaccccagaucacacaguuuuuuguuuuuguuuuuugagacagggucuuacucugucccccaggcuggaguguaguggugcaaucucggcucacugcaaccuccaccucccaggcucaagugauccuaccaccucagccuccugaguuguugggacgacaggcacguggcaccaugcucgucugacuuuuguuuuuuguagaaaugagguuucauuuuguugcccaggcuggucuugaacuccuggacucaagcgaucugccuaccuuggccucaagugcugguauuacaggcaugagccaccauggccagccagaagauuuucuccuguguauucuuucagauguuucuacuuuuauauuuagaucuguuaucuauuuugaguuaaacuuuguauaaugugagguuuagaucaagguucauuuuguuuucuuuacauaugguugaccaauuguucuaacaccauuugucgaaaagacuuuccauucucaacugaauugauuuugcaucuuugucaaaggucaauuggccauauuuacauggauugauuccugugcucuauuuuguugcacugauguauguauaugucuuguugccaaugccauauggucuugauuacuauaguuuuauaguaagucuuaaaauacauagugagauuucuuaaacuuuugcuuuuguuuuguuuuugagaccaagucucacucuguugcccaggcuagagugcaguggcacuguguuggcucacugcaaccuccgucuccuggguucaagcaauucuccugucucagccuccugaguagcugggauuacaggcgccuaccaccacacucagcuuauuuuuauauuuuuaguagagacaggguuucaccauguuggccaggcuggucucgaacuccuaaccucaggugauccgccaaccuuggccucccaaagugcuggaauuagaggcaugagccaccgcaccuggccaacuucgguuauuuuuuacaaaauaacuuuugcuguucuaauuccuuucccccuucauguaaauucuagaaucaccuugucuguacuuacaauaauuucugauaggauuuugauuacaguuguguuccagucuauagacuacuguagggagaguugacuccacuguauugagucuuccaauccaugaauaugguaugucucuguuuaucuagaacuccuuuagccuccauuaucagauuuuuguaguuuuaacuauacauguucucuacauaguuagauuuauguguauuuaaguuguaaguauuuugccucucuuggaauuauaaaaaaagguauugucuuacuacaacaucagaccuaaggaugauuauuuguguaucugacauaagcuggaugcuaucaacaucuugggagaagaggaaaagauaauuuccccaagagcauuccaugagauuuagaacuggaugacagggcaugauuguacauagaaggaguuuaauguaguuaacuaaggugaauuaggauuggauuuggugguuuuaaacaauuugcucuauuaaguauuuguuauuuaugauggaguuuauauaauuggguuuuuucuuuuuucuuuuuuuuuuuuuuuuuuugagauggaaucucacucuguugcccaggcuggagugcaguggcguaaucucggcucacugcaacuuccgccuccuggguucaagcgauucuccugccucagccucccaaguagcugggacuacaggcgcgugccaccacacccggcuaauuuuuuguauuuuuaguagauaugggguuucaucguguuagccaggauggucuugaucuccugaccucgugauccacccaccucggccucccaaagugcugggauuacaggcaugagccaccacucccggccaccuuuuuuucuuuuuccuuuuaaguagagguggggucucgcuguuacccacacuggucucaaacuccuggccugaagugauccucccaccucagucucccaaagugcugggauuacagaaauaaaccacuguuccuggccuauaauugguuuauaaguaaaguucuaaacuuucacuuuaaaauuaucuuaccagguugggugccaaggcuuauuccuauaauuucagccuuugggaggccaaggugaaaagaucgccuggggccaggaguuugagaccagccuaggcaccauagugagacuccaucucuacaaaaaaaugaaaaauuagccaagcacugugguccaugccuguaguccuaacuacucuggaggcugaggucagagaauccugcuugagcccaggagaucagggcugcagggagcuaugauuacaccacugcauucuagccugggcaacagaguaagacucugucucuaaauaaauaaauaaaaauaaaauaaaauaaagugaaacuaauuuaccuuuaguuuaccucuuuugagucuaguuuaaaacuucugguuccugcuaguauacuuaaagaaacaguauaguauagaaccuuugcagacuuaguuuacaauuuucucaggaugucagcgcucagauuucauuauuccaauaccaaagggacaaugaaaucacucauggcaguuguaauggagggaugccaucaacauuaguuuuuauuuuuguuuuucaggggauuuuuuuguuuuuuaagaaaugggauaucugagugagcugaaaguuaugaagacaggaacucagaaagaguuaagguacuagaaagcaggaaguaagaccucucuuccauccaucgugcacauggacuauguauucacuaccaaaccaguuagaugguucccagaauuauagggaucuacaucuacauguucuuccugguuuccacuuacccagcccucaggucugguuugaagguaaugaauuaucucacuugguuguuaacagucaguugcagaucgaacuccuuguucuacugcuuccccccuucucacuacuacacuugacuaaucuuaaaacccccccaaaagaggaggaaaggcuaguaaggaagcuggggccauuaaacaauguuuaagcauagaaaaaaggaauacauaaguuugaguugaauuaaagaaaguugucuuaacuuucagaauaguguacuuuucuuuuucaucaaugaccaagguauuuuaagauuuuuguauuccagaauuuuaauauaaaauacaacaucaggauuaucugauccaguauuuuuuuuuaacaacuaaaaacaucgaguagacuucggcugaauguaaaaauagguacauugcacauacuagaugcuuauugauguuucugaauuuuuuuaagaagguggccacaaacagcuguagucuaauaaaaucuguauuuuauucauuuuguucauuguuuuauuuuuuccucuauuaugucuuuaucaacaggucaccuaaacugaguuucuucuagguuugggcacauccaagaguugaccuugguacaguagauucauuuauuucagcuacuuuauugaugccaauauuuccauuauuuauuucugcaucagcaguauggggagugccaaauugauguugucauaacaauaguuaauacaguggagcacuugcuauaugucaggcauugcucuaaagacuuuauacuuaucaaccccuuaaauaucacaacaauccuuugaggagguacuguuagccccguuuuaccuaugaggaaacugagacacagagauauauaacuugcccaaaauaguaaauagcuggauuagaauccagccauuuuugcucuggauuuucugauuuuagcugcuacauuaucaugcuacauuuuacuagcucuuacaagguuuuacuuuacauuaccuuaggucaucagucagcagauuuacuacaaauauuagcaacuauuugugaaauuaaccuugaaauguaaucuacugauaaacuuugugccuucauaacuguacuuaaguuaggaggagaauaucaaagagaaaaaucuuugagccagaaauuaagcuugucaguuucccugauuacagaggauuaaaaguauaggaauugauuaaaauuugaccuuggguggaaagaugauuuuaugaagucugguucaucuuggaggcagcuuagaguuaaagaccaaugcauggcuuuccauaccgauugguuaaaaaaauuauguagauuuuauacacauugccacuuacaucuuguauguuuguagcuccucuuuaucaagaauggcaaauuuucaugcagaauagaaguauaauaagcauuauuaagacaguaacuugucuugaaucuuaauuguauauuucuaugauuucagaccucagagcagucuuuauguggaauuuugauugacggcaaaugcuaggauguucuuuucaaaauuuuccuucuaggagaaauuauauuucacguauacucaaaguauauguacaauaggauacaaaaauauuuuguguagcugaggaauaguguauaugccagugauuaccaaaguaucgggacaaucagaugacuugguagcuauaagucuaugaagagccuggucuugaggcuucagaguaggggcguucuuuuuaauaaaggcaccuaaacuuauauuugugugcauauggaacaguuaagauggugguugaguccagagacuagaaugguuuucuugccauguguuuucauucaacaauuuuuaaacugaauuauucucuuuauucuuuauuuauguuauucacuaucaaugaauauuguuuguuuuauuaaaucuuuuguuuugcuguagugacuugagggggccaucuccuaacaacagaggcuuugacaaagcaccagaggauucuguuaaaaaguuguguuucguaauuguaguugucgugucagagccuaacugacuuggagcugaaggauuuuugugagaugaguagcugugccagcagggacccaagucuccugggcuggccgcgcucucauuaagauuugccgcuagcaguggcgguguucagcauguaugugacgugcauucuguuauuguaugcuuggcuugucagccugcagcuuucugacacucacuuaugucacucuuuauucagagaggaagaagcuuuugauaauuugacaagacaagcucuuaaacgaucuaggucauggccuucacugucugugauugugaacauauuuccugaaagcccugucacucaucacagcuacauuuucucccggggagccacaggccuguccuggucucuugucagcucauacauuuugguuauucauauaccaaauacaguauuggggguuuuuuucuucccuuuugcaaaugcuagcauguuaguaaggcuaauccuuucuccugugcuguguucccagcagggcugcguucaagggcucucucuaguacaaggcagacaacuggccaaggggagcugaggaggaggaaaggccgcuuagugcuguuuuuguguuuguucauuguuguggaaauaugagaacugguggcaagggccuugucuauugagcacuugagucuuggucugcugucaggggcuguuuaagauugaguguuuuauuuucuuugauguucacauuugagaauagggaagugggaauuaaacaacagaugcacuaagccguuguucucguaaaacaauaauuagcaccugauaaaauucaauaugggucaaaaugcacaauauaaacucucaauucaucugguguggcaaacuguguugauucaucuuugaauuuuaugaauaauaacacugauuuauguaugguuuauuauacaaaauacaauagacgggaaaacuaguugggcagaaguuggcaaacaauguagcacauugcuaaaacagauguacaaguacacuuuguauguuuucaguugugugauuugaggaggcccuuuggguugccauccaucuaaguaccaguaaggugagaucaccaggguaaccaauaaaugcaauuguauuuucauaguuuguugaauuugcaucuuagaugaguuccacagcugacuaguaauucauuuuaaguauuuuuuuaauuagaccaaaguuaguuguaauaguaggcuucuugcuuuagaaauuacuuuauuuuaugcaauagguauauaauuuuccaugcaauagauacauacauuugggugccauggcauucuauuugauaagaagaaaaauacgugcaacgacuagggaaugguaaaaagaaguugaagccauaauaagcaaaaagaaaaauuaggguuuuaaaaauucauugaugauacauagauauaaauaaagaugugugccuuauauugacaccuaguuugaaaugaaaaauauuuguuuacuuuuuaaccucaaauauaaauaaguauuacaaaaaauagcaaaaugaaacuaugcaugagaauguugaguaaaaauacuuaugagacagucaaguaggaguuuuuaaaaauuacaauacuauugucuaauaaaugaaaagaaguuucaugucucucacuacuaauuuucuauauugggcaucaucuucauguacagagcaaucagaugauuguucaaaaaccaaguaauucuuucuuuuauuacuaaauugcugcaacacaagaaaaggucacaugguagaguggcauucugccaguguaugacaacucagugauugcgauuuuucaaccguauuauucugaggacacugugguaaucaagaacuauccauaacuaauguauaaauaacugcuugcuuauuucuacaauaauccaacucaaauuauauauacacagcaaaaagcuuaugauagaagguaggaaaugaauauuuaaggauauauuguacauuagauauuuguguguauacauguuuauaaaaauagauauuucuuguauauauucuuaagaacuuuuguaacaaaguuuguggcuacauuugguaacuaacaugaucuuugccuuaugaaucaaccuuuuacuuuuuaaaaauaguugucuuuucaucaguguuguucauccagaaaugacuggauauaauaaguggguuuuuuuaguaagacacuuuaguuuccaggaauuugauauuaaaacuggaaagcugaccacuaaacagucuuuccuauagaaagcuguguagacugcuuucuauaggagcagucuacacagcuuucuauaggaaauuacacaggaaaguuaaaaugcguaaaggauaaaauuuuucagcauagauauguuucagcauaguugaaacauaucuacuuuuuugucuaaucacuuauggugguauaaucaguagagguauuggcauucaaauguuucuuaaauuauuaucauagccaugauauuuucagauuguaugaauuaccuuuguuagucuuaucaauacuuugaaaaauaaaugaaagaggaaugacaaaucaaguaaagaguuguuucaaacuagguaucaaaaauuacaaagauuucagaaagucuuacucuaauuuuaggcaugcaucuauaaacaaaagcuauaaauuuccauucgcuuuuaagaaucaccauuuccuuugcuugguguuuuaauuuauuccaaccauuuauauaguuacaaacaacacacuuuuugcuccugagaagaugguaaacugaucaacuauacauaagcagcuugguuagaaaaaguguccuuaacaaggucauaauuuaggcauaagaagauuuauauauguguucguaagaaaauauauucuaaucacuguuuuuguuguuccugcuauuguuuauauuugcuuguuugguugguucuuuuguuguuaccuauucuaguuucaauuaguauaucuuuuacaagauuaucgacguuuuggggauuuuuaaaguuguuuuugcuacagauguggauauggaaagauuagacaguuuggacuuuaguuucuugcagucguuuuuguucuuguuguuuuuaauucucuuucuuauagaguauuaaaaguuagcaccaagugauuccguaaaagaugccaacagcuaucacaaauauguaauaacagugaagucuucuuaaagcaguuacuauuaaauuguuuuccaucuuacuaccaaaguucaaaaugcuguuuuaaaagguguacuuggugaguuuuauugauuuugaccacugcuguucauuuaucaguuuaacugaguuauggcucuuuaucacaucuuagugcccaaaacuuguaaccugaaaagaaaaagagagaaaacuuuguuacuggcuuucugacaauggcggggaguguguuaaaccaguguaaaauucaauuaaacugucuagccagguuuuugaagcugaaaugcagacccuuucuguuaagcuucuuauuuuccugugaccgacaccgguggaugcuggguuaugccaaaaccaacaggcuguaaaguaccuuguuucaugcucccagcugaucaauauuuuuauuuuccaggcuugcacagaaaucuggaggcaguaucaccuaacggugaguagaaacaccuuuuuuauuuuccccaagaccuagccuauuuacccuucucugaacugcugaccauaaaauauagacaagcaucuucugcuggaagauaauaaacaucugaagaguuuuuguacggagaaagcaauaauacacuuuuucucuuuuccacugcccccuacccuaucuuccuguucuuaaaagaauuugauuuuuuuauuacucacaucauuuaaugauuacaucaugguaucucuuagucuuccagacuauauucauuaaauuaaagggaaaaaguauacugggagccuuaaagaguaauaauccagugucuuuaaaauguuguauuauccacaguccacaagcauucaguccacaguaucuucaguugcuuuuacuaaaacaguuacugauauuuuucaaugaaccuagaaaaagcuuaguguauauuucauauagaauaauucaacugucauauccuuaagcccuucuugacuuauucaaaauguauaaauaucugcuuaauaccauucaaguuauucaauuccuaguuuccuuuuauugugauuuuaggcuaaguagaagcagaaaauacaguuugcuagagaaucuaauugacuggugcucaauauuaugaaguuaguuuacuuuuaauguucagcuuaaaucauuucaguaauucaccauagcccuacuacucacuucuuuuacuguauuaaauauguugugcuaagcaacagaccauuauucuuuuaauuauuacaguuauauaacauaauauauauuaauuaaaaguuguuaaacauuguuucuuaagguuuagcauaguuaaaaguuuuguuuacacaaagacagguuguaaaaauacaaagggcaaaguucuuucaaaacaugacuucuuaucauucuccuuagagaaauaaaaaguaaaccaacaaguagacucaaacuaccugucugucugucacaggcccaagaggccauaaauuauauaaggugguuuguuuucacauuuugugauuaccauuuaauuuuuuuaaagauuuucaguagaaagcuguaacuccucaacuauuccucaaaucucaaauuaggauuuguuaaaaacuuaaguguuauacccaaaaauauauacauacccauguauguuacacauauauauuacaaauguaauucaucugaauacauuguuugugcuuauguagcaguuuuuuuauccuaucauaauauagugaaaucauuacagccuaaacuuaauuagaaucuaauuauauguuauacuuuucaagaugacagagcuacucuuuguaacuguauaaaguaauauccuuauagauuugacauugcauuuauuuuagcuuuuccccuaauuuaaacaauuccaaucuugaaguguaggaaguaugauuuuaaagcugcucuuuugauuauuuacaccuguguucguuuauauaccuauaguuaaaggguaaaaauuuguuucaauguaacagaaauauuugaagguuugcuuaauauuuuagcuguucagaaacauaaauuuuaaaaagaaucauuaggaaaaaauaauacaaaauaaauuuacuuuuuaaggaauuacaauauauucuauuuauagguauaacaaauucaauuugaaaacuuuguuuguuccaaucuggaauccugguuaauuuuuuaaaauaauauugaaguugccaucacaguuuauaaauuaucaaguugaaauuaauaaugaguuuacuaugcaaguauaaauauaaaacuagcauguuuaugaacuugugcauauaucagugucucuaaaauaaaauaguuaaguaauuauuuaaauuaucaguauauggacaauauccaaauguaugcaaugaagcaauauucagucuugaauaaaaacaagaugcaugaugauuuuagucaucuucagcucuuuuacuaggcgauggacugccaucuauugacuccuaguagcccucacacaugaauguugagucaaucagcgcagugaccaaguaaugaagccucaguuagaauuguuacuacuuauucauuuaaaccagucugcuuaaaacucuggagcuuucuacacuuaagcauugauuaauuacuuuuucuaaccaaaauugucauauuucuuaccccaaaugauggcaaagaugauuaguauccaguuuggagauguuuauauuugggagcuuuacaguugcuuuuaucugccucccaacuagagggucauuuacagaacgacuuaaauuuuaacaguaaauuaauguuuauccaggagucguuuucuuuaaaaaccaaaaaagucuauagguuaaacagaauauuguuucucaaacacauaagaaaggugguguaguugauuguuacaaguggacuuuugaaauauuccaaauaaaaaauuccuuaaaacacuuucagaacuaagaagaaaguuauagaaguguucacuauuuucaacaauuucaagaaaaauaaaaugaaauaucuucaacaaccuguauaugaauauaauagcuuuuuaaucagcuagacucgacuacauuaauaaaagcuaaagaccaucauucuaaaggguucaugcuaauaaaacuaaaaagacuacauauacacaaacauccauauuauaacaaccaucuggugacaccaucuuucuauguuuuaaugauucuauaauuauauaauuuaaugucuuuaucaauuuggagaccaugaaaaaaagaaaaaaauauuguuuuuacuuaacaaguacauaauuuccucaaauaguuaauauuuuuaccuccuucaaaaauguuuagaaugcuuuuaaauguuuaauaauauagcuaaaauauaacuucuuguauuuucauuucugcuacauuuucagauuuuuguagagccugacuuuuaauguucuuuuucaucuuucaaauaacucauucuagauaaaaauuucccccuuuauucgagaaagaaugucccuucccccacccccugucauuucuacucucauuuauauuaaaaauccuaggccaauauggccaccaacagaguuuuacaaccaacagaauuuuuaacuaguagaggcuaugauuugacaugaguuggacauuugguuaaucuuguuuuuaaucuacuuacuuuaaaaaguaaccaggaguuugcuauuugagggcuguauguguuaagaaucgaaaaggacaaugcaucuuuuauguuuaauuuugcauuugauuucuuugugugcauuguuaaaauguauuucaacccuacugccuuuuauuuuaacugaagguuuaagcaggaagcaaauguaacuguuuuagaagaauuaagccuuaauuguuuuuuuauauauaauguuuugaaugccuagaauucacacuucaaaaaauagacuauuuguuauccgggaaauggggaagaguagagaaaugagugugcuugacuuccuuucuggccuaagaaaggcuuauggccacaguuugucaggguauaucuuauaaaccauaaguaacaauauuacauuucauuuugccacuuaguuuucuguccuuaccuggaaauacccauuuagaaauguauuuuuuguguuuucacaguuuggaguuuuauacugagugagaauguuauucucuaaagcauucuaugccauacuacagaguggguaccccuaaaugucaacagauuuggauuuaacucuagaacuauguuuuacacuccagaaggaaggaauaagaaggugguuuugguucugagacuauagcuaugcaaaagccuuuauccugagauugugauguaagauaggauagauaauuuucuaauugccuaaugcuaauauggaauguuuuuccuuuaaaauaacuuaaaaugugaaaugaagagauucaaaaagucagccagaaucuuuucuuuuccugguuaauuggauauauguugggauuccuaaauaucuuucugagagguccuuggcuacauaagcagaucuguaaaaaccauaauaaccccauccacacaguagauaucaagugauaggucuguuuuucucugugugcgcuuugguguguuuaagaaaauagaacugguuacauacugucuuguaaaaugcuaucuaaacaccauuuuuauugguaccauuuuugaggccuagcacauagguuuucauaagcuaauacauuauaaguucauuuuggaagcuuuuguuuugguaguucaacuuacuuugccuacuuccucaagaaccagaaauacucuuguauaaauuauaguuuuuuuccucuguaucugguauugcuguuuuaauguuuugauugaucagguguugcuauugagacauuacaucucugccaaauugucagagguuuaguuuucauuuaaaaugcccuuaguacuaaaauacuacugaggugaacgugauugugcucugaucauucagaaggcacaugacucuuuuguagugcuucagagccaucuuuccauuauaguacuauaaaauaaaucagacugguuuaucuuuugaguuacuugguguuugaauaacaagauuuuuuuuuugaauaagcauugaugacuuguaauaguccaucucugauaacagagauggaaaauacauuuggagaaugacuaaaauuuuuaaagauuuuucaaaugcaaaauuuauaugaauaguuuuauguuauuuaaauacuuaucuuguucuuaaagaauuugcuguuaaaauuaucaucauaauuuuuacuucagucuucucauauuuugaguuuaguaggaaugauaauuacuacauuuacagaguaagucaacugauuuuuuuuuuuaaucuuuauuucacuggcauguggaaccacauuuugccagaacuuaucauuggaaaaugcaauuucaaagcaaaugaaaccuggaauuaucaaucucaauaaaugagauucuuuuaaaaauaaauaaaauuugcuaaaucaucaaaaagcaauuuucuaaagcuacuguaaaggaaagggggaaaaaugaauguugugaauuauaaaugcauguuauuuuuccucacauaacauuuccucagauauuuagaaauuguauguaugcauauuuauuugugaauggaguuagaauaagaucauuuagauuuggguguaauuuuuauuuauuggagcacuugugagaaccuuaguauuuucuucuuuacaaagaaauacugaaguguucacuccuucaauucugaaguuacuugauucucaguauuuuaaugcaaauacuaauuugguuuaaaugggaaaucaauauggcauauuuugcauaguuuuuuccuugcauuaauauauuuagauaauaucaaguacuuuaugaugguaauccuaauguagauuuaaguguuucagauaaugaagcaaugagaaguaugcagccuucacucaauuuaggaaagauuuaucauaaauguuuuggcauagaagcagcugugcuuuugccaucuucuaaauaucuuuaaugaccuacucacuagucaucaugaauuuggcucauauuuuuagauauuagauguucaauaaucaaauaauugaaucugaaguucuacuauaaauagugacuuccuuucuuuauuugacggaaaaagucccugugcuuuuuauuccugccccuaguggcuaggggcaaagaccaguauauuuaggacuuaaauaugucucacauggccuuaaaguuguacuucuguuuuaaaaauggaaagaaguacuuguuguggucaucuguuuucuuaucuguuaacaaauguuuauccugaggaugacaaauggagcaucacguuugcacuuuuuuuuauuacccuuuccucucuuccccauguguguucagcauuacuuagaaaggaauuauaguuagucauuauagggacaauuuauucuugauuauuaaauacugugguaauuaaauuucauuucuaagugcuucuuguuuuaacauauauaacacacuuuaaaaaucuuuuuuaaaacccacaguauucauauaaucucaaagaaaacuacauuucuuucuuuaaaaaaauuaaaauauggaacacuucaugaauuugcgugucauucuugcucagggacaaaacuacguuucuuuuuacuugcaacucugcacuuuuaaagagugacccuauuacaauaaaaaugaguauaaauauaaacaaauagucuuagauuuuccaaaauuaauacaguuuaccauuguacaguaucuaacuauauaauaaauuaacaguuuuaaaaucuugagugaugccaauucuuugucguguuacguacacauaaagaguguagaaguauuauguagauaacuuuagcauauucaagugauuauuucgcauaugugcuuugaacagguauuucaugccauuuauuaauuauauuccgagugaucaaacuugucauagucuuuucuagacauuucaguccaacaguaaauguagauaaaauauacuagagcauugauauuuguauuagacauucauuuugguagucaugcaugugagugacaugguagauuacaguaauuccuaaaggucugaaguauuuaggaaucaauuaauuacucacaaucaugaucaaccauaaccuuuaaggguuuggaucgaucguuugaauaaucugcaggaaaagacuccuugacuuguuaacaugaacagucucucugaacuaguguuauauuuucuguuacaagcuguggugauaaacuuaaguuuuagguuucaaaagcacagucuuuucagugacugaaaguuaaugaauuauuguuaaaaucagucagauuuuagacuuaaaauuuaucagucauuugaucccuauauaucagaaauucaaggguguuauguguggguuuuuugguacauuuauaaguauuuucuuccagcuauuuugaguuggugcaaugauccuccaagaccaacaacucugguguuuaagaaauaccgaaaacaagugaagaaauauauuaccucuuuagaaagcauuuaacaaaaaaaaguuuaauaucuuugggauuaaauuagaacuucaccuuaauugguacaccaguacauagauaccgcacauuucaaaacaagaauuauuuaaagugaguguuuagaaauuuuuauuagcuuuguaaaaggaaugcacauguguguaucaacugguaauaaagcuacuagauaauuuucauuccauuuuucaauaaucauguagaacugaauccauuggguaaauuauaagaucaucuuuauaauuuuguaauacauccauuuuacauagauauguuucuuuacauugauuuguggauuaccccacauuuuuguucaguuaggaaaacuaaguuuuggguugugucuuaacuuuguuuauacaauaucaauuuuguuuucuuggaucucucacauuuccuuuguuuacaguuguacauuuccucccuguuuuuaccaggccuuagaaaacugugcuauacaguugggccagaagggcaagcaaauuucugaggaaauuacuagguggcauuuuuuuuuaucauaauagagaaaagaaugccagcuuugggauuggacugugguucagagucugagucuuucgucauauacuaaaugugcaaacauaguuaaaauauuuaacuucuaaagcccucaguuucuucaucugaaaaauggggauaaugccuuguaggauuuuguuaaguauacgaugagaugauaaauauaaaauacaauaccugacagacagagcauguuaaacacuaugcaggcuguacuacagcaaacccaaaggcaucucacaccuguggagauggccucuggacugacgucccaaacucagguuauuauaaugucuucugcccaacauuaggagauuccuaaggaccucuuuacucugucuccuaacaauguuuccuucuuauauuuauugaagggaaucuuuuguugacaaaauuauuuaccucaguuuucauuuucuaauuauuuauacuugucuuauucuuuuccauuuaggcuacuuccuuuccuaaugaaaauaacuauauaaaauguguaucauaaaaaugcaauaucacuuugaaaauacauauuaauaaaugugugagucuuaagugauaacuucaguaccaucugaauauaguucucuaucauaagcaaauaaauuauauaaauauuugcucucuauacaaaugaugagaauaaaacgaaauugaaaaauucacccaaacauaaacauaccccaauuagaauacuuucugcuagggguagagggcuuauguuaaucagauaagaaaugaaacaaaauagcauagcaguuuuuugcacuuuagguaaaacuacuuuaugccuucacaugauuaacaccaaaaaccagccugauuucauagcaaaauguagugguauaagagcugggucaguucugcagacuuccagcuguauucucagauacguccagcgaaaaaggcaacucaaacuuaagcacuuuaucaguacaugcaguuuguauucuuucaaagagcauuccuauuucauguuuguuccuuguuuuaagacaagcaaaggcucagauggaacauauuguaaaagcaaaagaacauuacuucccccuucuaacagguccuugcagcuguggaauucccugccuuugugaucgaugguuaagaguauuacaguggaauaagcagaguugggauggcagguggugggagggccauguguuguaagucauguggaguuaugguaaaaaugaaaaucuugggguuuauuuggaucccccauguauuagcuaauaaacguaauagagcuaugguucuauucuuuuauaauuuuuuuauugggguucauguacaaucacaugcaaaauauaguagcagauuugaauauguuaagcauuuuguaugguuggaagauguauauuagugugauuucuguguuuuauagucuagcccaauaaacauucagauaaaauguccauggauuuacacauuuauguguucuuuucugucccuucccccuacauccugucuccaugccuucaucccucuauccugcaucaaagcuugugguccuucuccauccauguacuaaaugguuucuuuguaaaccaagccauuuguccaucauuguuugggguccaaacagugguaagauacccugucaccgaucccgcaugcuaugaauggcagcuccucuccggacaauuggcggaggggccgagaaauauuccugagaggauuauuuaaccuuucaauuuagagggcacaaagccuggcugauuaaugaacuuucugaugggugccgauaagcggaucuauuucuuuauuuccccuaaaagugauuccuucuucuguccauauuacuauaaucuuaaacauaaaauguggcaaauagauuaaaaaacagcacuaaagaguuuaucuggcuggcaaacugaaggagcuaaauuaaaauugguaaugacagcaguggcucagccucauauaugguuuuuaaaugcacuguguauuuugaagagacuuauucuccagcucgccugguaaugacugcuuuuggugcacagucuggggcuggcuucuguuaucccaccccacccuacccacccaccccccccccccccaaaaaaaaugaguuguguuaucuggauggcugcagacacauacgcaucccccuuucucacugcaugggcagacaaggucgauagcauuacaagguauuuguggcagugcuuguuucaguuuucagagcugccaguuuccaggcggauuugaauuacaaaagaagaagcuggcaugaaaauugaaagguuuuaucggcuggucugaagccucauagcacauugcuuauuuaugcaguccauuugcaccaggaaauauaaaaaggaaauacauuuuuaaaauaaggccauaaagacucagauauguuuaagauggcaaauaaaauauagauaccuauaauaucuuuccaggaaacgauuuucacuuaauguugcacauuacuucagaagagcauuuauguugcugucauaaauuugugcguuugugucacuauguagguagucucuggggauuaagaaggaagccuuugcuaacuuacuuuaaaauuaaaauagacggagggauagcucugcaguuugagagcuacauuggaaauauuuaaauagggugguauauuaaacuuaaacuaacauuuuugcauuccauguaaaauuagcuauggcccaaugaauaaaugcuacuaccuuuagagaaaauugggaugcuuuuuaagccaugaagauuuggagcauucaggaagugaauuacucugauccuuacuguguugcguguguucauuguucucugcuuacugagguuuucuuucuguuguuggaguuguuuugauagggggaguguccuguuuacaaaaagaaagguuauaaauuaauaagcuuaauagcucauuuuuauaaaacucgugcuucuuuuuaguuuucagauauauuuuagauuuugcauagugguuaauguugugaauauauaacccuuucacuauuggaaguuauaccaauaauuuauaucuauuuacauuacuuuaauguaguuuucgauuuacugaaaaagauacaaugauguaaucccuuauacucuugacuacauaaaaugaagacauaaguauacaaacauaaaguagugcaagaccuugagugauuggucauucgcagcuuuucaacccauugguuuauaaaauuucaguguauccaaaagagaaguagggaggaaguuacagagauacaggaaauaucaaauaacuaaagcaacacacguuauucugcaguucaaaugaacacucuuuaagaaucuuuuuuccaauauggcaaauuacucucagguaaaccaugagagaugcauuuuuuuacuauuuuuauuuucacuauuuuuaccaguaucuggguaccuuucccauguuuucacgaccucgacuaauuacuucauguaguuguuuuuuguuuucuuuuuaaacagagaaaauaucaaaagcauacaugucuguugcaugcuaaugaugugcuguacauuuuuucaugaauuuucauaaggauuuuuucuacguagcauguguggcuuaaugauguaaucacccgauagacuagaaaaugcuccaaaggagacguuccggucuguuguguacauaauacauguuucaaaaaucugccuaauuaaggaauuacccaauggauugggagucuguuggguacaugacaugguuuuuuaacacauaaaaguauuauguauauaugguacacaugguacuuuuaaugccauuuuuaacauaugaggaaaauuaguagcaauguccacuagaauacaggggaauucuguuuuuucacuaagcaaaaauaaaagcuuuaaaaacagcacucuuuuaaaauaauucuaaagccauuagcuuggagaaaauuccuccuaguauuccugaaagggaaguaauacugucaauauuugccagaacaguguacaaauggaagacuuuguccaaaaccucaguugaaguaggccuagaguucaggucccaggugugaggauccaccucagaaaaacaccuuaaagggaggaaagggaacaguuuuuggcuuuuuuguaacacagcaucaucuuuguugucucacagccucugcuuugguucaguucacuauaaaacaguuugccuaacuuuuagguuucuuuauuugauucuuuuaggcauaaauugauuuggaaauaugaaagaauaagguuguucucaaacaugaaaaucauauugauugaagaggugccuaggcacaugugauuuagucaguaagauuggagccaagcucuacuuuucucaguguuauauuugguuaugaaugcauuuaccucagguauuuaauauauuugcuuuuuaauauaugucauauagcaaacuggauuaauaaauagaaacacauaguguagucuuuaagcauaugugugauuauaaaaauaaauccauuuugcauucacagaauagaaaauacccuuuaauuagugaaauugauuacauaucguauauaguaaugagcuucagcuagaugcaagcccucauuggaucaaagucaguuuagauaagggcagcugaaggucacagagggagaugcccagcagguucauuugcauaaaaaauuacuguuagaaauaggacacugaggcagcucuagcauuuugaucucuuggccuuugucauggagauuccuaguagugaagggaguaaggccagugucccagauaaugauuaacuguuuuaauggcauucauucauucauuccacacuaacuacucaugcagaaaaaaggguuauguaaaaugacauuagaagaaaaucauuuguaaucguugcaucgggcugcacuuugaggagacauuaggaguaaauccguggcgugguaggcuuaugcuuuaucuucugauauuuacugaguuuacuggugcaugaaaagcuuucagcaagaauagcagaugggauggaccuuucauagguaaugcuaucuaccagguuauuacuucuauauauugauaguaaaguaaucuccaagauaucacccuacaaauauagauuauuuaaaugucugcaaccaaaaaaaaaaaaagaaauacaaaaggccugcuuuuauaaguaauuaauuugguauccguugggucaaagucuuuagaugaaauuuugacuuaaaaaaguucacaaaaacuacauucauugccuugcauuuaacuuuuugucagcaguacaggcacguaugacagaacacugaacuuagagcuaaucaguugacacauucugcuuuaaauuggaccuuuacuguuaauuaaaaauaaagacaugcuccaaggcauaaguauugagucacaaauuuauauuucuaacacaauagcuuagagauuuuuguuagaucauaguaugaaaacuuguccacuggaaaccacuauugaguuuucaguaguguauucuaauacagaaauguucucuaauuagguaagaucuaggcugauuucauuccuauuaagcccuaguacaugauaguuuauuaaaaugagaguauguagauagcguuugucaugucauuuacuaauuaauuauugugaaacaguuuagaauuucauagcacaauauacuguugcuauuuuuauuaguaauaauggaaguuuuuaacuacugacauuauucagaugaaugaacauccacauguuuacauuucuuucaggggcuaaauuugagauuccuuuaaaauaaaauaagaagugucaacaugaaacaugcuuucaaaaucucgauuaagaaggaucucuuugucccugguacuguaagacugaguuccuguucacuuggcauuacuaauuccuuccugauuuugucagaguauauaccacauucucagugugaaguaggggagacaauaaggaagcuguauuauuaauuuauucaagcuuuuuaauauauuuaagcaugauuugauagguuuucccuuaaugacauaaaaaauuaauaguuucccaaaguaugcaaguuuuuauuaacaagagcuaaaucauauuggaugauuacuguaggccaugugcuuuacuuaugcauuaccucauuauucauucauuaauauuuacugaacuacuacuauaugccuggcccuauuccaggagcugaaguacagcagugaacaaaaacagacaaaaaucccugcccucacagaacuuacuuucuccuagccuggggaugggguugggaguggauagguaguaaacuauauaguaugucagauaugauaagugccauguugaguuuuguuugguugguugguugguugguuggucuuuuuaaaauaaaauggcaguacagcaggauagggaguacagauuggagggagcuagccauuuuaaauagggugcucaggaaggccuuacugagaugacauuugagccaaggcuugaaggaagugaaggagugcacuauauuaaaucugggagaagagugaugcaggcagaucaaguagcuggugcaaagcgcugagguggaaguuugucugggguauucagagaacagugaaaaggccagcaugacaggcuugcugugagggaaaguaguaggagaugagguuagagaggugggaggaugcaaauuacaggccauuguaaaguuuuuggcuuuuucucugagaugagaagcuguuagagaguuuugagcugaagagugguauguucugauuugcaggcuauaaggaucaucuuugguuuagaguauguuguagagggcagggauagaagcggagagaccaguuaugauguucuuguaaucauccaaacgagaguugaguaauuggaccaggacaguacugguagaguggaaagagguggauguauuugcagagccaacaagcuuugcugaugggcuggguaugagguauaagcaagagacaaguuaagguuguucguuuuuggccuaagaaacuggaaggacaaaguugccgaugagaugggaaagauuuugggaggaacauauuuggggugggggaagaacaggauuugauuuuaacuaacuaaauuugaggugccuguucgacauucuaguagagauacgugaguguagaguuaacagagaucaaggcugaagauagaauuuuagaauggcaagcgaaaagguuaauguaaaucuauacuauuagaugagagcagauucaauagagaagaaaagcagucuaaggacugagcccuggggcacugcaguguaauuggacagagagauggauagaagccaacaaaggagacugcagaagaaauagccuaugagguggaagaaaacuaggagagcguguugucugggaagcuaagugaagaaucuguugcaagaggaagugaucaccuggucagguuuuacugauagguuguuauguaagaugaguauguuucauuuaugccucacagcaguguuaaugagggagcacucuuacuguuauuauucccguuuuacagaugaguaaaaugaaggaaagaccauguaaauaacuugacuaaggucacauagucaguaaauaguggagcccacauuagaacauaaucccaaaaugcauuggauaaauaaauuuuaucagagcaucugggucuuaggaagaguuugccaauuuugcccuugauugcccccagucguuaaaauacuuuucuuccaugcuuuuucuuugaauaagccaaacauaaucuuuguauuauguguguguacauauauaguacaugcgcauagccauacacuuguauaugccuguacugucucugugaacacgagaaucucguaacaguaauugccguugaggaaaggggaacugagugagaacagaagugggagacagacuucucaccacaccucuuagugucuuuugaauugugugccaugugcauguuacugauuguaaaauauuucauucuuuaaaaucuaaauaacucauuuaggauucauucuauagcagcaagacauaugauuuguucuuucaggcucuggccuaacagcaucucagaagaaauugugcugaugcaguuuuuuaguagaaaauauguauuugaugcacacuuaauuccauuuuguaggccucagccucccuagugcuuucaucuuuaaaaucuuuacuauauuugcucuuucaucuauuaucuccguauuccucgcagugucuauuacaauguguuguacaaaguaggaacucaauaacuuuugaaugaaaaauuccuacuaagggauaaaucaugagaacuaccuguuauuuccucaaauuuaggcaauaaaguaacuaaauucggaaaaauuccaugaaacuuuuucucaggcacucaauuaguagcagagauuuucaguguuuguaucuacuuucaccaccuuuauuggugcauaacuuauuuccacucucuguugaaguccuuaauaccuacucauucaccaccuauuuguuuguugagcacuuccuauguucuaggucaggggucagcaaacuuuuucuauaaagagccagguaguaaauauuuuagccuggcaggccauauggucucuguuauaacucuauccuuauaguaugaaaucaaccauagaaaauuuguaaacuaauaugugugccuguguuccaauaaaacuuuauagacacugcaauuugaauuucacauaauuuucauguguugcaaacuauucuguggugauuauuauuauuuuagccauuaaaaaauguaaaaccagcugggcacagugguucaguucuguaauccuagugcuuuuggaggccaagucaggaggauugcuugagcccaggaguucgagaccagccucagcagcauagcaagacccccaucuccuaaaaaccuuaaauuaaaagauaaguuaugucuuauauuugcacaaacaaacauaaauagaaauauuugugaacauagaccuuuucagagagcauuuauuauuuggagaguggaugauccuuuuuaucaucacaaucccugcugacagcuaccaacuaguuauugaucaccuaccauuagcuucaaacccaucaugggcaucccaugccacuuaaaacaaauccgauauucuucacccuaauuuauaaagcccuaagugaucuggucccucccuguccucuagagccuccucuuucacucuuccuucaccuacuccacuuccaaauuuacagguauuuuuuucaaauccucaaauuugguaaguuuguuccuaccauaggacucgguacuacucguuccccaugccuuacgccaagagugguguuucccagacaucacauacauggcuuuucuuguuaugagaaaggaccuuccuaguugaggcuucccccaaaaagucaaucuaagucaucacuagugauucucauucauauaacuauuuuaauuguuugcauacuauuuuucgcuaauauuuuguauguuuguguauuauuggcucuauuuaucuuccaccacuggagaugugagcaaugacuuuuaucuugcucacuucucaguuaccugaucuuagaacaauaucuggcauguauuaggcccucaauaauuauuuuuugaacaaauuaaugaaggaaugcaugcauacacucaugccaugggcccagcacucugguaaaucucccugauggaggcauccuucgacuuguauucugcucuacuuguccccuucccuucuugcauacacagccuaguuucuaggaaaagugaccuauguucuguucuucagcagcuuucuacuuauaauaaauccauuacaaucuggcuuguaccucuaccccucgaaagaaacuacucacaauaguuucuccacuugccaacaacuuccuauuugcuaaguccaguggauuucauagucuucaucuuauauaacccaucaguagcuuuuaacaguuucuuccuugaaacauccauucugccuucauaucuaugacaucaucucuuuuguuuuuauuucucuuaagccauguaugcuuguggcugcaauuugaugucacgucaaauaauauagcugucuuuguggguggaaaaucauuucugcuuaauaauuucaugucuucacaguguucuaucugaagaaauuugugaaccacugcaauaagggauacauggcuuacaugcguaccuguuaaaacucuguuuaggcugggugugguggcucaugccuguaaucccagcauuuggggaggcugaggcaggcggaucacuugaagucaggaucaaccugaccaacauggcaaaaccucaucucuacuaaaaauacaaaaauuagccaggcgugcuggcaugugccuguaaucccagcuacucugaaggcugaggcaggaggacaacuugaacccaggaggccgagguugcagugagccgagaucgugccacugugcugcagccugagugacagagcaagacuccaucucaaaaaaaaaaaaaaaacucuuguuuaaugacuuuuagcuagucuuaauuuaugaaccccauuuuuaauugcagaauauaaaacgguuguuauuuuuauuauaucucaauugauaauaccugagguuguaaauuccauuuuguguagcuuucaguaggaaagauuauugagguuauuguuuugcuacaguuuuucauuuuagggaauaagagcugaaaguaaaguuguuugaaguaguuuuuuuuguuuugguuugguuugguuugguuugguuuggguuugcguuuggguuuuguuuuuugcgacagaguuucgcucuuguugcccaggcuagagugcaauggcacgaucucugcucacugcaaccuccgccucccagguucaagugauucuccugccucagccuccugaguagcugggauuacaggcaugcaccaccacgccuagcuaauuuuuguauuuuuaguagaaaugaggcuucucuauguuggucaggauggucucaaacuccugacgucaggugauccacccaccuuggccucccaaaguacagggauuauaggcaugagccacugugccugaccugaagaagauuuuuauaaccuauuuauuauuuuccuauaucaaggaaauaagaccuuuacaaaacaccuguuugcaacauuaaaaacaaaauuagggggccugggcacguuggcuguaaucucaguacuuugggaggcgaaggcaagcaauucaccugagcccaggaguuugagaccagccuaggcaacauggcaaaaccccaucucuacuaaaaauagaaaaaauagcugggcaugguggcaagcaccuauggucccagcuacucaggaggcugaaacccaaggauugcuugagcccaggaggugguguuguggugagcugagauugugcugcugcacuccagccugagcgacaaagcgagacgcugucucaaagaaaaaacaaaauuagggcuggccaugguggcucaugccugcagucucagcacuuuaggaggccaaggugaaaggaucacuugaccccaggaguuccagaccagucugggcaacauagugagucccugucucuaccaaaaauuuaaaaaacaauaauauaaaaauuaaaguagccaggcguaguggugcacuccuguggucucagcuaccugggaggcugaacugggaggaucgccugagccugggaggucgaggcugcagugagccaugauugugccucuguacuccaccuugggcaacaggggaagacccuguccaaaaaaaaaauuaguuggcagacuagcacuguuuguuaaagacuuucaauaaacaacauaagaaauaaagugauccacguuuaagccgauccuuaacuuuucuuccagucuccacaaagcgugggggugugcagggguuagguuuuucucccccuguuuacagccaccaccuccucagaggucuguguccaucaucuccuuuccuccucugguuucaacuucuccaucuccauuaucuuucccagauguucaagucuuucccauucuauaaacagauuccaccaaauccccuuccuggguacugcuucaucuuauucugccgcuucaugcuucucaauauauaacuucucucuccuacaacuuccauucaauuuuuuaaaacauuuuuuguucugaaauaauagguuagugcaaagguaauugagguucuugcuauuaaauggcagaaacugcaauuacaguuaccuuugcaccaaccuaauauacauacugaaaaguauguaaaauacaugugcaaaagaauaaauuaguuauguaauacacacacaaguuaacuaucgccauguugaaguaacagaaaauuucagcuaugccaauauccugugugcuguuucuccucacuggaaguaaccuggcuuuaaagaaaaaaaaaauccggguuaaguucacagauccuggcuuuuaugaguaaugauuucuuugcucuuuuuguaguuuuaccaccuuuguaugcauuacuuuacuguucauccugcugccuuguacucuuucuagaauaucucagaauuuucacaguaagguuaucugugagcaguugccacuucaaguggauguuucucaguccuaaucucacuaggccucucugcuauauuuaacauuguagaucaguucauccuucuugaaacaacucuaaagucuguuacuguauucuccuaugucucugcauccuuuaaccuucccuucuauguccauuucacaggcuccucugcccaccccuuaaacauugaugucuucaggguuccuuccucagcccacagccacucuuacacuguccauggugauccuguccacucuagugauuucagccuucacucuuaugcugauuacuuucagaucuacucuucagcucagacucuucugucucuacauagaaacugccuccuggagauccuuaccuagauacuccauauccaagacagucuucaucaacuuugccucuaaacuugcuccucuuucuuuuucuacuuuuucugaaucaauccuuguucacccauguucaaaaucuggaggcauccugauuuuuccuuucccucauuccccacgucuuuucaaugaccaagugauaccaguucguucuuucuuucuuucuuucuuucuuucuuucuuucuuucuuucuuuuuugacauggagucucgcuuuugucgcucaggcuggagugcauuggugcgaucuuggcucacugcaaccuccgacucccagguucaagcgauucuccugccucagccucugaaguagcugggacuacaggcacacaccaccaugcccagcuaauuuuuguauuuuuaguagagacgagguuucaccaugcuggccaggcuggucuugaacuccugaccucgugauccgcccaccucagcuucccaaagugcugggaguacaggugugagccaccacaccuggcccaaacuacaacuauccuaacuucgacacuuaaaacuggauaaagcucaugcuccuuuacuugacuuacaaggcccuccauucuugugcccugcuuuuuccaccuugucuuccauuuacacccggcuauguaugucauauuuuggcagcauguaugcucuuuuuuaguuccaugucacuguucauucuguucccucugccuaagauucuccauuugauuuacaccuaauuugagaguaaauuuaaguuuuacaccugcagggaaacuuucucugacccuucuuuaaccccauccgcuggugggggagucccccucaccacuccauuaaugccuuguacauacuacugucacuguauugacauuguuuuguaauuauguauaugccucucauguucugcuggcccauuauacuguguuggauaccgaacacaguacuuggcacaaugccaaauugaaugaggagggaagaaggagagggaagcacacauugacauuaagaguaaaagaauuguucuuaccauguuauauacuuuaauauauggaaucgccugaauacaggucuccauacaaaacucuaagaaacuucuaaggaaucccuuaccuauaaagcucuuuuggaaagaaugagguuuuaauuuucuucuaacaucaacaaacccucacaaauauucauguugcagaccaaaccuggaccacccaaaaagccgaagaccccuucaagaccaucagccuuagcauauugcuaucacugcgcgcaaaaaggccauuauggacacguaaguuugagugacauuugggcaugaagcauucuguugucagggaguguuuucugaaagaugaacucaaaaagaauguaacucuaaauacuuacuuuuuaauaaacauuaaaguaagacuuaauauauuuucaacugguuuaccccuccccucccugcuagaguaacaagcuaucagagcauauuccucuaauuauguuacauguacaugaacagguugggauaaaacuaauauaguucauaaaaucaaacaaauauaauagucaacaguaugauagcaguucucaugaguucuuacaaacacaauugcuuugacaccgccauagcaugauuuuagauuuucuuuuuuuuuugagacggagucuugcucuguuucccaggcuggagugcaguggugcgaucucagcucacugcaaccuccuucucccggguucaagcgauucuucugccucagccucccaaguagcugggauuacaggcgccugccaccacacccagcuaauuuuuguauuguuaguagagaugggguuuuaccauauuggucaggcuggucuugaacuccugaccucaggugauccaccugccuuggccucccaaaguucugggauuacaggcgugagcuaccacaccuggccgauuuuagauuuuuguuguguuuugggguuuguuuuuuuuuuuuuugguuuuuuuuuugagacggaguuucacucuuguugcccaagcuggagugcaaugacacgaucucagcucacugcaacuuccaccuccuggguucaagcaauucuucugccucagccucccgaguggcugggauuauaggcgcaugccaccaugcccagcuaauuuuuuguauuuuuuuaguagaaaugagguuccaccauguuagccaggcuggucucgaacugcuggccucagaugauccacccgccucggccuccaaaaguguugggguuacaggcgugagccacugcgcccggcccaauuuuagauuuucuacuuaguucucccguuuucccugguacaauguucaguuaagucuacaucacauacauguaaacccuggcauucaguggugaaaaaacagaugcugcaucauugacuugcucaccuaccccacaaaugcccagauucccuauccagccaacauauucccuaaccccagcugaaaaggccaaacuguguguguucuagaugcugaggugucaaagcagaagaagcuucuugcugagagcugggcaugaggccacuaggcagaugccacauuaaguaugaagcagcagcagcucauuucagagaaaggauguaauaagaauaggcucagagcccauacuucugggaaucuugaggcaguggaggaaaggcaguggcacagaaaguagaaaauucuuaaaaaagaauguauuauucccagucuccagguaggcuucuaguagccuagaaaccaagauaaacuaauaucaaaccagaucuggugucaggaggcagaaagcaugcaguguugggaguccucagacugagaaguaugagcaauaggauggggugagugguauugcagguuaccacuugaauuccaacuaugacacaucacugguguagaucuugggagcuggagaccuacauuguagggcaacgaagaaaagugcugaacagaauccauaaacagauaaaguuuaucuuccauauuggggcagcagcaaccgugggggugagacauaacuuaugaaagccaggaugaggcucugagccucaguugcaguuuuugcucugcuacugacucaaccaugugauguaaacaacccauuuuuucucuuuggucccauuucuuuaucuccaaagcagagaaguuguacaggaaaucucucagcaccaaguagugaagacuuuuuuugagacacgguacagagugcagugggcacuaucucagcucacugcagcuuugaccucccaggcucaagugauccucccaccucagccucucgaguagcugggauuacaggcacacaccacugugcccagcuaauuuuguuuauuuuuuguagagacauggucucacuaugaugcccaggcuggucucaaacuccuggccucaagcaauccucccuccuuggccucccgaaguguugagauuacagaagugagcuaccaugcccagccaagaagacuucuuuuacagaauuaucaucucuagaucuuuuacugcucuguccauuccucauuacuaaacauucagauguugucaacgucuuuuagggaacauauucacauaagcuuuccauuaccacacaaaucacauagauguacaauuuuugcuugcuuaccucuguaaagcagagggguauaauuuuagcauuuauguuuguucaauuaaagaaaaacaauuauaguuggaugcuuacuagucacuucuguuaaggcagauaggaaauauauuaaaagcauguggaauuuaucccuaaaaucuagauguagauaauuuuuaauuuacaauaaagcaaauuuggcagccucaugacugccauagaugaggaacucuagauuauuuacacuaaugaagaagaucauugguguggcuaauccagaauaguagauaaauuauauagccaacuaucaauugucugugcuaauggaggggaccagcgauguggauaaucaaaauauaauuuacauuuagcuuuggaaaacauuuguaguauuauauagcucuguguagucacaucagucuagaccauacaagacccaaauagggaacuaugcaggugguuaaagaugucuguggaccccuucccuuucaaugucagaaauccagccuuacagauacuauuauugaauggauuccucaugugaaagacuagaucuaaggugaauaugacauugcccuucccuaauuucacucacucucuagcuggggaagcaaggacaacaguagucacuguacaaagauuacuccaggagugugugaaagggggagcacgggcugggagaguuaaagauucugcugaaaugaguauuaguugaguguaucaagaccucuguuaccuuugcauaaucacaauuugcucuuuuuuuuuuuuuuuuuuuuuuuugagacagaguuucgcccuuguugcccaggcuggagugcaguggcgcagucuuggcucacugcaaccuccaccuccuagguucaagcuauuccuacuucagccucccaaguagcugggauuacaggcaugugccaccacaccuggcuauuuuuuuuuuuuuuuguauuuuuaguagagcugggguuucaccauguuggccaucuguucucgaacuccugaccucaggugauccaccugccucggccucccaaaguguugggauuacaggcaugagccaccaugcccugccaaaagcguuucuuuauguuaccauguaaguuugccauauaaccucuaggacccuccccccgacaaaaaaacaaucuaaauaauccagguagucacaacagauaaaucuaaagauagcagaaggauggaaaugauaaagauuagaaccgaacuuauugaaauagaaaagugaacagcaucaacaaaaccaaaagcugauuauuugaaaacucuuuuuuucaaacaaaagagaaacuucuggaaaaacuacugaaagaaaaaagguacuaauaaacaaugaguggaaagugugaguaacuuaagauacuauauaaauguuuuuaaauuauaagacuacuucauaaaguuaaaucugaaaaggcaaauaacucuaaaauauauguauaaauuaaccagacugacucaagaagaacaaaucaacugaaccaauaccauuaaagaaaaugaauaaggccaggcacuguggcucaugccugucaucucaacacuuugggaugccaaguuggaaggaccacuugaggcugccaguuugagaccagccuugguaacauagugagaccuugccucuacaaaaaacaaauaaaaauuaugaagucugaaacuuaaaacuuacaucacuguucauuggaauauucaucaguaagaguauaaaaacacaugagaauggccgacuucaacuugaugacagugguaacuucuggaaagggaaggagaugagugcaaaaugggaaggacuuacauggaggauuucagcuauaucaguaauacuuuauucuugggggaaaaacaggcaacuaagguaaaauguuaugguuuuauaugagggugaauauagguuuuuaauuauuuuuuuauaaauuguguguuuagaaugauuuauaauuuuuuaauucuacaaauuaaguacauaaauguuuggcugcuagcuuggcuaguucagacuuggcuuaauuuuauguggauuuuucaccuacucuuuaaaauauauucuaauuguuuuucauuacuuagcuaagaaacaacauuuuaaaguaacuuuuaggcaagauggcagaggcagaaaggggaaaguuccaaaagaaaagauuucaaacaugcugaauggaucugugucacagaucaugauaaacaaaagccugcuauguggugagugguucaggccaaagccuauggauuugggaaauacuagcuggguagaggccagagucaugagaguaggaagcuguccugggaaaaugaguaagaguagggauuucaacuuggguggcggaagcaagaagagaaacuucuuuuggggugucucacaauuaccuaggaacaauuuuaaacuaggcauaaccuaccaccaaccuaccccccaccguuaagaaucacuaccccuauaagcagugaauguugaguuaaaauaagcuugcaaaccauuugucucuagaaaaaaagaucaaagggcuuagaacuuauacccacauuuuggggauaggaagaagagauggaaaagaacuugauagaaggcuguuggaagugauggacaagcaaaggaguaauacuaacaugaggccgaauaacauaaacccacuaacagagcggcaaggcugcuaccucagacugugaaaggaguuaggcagaaaaggcugaaaaaagauacgaaggguuucauagguaaagaaguaagggaagaaaacucaagcuugaaagaauaucauaacacagugggguuuagggcugggugacccucccaacaccccagcaaggaccauauccuacagccaccacaugagguaccagugacauggggcucauuucuaauuaacaugcuccagaaucuugcaaaaagguuuuugaacagugugaccaugugacaucauaauuuuacauacaauuuauaggaauguccagaaagagaaguguaugacccgucuccaguaucuccauucaucugcuacuaugaugacaaauaugaaauucaggagagagaaaagagacuaaaacaaaaaauaaaagguauguugcuagacuucuuguuagaucacauuugcaguaguuucuaaauuucuuuguuuguacugucuuugccugcuuugggggucauugguuagcauagaaaguauuuuuaguaauuaccaaagagacuggaacuuucuugaucuccagaaaccaagcacccacuucagaaauaaucccauguugcaaucuccucacaguaaacauuuuuuuacagugaucauuuuaggaaauguccagaaaauauugcuguccaucuauauaggcagaguuuuuaaaggcuccuuugagauuuuucuguuugacagguaauuauuuuuuuuuccauuuguauuucuccaguauuuuuuuauggaaagaaaggcuuuccugcuaaguuauuccuggagcuucccugaagaagucauuuguuagaggccaccgcugcaagcagagcuccaaguucacaaccaccucugugguuucuguacuuacuguugcaaacauuguucuuuaucaccaaauuaauaucuuaucauuuaaguuuucucuaccucuguucuuucuuguuauucacuucaaggugguuuuccaaguuaucuuucuugcuuuaaaaacaaaacaguucuguauuuuuuuaguuuguucuauaccuuauuuucugacucuuuuggccuuuuacucuucuggauucuuaguucaggaccuuuccaaaaugaagguacuaauucugaggaaaauagaguuauuacucucccagcuccugcauauuuuacauauuuaauauaaaauguaugucaucuacagcuaucccuggauauugguuccaggagccuccucauuuaccaaaaucugcacuuacuuaugucccauaguugacucugcagaaccugauuauaggaaaaaguagccguucguauacacaaguuucuaaucuguggaaugguguauuuucaauccucauuugguugaaaaaauccacauuuaaguggacccacguaguucaaacucauugugcaagggucagcuguguggagaaguuauaguaguuguagauuaugauuaggcaaccaaauuagagauuaaaaagaauugcaugaaaaugucaucucuagauuaaaggauuauaugugcuuucuguuuuuuauguucuuuguacuuuucuguuuuuuccagguuuucuauaaugagcaguuauaacuuauaauuagagaaaacccauuuugguuuuuuuuuagcuaguuguaucgacgucuguagcauaaauccacuuugagguguucacuaugauccuuugaaauuuuuauaauaaaagucuaugcuaaaaguuuuuauuggccacuuuuuuaaucuuuaaagauucuauugacugcuaguuuucaucucucacuguaaccucaucucccaccuacccguaucagaaucacuaucagagauccguauuaagcgugucaagcucugacaaaacauuaacaucagcuuuaucacuaaaaccucuaagauacccgcacucacgugcacucacacacacuccucaaagccagugaucucuacccuggaggaauaaucucuugggcaguuuggcauccaccuaaaaguacuauggccaggccuuaucuuuagagggugguugaaaugucauaugagaccaucaaaaggccauuuuauaaaucuugcuuugccucauuuucaaaggcugacucgucaucauuggggaaacucguauuggucagacaugacuuuucuucacaaagcuaagaugauuacuguucuuacagguccucaucuccauugcuuaaccuuguuaaacuguugaaaaggauaauuaacuaucauuggauuucugaauguguuucauuuuuagcaaucagaaacuuggagcuacaacuauuuaauuuuuagugagugaugucauacuguuaacauguuuaaauaucuagcuucccugucuguuaaguuauuuacacuuaggaaagcucagcauggacuguuuagcugcugaauaugcaaaaauacuuuuauauuuuucaguacucaagaaaaaugggguuaucccagagccauccaagcuaccuuauauaaaagcagcaaaugagaacccccaccaugauauaaggaagggccgugccucauggaaaagcaacagguggccucaagaaaauaaagaaacacaaaaagaaaugaagaacaagaauagaaacugggagaagcacaggaaggcugacagacaucgugaaguggaugaggauuuucccaggggccccaaaaccuacucuucuccuggcaguuuuaaaacccagaagccuucuaagcccuuucaccguucaucacauuaccacacgucaagagaagacaagucucccaaggaaggcaagaggggcaagcagaagaaaaaggagaggugcugggaagaugaugacaaugauaacuuauuucuuauuaagcagagaaaaaaaaagucuuaagccgucaggcagccucugauguggcuuuucauuguucauuuggccuuugugucuauaaccuucuggcacuguguuuauuaucuaugauuaaauaaagugaguuuuugguuuuguuuuuuuaauuucagccauuccuagaguuacugaauauccauggagaucucaauucucuguguccaacaggauauuagguaagaaaguacaaagauaaaccuggacuucuccuauuccaauaugucaucuuuacucagaauccuagggauagguagaagaauucaucuuuucaagaaaguguuuuaaaaauacuuugggaaaaaaacugcaucaaagguaauuuauccucaaauuaaauccuugcaggaagagaaauuaacacuaagaaaaagucaucaauauuuuucaacuuuuuuuuuuuuuuuuuuuacuuuggaaaggacaauaacuauaaaccuauauccagauuuucuuucugcugaagcuguugucagaaucuuccuuuggacaaaacaucacuagcugacuauaaaaacaaaagugucaucauugaagcccugaagaggcagggaauugagcuucagcaaaauacaggaaaagaacuauccaguauaaaugucagaagacagauuuccuaaacaaguaaaagagacaucaaaaauuuuaacauaaucacaaugaaaucauuuuuuaccacuuuuacagcgguguuucaagcggacugucacucagaucugcagagaugaauauuacucaaaaaauuuuuuuguucucuugcauuuuuuucaacuaccgcaaagcuauacagauuuuuuuguacuuguggaucuuuuguacuucucauaaccuaaugucagacuaagaaaaauaaaauaucugagaguaaauacaug

SEQ ID NO: 13948 - RNA, 3360 nt, Homo sapiens
aaccagcauagcaccacugacauggaugccuugauagaacuccuugauagaacuuuaugaucuguucaccagaaaagauucuacaugaucacgccagacuauaauuaaggcuaaccaaucaaaauucagguacccaaaaccaguuauaauccagguagaaacuacagaucauaggaacccugggacugguuuuccagggaacccuggaauuauuuuuuaagugcuacagcauguacaaggacacuggcccacaagcuugcuucucacacguagaaacugacagacuaagagguagaugagagauuccagguuccaucuagcaguggagaggcagggcuccagcauguaucagagauaagccccaaaagcaaaguccacuuaugcuucagcagagguaagcgggcaggcuccuggcaccaccuccuccaaauggaagggaaggagggcugcaccgcucugccugugucacuggcuccucucccuggguccaggcagggccucucauuuucuccaggcuaacccacugugucccaagguuaaucucacaagacacuggucccuacaucauguaaaggguggauggggagccuccuaacaccaugucaacaugacugcuaacaaggagccacacacacaacugaauuucacaggaccucauauccuccaaugggcucuuucccacaucuacucgaaaggaaucguggguuucccuuugggcuuuucuuccugggaaucaguccaugggagaugccaagcgccccuggaacaugaaauuauccacacauguguaacugcacacucuagauuaacaggagagaaaacacgcucauuuuuguuuccagcuacacauacuuagcuuucuaaacacaaaaacugaauaauuuaucugauuuaugaaugaugguuugguaugucuaagaaagcuauauaaaacauaaaaugaacucauguucaugcaugaauuaaacugacuucaugaguucuagggagacgcauuaaccugugcuguuccccuggacgcacacuuggccucauacaggugccacuaacagcccugauggcagugucagaggacagcaaggugaggcuggggaagugaggcuguagggcccagagaggcccuagugccuccaacagucucagaugcuacuugauuacuucuaugcuaugggcugcuaacucuuacauagccuagaaaauauuuacccaugaacacuaccauguuuggauuucaaacaacuuuaaacauuugguaucagauugggggagcaacaaauaauaaaauuuagggucuguacuguuaaaaguauaguauauaacaguaauaaaaccuguguggggcauuuuugguuaaucugucgucgaaaacgguaaucuaaaccugggagaguugcuauauggggaggggagagugaagaaauggagaacaggcuuguccucggguaggaugugucagccuagacuggcccucaacaucuggacggagcaacagguaaaugugccauggaagaccccacaaaacaugacuccacaucagcagaacaaagacaaacacaagucuuuucugacuuccuaacauggaacuguaacaucuguaauacaaguugguuaaaauacugcucaaacagcacauagggaaacaauaccuugucacucucuacaaguacacacuccauuuacaauuugguuuuuaaaccagaaaaaacuguuaaaacaucuauccaacagugauguauucaaaaguauauacaucuaauaguccaagagaaugcucacucuggacccagugucagcaccaaagugcaguguuuaugacugcaaaucagguaaaaauaaaaaauacaguacuuugaggccuaggacuagcucaugauacacuuuaaagcauuuguggcagacagguguguccucaaaggccuuccuuuaagacaggcaccaaaucaccacugguuacacauaagugcauuuugcaucacuauacagggauauaauacucccaucagaagguauaggaaauuuaaaugcuacacaguuuuacaaaaauugcuaaaaaauuuuuuuugcacuucaauuuuuaaauuuuuaaaugugccacuuuuaauaucaauuacaaacuacuuucugacugcauuacucaaccccaaggaagcaccugguuucagggauugcaucccuuucccaagacgugcacuucacucagaaaugcagcagcacaaauacuacauguuaguucuccgguuauuaguugcuaaacuguuuaagagccacugggcagcuggaagccucgaacccaaaggcauuaacugcuuaccaaaagaaauucagucugacaacuggccucagcguugucuuguaaggacaaacagcuagagcaaagugcugggaagauugcugcucugccagcgcaggcagguagucuuugagugcuuauacagguggcuggacugacuaaaccucuugccacacuucaggcaggcguaaggcuuuucaccugugugaacacggaugugcuucuugcaaucugucaaagucagaaaaguuuugcagcagauuuugcaggcauacuugcgagcucccucuacaaccaaaacauugugcucugauaaggccuucuugcacuuugacagaacaucugcagaugcccuggucaacuguggagggccaggcugggaaggauggccauuuucaaaugaggacguagcuccauucaucauuagcugagaacugguagaguuuucugggaucugugagcuccugacggaaguuacaacuggcauuuugggagcuaugcggcgguaguaaggaaaguuacuggcuccuccccuuggggaaccuaucauuacccuggagaaggaggaguggaggcccaaaccagaccuggaaaaguccaucccaaacuguucuccuccuugguagccugaagucugcacacacggcaggcccaucaccuccugcauaggccugacgaagugggagucugcagguucacuaaauggguucucuacaugggagccaggggcagaggagggcccaccugcaggcccagccucuggacucaacaaauagggggccucacucuccagccugcagucacuagugguguuuggaauauuaucaucauuguucugauuugcaguaaaguuauuuccucugcucuuguuaagaaaauucgaaauacuaaaaguggacuuaugcucuagguuauuugugacuuccaaaauauggauaucaccuacccugucugugcuagacuggggaucugaaaaacuccgaucacugcuuucagggcugaggucuaucuucucggcacugaccacaacuccuuccacuuccacagacucgcugccuucugcuugugag

SEQ ID NO: 13949 - RNA, 4198 nt, Homo sapiens
cuuuucuuaauugauauguuuauuaaaaacauagacuaauaaugauccugugcuuaaaugucauugugguugugugcugauuuccacaaaacauaauauaagagacucuucacaaauacacucugggcagaagaaaaagguaaacagaaaugacugacaagacagugccauuucagacacagcucccuuaauacuugcuagaaaacggaguuugacauuauuuacaauuauaccaguauugucagaggccaaacgucacagggauaaggguacaccagaucacgagacaucguuucauacuucccaaauaguuuuauauuuuagcuuugaaggucaguuaccagagccaaacuuguucuuaacaagcagaauuuuauguccauucaaagagucucuuacaccuuucugggccuauucacuugcagagaggagucgaaacuguaaccaggcucuucauaucgugcauucauaugugauguccugucuucauaugcuguccaauuucuuuaagauaaauggagcugaaagaaaaacaaaucuaaaauuaguuuucaaaucuauuagcccauaggcuacauuauagaauuaucagguuuauucaacauguuuuugaaaauaacuccaagugauggucaagcaugugccuguacagcccagcaaaagggacuaguugccuuccaaagcagcccauuccacugucauucagcuauuauuguaaauuucauucuuauacuacauaaaaccuuuucuccagauaguuugccccuuagggccauaaaguauaaauccaauucucuuucaaaugacaaggcuuuacucuagcgauuuauuuuaacuguaaaaggaacaaaacucuagaggaaacaaaugggcauuuuucaccuuuaaaaacucauuugaaaggcagaggauaugggaaaacacugaacuagagaaccggaagagcuggacaccuauuuugggucucuuacugauuagcuauauaucacuuaacauacucuagaucacaucugauacaguccuaccucagucauuaagagggucuaauaagaucauguacauagaaaugucuagaaaacuaagugucgacauauagaucuaaagaagugauauuacuguccuguguaaaaguguugugaccaaaaaaaagcuacccaaaucaccuucuuucucaauacucauacuaauagaauuuuguuaacauuauuuuauuuauuuauuuuuuucagccuccugaauaguugggacuauaggcacaugccacuaugccuggcuaauuuuuguauuuuuuuaaaagacgagguaucaccauguugccaaggcuggucuugaacuccugagcucgaacaaucugcccgccucagccccgcaaagugcuggaauuacaggcaugagccacugcgcccagcucaauuucuuaauauuaaacugaagacacugagaucugucagaagcugauaaagucagcaguauauccaauuuuuccuacuaauucuuaacgacagaaaaaaauccaugaaaugaucaauggauaagcaaaaugugauacauccuuccaacagaaacuuauuuagcuaucaaaaugaaguucugacacaugcuacaacauggaugaaucuugaaaauguuaugcuaagugaaauaagccagacacaaaaggccaugcauuugacaauuucauuuaaaugaaauauccagggccaggugugguggaccacaccuguaaucccaacagguugggaggaggaaaugagaaggauugaucgagcccaauaguuugagaccaaccugggcagcauaaugaaaccucgugucuacaaaaaauaaaaaauuagcagggcgugguggugugugccugcagucucaauuacucaggaggcugaaguaggaggaucacuuacuugagccugggaggucgagguugcugugagccaugaucacugcagccuccaccucugcacacuagcuuaggcaacagagcaagaccgucucaaaaaaaagaaaaaaaaaauccggacuagacaaauccauagagaaaaaguagauuagucguugugaaaggcuggagaaaagggggaaaugggguaacaaugaauucguaugguguuucuucuagggggaaagaaaauacugucaaauugugauggcugcacaacugacugcuaaaaaccacugaauuguacaccuuaaauggguauauuguauaauauacaaauuauauuucaacuuaaaagugaaaauaaacaauucauaucaaauacaaaggucacugagaagcagcaaauauuucacuggcagcuagaucaaugaaaaaggcaggaggcaggaaauaaguaaauuugggaguugcaagaagcuguugaacuaggaugauacggguguuucuguuccccaagacucgcucuucugugaaagcagaguaauaccauagacagugaaagagacacagaauaagggacaucucaguaucagugagcucuggccuaagcccaacaugagccuucaauaggaugacuuugguauggccuucauuuauuugaaccaucccugccgcuccauccagacuggcuggccaauaauauacagcaaggaacaauggaaaggauacugaauugagaacgagaaggcagggcauucgagaacugaucauaaagcugcuuccaguucuuauauucaguguuccuauaacucugauaccuuccuuccuugcuaaguccccucugaaaaucaaguucucauuuguaaaaugauauaaagaaucuuaggcccugccucccucaaagguccacugucaagacuauauaaugggaguaacuuccugucaauuuuaagauauagaaaaaaaaaccucaaauauuugcauuaauccuauagacucauauucuuuuuucccauuuuuuuccaaaaaacuaaugacucacuucacccucuauacaaagaaacagaaaugaagcaaaacuuuuuggauuucaaaggucagcacuuuugaaagggaaggaacccggccgcugguucacgccuguaaucccagcacuuugggaggcugaggcagguggaucaccugaggucaggaguucgagaccggccuggccaacaugguuaaacacccaucucuacuaaaaauacaaaaauuagccgggcgugguggcgcgcgccuguaaucucagcuacuugggaggcugaggugggagaauggcuugaacucgggaggcagagguugcagugagccaagacugcgccacugcacuccagccugggcaacagggcgugacuguguaucgaggaaaaaaaaaaaaaagaaaagaaaagaaagggaaggaaccugguacugaguuaagaguucuggauuuuaggucaagaucauucacugaaucgcugagugaccuuuggccagccuucccaagaaggcuguuucuuccuucuagaacuaugguucuguuucucuguuucucugucugcaaaaacgagggaguuccucuagggauaauuacuugagcucuuucagcucaaacauucuuuuuuuugagauggagucuugcucugucacucaagcuggagugcagugucgcgaucucggcucacugcaaccuccgccuccuggauucaagcaauccucccaccuuagccucccgaggagcugggauuacaggcgcccgccaccacgaacuccugaccccaaaugauccgcccgccucggcuucacaaagugcugggugggauuacaggugugagccaacgcgcccggcagcucaaacauucuucaagcugggagaaccaggaugauuaaacacgcgcgccggccaccacgugcacuucagugcccggacccugacccgcagaccucaaaccgcgcauaugcccgucgccuucaacgcgcacccuccuugcuccccgcuaccguucagcucaguucgaaggccccgaugaccccuuagaguuaaggggugcccgucggugagcuccccgcuggucucacagucacagcccgggagacacucacugacucgcaggagggccacguagaugagaaaguuccguauggaggagaucacauccucgcgcaucuuccguuucaucuccuccggguccagcuucggcgcgaggcccucaauccggaacaucgcggcucugacuuagcagcuuccagccgccgcgcucugcucuccacgguggccgccucgcgcccggaacucggccu

SEQ ID NO: 13950 - RNA, 4198 nt, Homo sapiens
aggccgaguuccgggcgcgaggcggccaccguggagagcagagcgcggcggcuggaagcugcuaagucagagccgcgauguuccggauugagggccucgcgccgaagcuggacccggaggagaugaaacggaagaugcgcgaggaugugaucuccuccauacggaacuuucucaucuacguggcccuccugcgagucagugagugucucccgggcugugacugugagaccagcggggagcucaccgacgggcaccccuuaacucuaaggggucaucggggccuucgaacugagcugaacgguagcggggagcaaggagggugcgcguugaaggcgacgggcauaugcgcgguuugaggucugcgggucaggguccgggcacugaagugcacgugguggccggcgcgcguguuuaaucauccugguucucccagcuugaagaauguuugagcugccgggcgcguuggcucacaccuguaaucccacccagcacuuugugaagccgaggcgggcggaucauuuggggucaggaguucgugguggcgggcgccuguaaucccagcuccucgggaggcuaaggugggaggauugcuugaauccaggaggcggagguugcagugagccgagaucgcgacacugcacuccagcuugagugacagagcaagacuccaucucaaaaaaaagaauguuugagcugaaagagcucaaguaauuaucccuagaggaacucccucguuuuugcagacagagaaacagagaaacagaaccauaguucuagaaggaagaaacagccuucuugggaaggcuggccaaaggucacucagcgauucagugaaugaucuugaccuaaaauccagaacucuuaacucaguaccagguuccuucccuuucuuuucuuuucuuuuuuuuuuuuuuccucgauacacagucacgcccuguugcccaggcuggagugcaguggcgcagucuuggcucacugcaaccucugccucccgaguucaagccauucucccaccucagccucccaaguagcugagauuacaggcgcgcgccaccacgcccggcuaauuuuuguauuuuuaguagagauggguguuuaaccauguuggccaggccggucucgaacuccugaccucaggugauccaccugccucagccucccaaagugcugggauuacaggcgugaaccagcggccggguuccuucccuuucaaaagugcugaccuuugaaauccaaaaaguuuugcuucauuucuguuucuuuguauagagggugaagugagucauuaguuuuuuggaaaaaaaugggaaaaaagaauaugagucuauaggauuaaugcaaauauuugagguuuuuuuuucuauaucuuaaaauugacaggaaguuacucccauuauauagucuugacaguggaccuuugagggaggcagggccuaagauucuuuauaucauuuuacaaaugagaacuugauuuucagaggggacuuagcaaggaaggaagguaucagaguuauaggaacacugaauauaagaacuggaagcagcuuuaugaucaguucucgaaugcccugccuucucguucucaauucaguauccuuuccauuguuccuugcuguauauuauuggccagccagucuggauggagcggcagggaugguucaaauaaaugaaggccauaccaaagucauccuauugaaggcucauguugggcuuaggccagagcucacugauacugagaugucccuuauucugugucucuuucacugucuaugguauuacucugcuuucacagaagagcgagucuuggggaacagaaacacccguaucauccuaguucaacagcuucuugcaacucccaaauuuacuuauuuccugccuccugccuuuuucauugaucuagcugccagugaaauauuugcugcuucucagugaccuuuguauuugauaugaauuguuuauuuucacuuuuaaguugaaauauaauuuguauauuauacaauauacccauuuaagguguacaauucagugguuuuuagcagucaguugugcagccaucacaauuugacaguauuuucuuucccccuagaagaaacaccauacgaauucauuguuaccccauuucccccuuuucuccagccuuucacaacgacuaaucuacuuuuucucuauggauuugucuaguccggauuuuuuuuuucuuuuuuuugagacggucuugcucuguugccuaagcuagugugcagagguggaggcugcagugaucauggcucacagcaaccucgaccucccaggcucaaguaagugauccuccuacuucagccuccugaguaauugagacugcaggcacacaccaccacgcccugcuaauuuuuuauuuuuuguagacacgagguuucauuaugcugcccagguuggucucaaacuauugggcucgaucaauccuucucauuuccuccucccaaccuguugggauuacaggugugguccaccacaccuggcccuggauauuucauuuaaaugaaauugucaaaugcauggccuuuugugucuggcuuauuucacuuagcauaacauuuucaagauucauccauguuguagcaugugucagaacuucauuuugauagcuaaauaaguuucuguuggaaggauguaucacauuuugcuuauccauugaucauuucauggauuuuuuucugucguuaagaauuaguaggaaaaauuggauauacugcugacuuuaucagcuucugacagaucucagugucuucaguuuaauauuaagaaauugagcugggcgcaguggcucaugccuguaauuccagcacuuugcggggcugaggcgggcagauuguucgagcucaggaguucaagaccagccuuggcaacauggugauaccucgucuuuuaaaaaaauacaaaaauuagccaggcauaguggcaugugccuauagucccaacuauucaggaggcugaaaaaaauaaauaaauaaaauaauguuaacaaaauucuauuaguaugaguauugagaaagaaggugauuuggguagcuuuuuuuuggucacaacacuuuuacacaggacaguaauaucacuucuuuagaucuauaugucgacacuuaguuuucuagacauuucuauguacaugaucuuauuagacccucuuaaugacugagguaggacuguaucagaugugaucuagaguauguuaagugauauauagcuaaucaguaagagacccaaaauagguguccagcucuuccgguucucuaguucaguguuuucccauauccucugccuuucaaaugaguuuuuaaaggugaaaaaugcccauuuguuuccucuagaguuuuguuccuuuuacaguuaaaauaaaucgcuagaguaaagccuugucauuugaaagagaauuggauuuauacuuuauggcccuaaggggcaaacuaucuggagaaaagguuuuauguaguauaagaaugaaauuuacaauaauagcugaaugacaguggaaugggcugcuuuggaaggcaacuagucccuuuugcugggcuguacaggcacaugcuugaccaucacuuggaguuauuuucaaaaacauguugaauaaaccugauaauucuauaauguagccuaugggcuaauagauuugaaaacuaauuuuagauuuguuuuucuuucagcuccauuuaucuuaaagaaauuggacagcauaugaagacaggacaucacauaugaaugcacgauaugaagagccugguuacaguuucgacuccucucugcaagugaauaggcccagaaagguguaagagacucuuugaauggacauaaaauucugcuuguuaagaacaaguuuggcucugguaacugaccuucaaagcuaaaauauaaaacuauuugggaaguaugaaacgaugucucgugaucugguguacccuuaucccugugacguuuggccucugacaauacugguauaauuguaaauaaugucaaacuccguuuucuagcaaguauuaagggagcugugucugaaauggcacugucuugucagucauuucuguuuaccuuuuucuucugcccagaguguauuugugaagagucucuuauauuauguuuuguggaaaucagcacacaaccacaaugacauuuaagcacaggaucauuauuagucuauguuuuuaauaaacauaucaauuaagaaaag

SEQ ID NO: 13951 - RNA, 4937 nt, Homo sapiens
cggaaacgguguuugguggagcccgcgauggccgaaccugcgucugucgcggcugaaucucucgcgggcagcagggcgcgcgcugcacgcacaguacuaggucagguggugcucccgggugaggagcugcuccugccggaacaggaggacgcggaaggcccugggggugcaguggagcgaccguugagccugaaugcuagagcgugcucgcgggugcgcguuguaugcgguccgggccuucggcgcuguggggaccgccugcuggucaccaagugcggccgccuccgucacaaggagcccggcaguggcagcggcggcgguguuuacuggguggacucucagcagaagcgggugagcugggacuccggagggguggugcggcagugagagugguagcccugcuuugagaagaccucccaaaagaagagagggacccugaggcccucuuuuguucaggcaaaccuagagccaccguagucuugugcccacuucugcauguccuuuagagggaccgugaacaauaggaacauagccugagaagggcgaccaggagagaaaaacguuuggagaccgugagucaugauuauagucuucaaaaccccacagcaggccugccguuuggagucucagagggcaggacuaggcucaaugaguggaugucauagggaguuaauuucuccuagaacagguaagaauuucauauagaaaaaauugucuauggaaugggcuuccuugguuguaaggauuccuuugccacuggacuuaugccacaaagcuagagacuuacugguuggggugccuaagagauaauggaguuuggacucaauuaacagacuaccagaagcugcacacccggcacuuuaugaagugauuuucuuuuaccgaaaguggcauuugaucagauuucucuuuaaugacaauaaaguaaccacaaaggacuugcugaagguaucuuccaaugguaucuugucauuuauggcuguuuuuucauucuguuucuuuuuguaguauguuccaguaaaaggagaccaugugauuggcauagugacagcuaaaucuggagauauauucaaaguugauguuggagggagugagccagcuucuuugucuuacuugucauuugaaggugcaacuaaaagaaacagaccaaaugugcagguaauuacgggagccuuugguuucaaagaaacaaacauccauucccuagaacacucacauauccagaaggcuaucugaauugucuccaaagcaugaccuagaucucugagcuuguauauaauugccccaggcuccaagaguuucuucagaugcuccaggaucagagccacauaauuauuauuauuauuuuuuacauuuacaauuuauuuuacauuggcuacauuuguucuugggauguuucauuucuacugaguugaaagguuguaucuaucaucgccauuauuuguuauguccauauccucuggacaaggaugucugcuguaggcuuagaggagggacagguggugcaaauugacauuaucagcuauccauccauccuggcuguagguccuaggagcugauagaggaguaauauuguuaccuuggguuuucaauuugagcuuuucagguagcauagccacacucuucuugucuauccagccugaaauuuagugauuucuucaccucuucucauucacuucucaugcaaauuuaguugcuuaauccuauuuugauccuauuugauucugucucugaucuuuggcauguccgucccuuuaucuccacaaguucaggcuucagcucccucuugacuggucucagucacuucuucauuaaucccugccuccacgcuuuuaccucaccauccaggauuuugagagcugacauccucacacggucacuuucucgaaaagacaagauucuccaaaaucuacagaauuccuuggcauuacacuccaggugucuuuccucaucccuaauuauauccuucauacagccauacucaaaucacaccaaacgccauuaaacucaauuuccugcccuuauuugcacaugcuguucccacugucuugauugcacuaucccuucgcacccuauggaacacauucucauucuuugagacguaggcuaaacaugaccaccucuguaaagccaucucuaguugccacuuuucucguaucuuugcucuagcacuuacuggauugagccuugacugagguuuguuuauauguaccuccccacugcccuccaagaccaaaugcuucugaaaagcagagaauguuuuguuccuuucuaguuuacauagucaccaacaaacaguagguacuuaauacguuuuguugagugaacagaaugaguucacucuccauuuccucaguuucgucccuuugaaguuuagcucuaugagguuuuuaaguaaauccugcagggagaagugucagugaauuauuguuugauuuugcuuugaauaauuugcaugccggaguuccuuccuuucucuguaaaucuguaauucucuaggguagugcgaccuaauauaacuuucuacagugaugcuguuuuguaucugcacugauuaguaugguagccacuagcuguugagcacuugaaauguggcuaaugcaacucaggaaauuaauuuuaaauaccuaauuuuaauuuaaauguaaguuuaaacaauuggcuaucuaccauauuggacagugcaauccuaguguucucuggccuugagauggcuccucgucugugauuuccugauuggugaaagggaaugauacauguguuccuuuuuuuccccaagacucaacuccaaagugacugugggaauccuauagugcagucagucccuuagccacagaacuguagguggcuggcauugaugccugugagaaagaaccaauaguagcaccuguaguuugcugagaggaaaugaacugguuuuuaauaucauuguagguuggagaucucaucuauggccaguuugugguugcuaauaaagacauggaaccagagauggucuguauugacagcuguggacgagccaauggaaugggugucauuggacaggauggucugcuuuuuaaagugacucugggcuuaauuagaaaguaaguccugaugucugcuggcuugacugcuuuuuauaauuauacauucuuggaaaguugguuaaucuucaggauucagauucuuuguaacguuugaauuucuccucagaguuagaaaucaguauccauuuuaacacauuuggaaacucaugaauuuaauccuaucuucuuggaaacauaucaaauucagauguguuuggcuguguaguuucuggugggcugauacuucaugccuuaagcucuuacucuguauucauaucuuccuucccaggccuguugcuuauuugacuuagcccaaaugugaaaacuggccuuuccccuguucugagucacuugaauacagaugcagucugcaguuguauaaaauuaucaauuuuuucuaauuaugggggucacacgcagcuuagauugugauguucaagguuauguagacauucacagaaggcuucugacacuuggucauacugaggcauacugagguucaugcugaggcagauucucuuuuugguguuuagaacuuuacccacccaaagcugugccauauucaggggcuuuacuccuagagccagugaaguugagagcuaucuuguaugccucuccuuacuacauauccuaaagaucuggagaauuaaguuuggacaucagagaagcauguuuuuaaccaagaagcauguuauuaaccaagcaccacccuuaugguuugaaagagccaauguuccucuccaaguacugaauuuaacacaagagaauaauauggccaggaaaauaaguuuaaagugucuuaacacuguagauaaaaaaaguuaugauucccagucuagaauuaaagugcucugaccaucuaggggaaugacuuuuacaaaguugguaaccuagggaguuugauuucuuuguaaggcauagcccaccucugugauuucuaguauaccuuugaacaguguaaaguuccuucuuggaagaaaggaggcagcaaaugucaucacgugccuuguucuuguugaacagcuauggagaacugcucagaaaaggaaucacauucuaaaggagacuccggacacaccuuugccacuucauuaaauuucauuuucuuuucucuucccaccaggcuauuagcuccagauugugaaaucauacaggaagugggaaaacucuauccacuggagauaguauuuggaaugaauggaagaauauggguuaaggcaaaaaccauccagcagacuuuaauuuuggcaaacauuuuagaagcuugugaacacaugacgucagaucaaagaaaacagaucuucuccagauuggcagaaaguugauauagguggacuuuuuuacaggucaguugaggcaaaaaacuauggguuuuuucaggugaaccucccccauuuaaauacucagaagauaaggugugaauguauguauuauuagaguccgaaaguauuuuuauaaguuacugguuuucacccacgcuuuugugggagagaaaaucauugcaaaaucauuuuuuuuguucgguacaauaaaguuuacuaaaaaacaguauuaggguuuauuuggaguuaacucccuuaguaauugcuacagcuuccauaauuaacuggaggucagcaguaaaauaauuuugugauuauaacaguaagccagguucaccagaggaaauguggaauaccuaaguauaaagcagcaaagaaaugucaccuguagucccauuauucagcgggugaguauauaacaacgaaauacuuuuucauuuaccaaguauuguguuuugcauggauuaacuccuuuauucuaacugcagaagacacuuauccucauaauugaaacugaggcacagaauuuaacuuggccuacauucuc

SEQ ID NO: 13952 - RNA, 5658 nt, Homo sapiens
uaggcagcgccccaggcgcaggcggagccucauuggccgcugagccccgggcugcgcggaggcgggaccugcggccagcccugggcggccauguggacagagcugggagggccggaaccagaacccaagcgugauccugaaccggagcccgagccugcugcagguaacuaacgcuggucuccccucggcucccucgggaagccgcagcuccuggcuccgcgugggggcuuuccucucugggccgcggcguccgcaucugggggcuggccuuuccgccguugcacuguaggacucucuccacguccccuaaucccaucccccgccucugggugacgcuacaggagccccgaggacacagacgcccccagaccuuaccacguuagcucgaccucaacacuccugcccacucggcccacuucaacagagggccccugaccauagcccagaggcuuggacaagcccaaagguugcgcccuuucccccgcagaaggggugaggugggcgccgcugcaguucccgcggauagagaagguccgguccuucccgcugugggugaacuguaaaaaauugccuguauucaggaggauaugcaaagcuagguuuguggaagucuggggugaggcuccuauacuuucuugcuguguguccucggugagucccugaaccucucugaugcccagccuucuuccagaaugggggucaucaucaacccugaccacccagggacugcagagaggcuuggcaaauuucccgugagaagacagccugcaaacuguaaagcaugaugcucugugagcugugaucuuccuaucagcaaguggaggccccagcaagaaccccauauaggccccaagaguaggaacggccuugguguggcugcaaagguuugccagccuuggccuaugaccaccucuccugacugcuucaccccuccaauccuuaccccauggguuggugacuccccuuuccccuaccuccuuuuggucuccucacccucagagccaggccuguugguggcaagggggcugugucccagcauauggcaaaguccugagcuaaauggaacccugggcaccccuggcagaucugcugacucagcuucccccugugggauaugaugagguuucucuucaaauaaucugaucaaucuuuuauucuuuaauucuuaguaucccccccuuuuuuuuuuucauuuuucuccuuuuugccuuuguuagaugcccaggcaugccacaguaccaagcguuaucaguaccagcucacauuccuuugcuuauuuggaaagaagacuaacuuucuagcucauuacagacacccuuuccccuuucucuccacuuucuuuuacgugcccacucuaucuaaaauaaaucaaauguuuagccaaccgggauuaguuuagauuguacgaccugaccccagccaauggggaaaggguacaggggcaggacuugcaucaggaauaaaggcucucgugccccuuuguucaggugugcucucauggcaacuggccaaggaggcaucccucugcgcagaaguaaaauugcuuugcuaagaauccuguguucgaguguucaauuuccuuaggauuuugagcauuauuccuaacacccgcaaggggaagggaaacuuucuuggucagcauugauuauuauuauuuuuuuuagauacagucuuguucuguuacccaggcuggagugcaguggcacaaucauggcucacugcagccucaaccuccugggcucaggugauugcccccaccucagccucccaagcagcuagaacuacaggcaugcaccacuaugcucggcaaauuuauuuuuguuuuuuuguagagacacgguucuugcuaugugcucaggcuggucucaaacuccuggccucaagcaguccuuccacuucggccuaccaaagcguuaccagcguaagccaccacgcccaucacauugauuuuuauggggccggggaccuacauggagccuugcuuuccugauugaguuuuuuguuccucucccugcccagggguggagggugagaggcugggggugaagggacaggcaggugcaauuccauuuuaccgcugggcggagcaagacucaugagacaucaaaggcagagagauucaaauucugacugaagaauaacugcuucaacuaaucugggaacacuacacucuguuuaauuuucauuuaauauguauuauaugccguuuaaguuuuauaacaguaguuguuuuaacgaagucuacacucuucagaguuguagcuuuucuucucagcugccuccugacuugcugcaccucugggaaagcugaaaagggaugcugagaccugugguugggggaugcugggcuaggucaauuucugaggcacggccaguucugauguccugaguggagcuugccaggguuuuuauaugcaagacaucauucaacauaaccccaugaggcauuucacauaugggggaacugaggcacagaggugaaaugaagcaagucccucucagagaacaaccaucuccaagucccuuugauuucuacucaagucuuaggucaauucuuagacagccuuuguggcaauuucaguguuuucucaguguaucauucaguacuguguguugagccgcugcucuguagcaggcauaccucuaggcucggggacguagcagugaauggaacagaaaaauaaguuccugugcucauggagcuugcauuuuacuggggggagacagacaaacauauaagccuguaaagauaguauuugggaugugagauagagaaggaguaaagcaggguagcggggauagagaguguuggggugggaaggguugcaauuuuuuaaaggguggucagggaaggccuugcugagacaguggcuuuugagacccagcagaggugagggagugagcugaggauaggcgggacgugauggaguuggcccagagaguucaucagggcccucacagcucuuacagucuguguuuuuagaggugacaguccuuuaugcuggaaucuugaaauguuugagcuggugggcccuuggguaccgccaccugccuucucccaccuguucacccugguuucuuuugucccucuccagagugucagcaugcugcgcuuccuggcaccccggcugcuuagccuccagggcaggaccgcccgcuacuccucggcagcagcccucccaagccccauucugaacccagacauccccuacaaccagcuguucaucaacaaugaauggcaagaugcagucagcaagaagaccuucccgacggucaacccuaccaccggggaggucauugggcacguggcugaaggugaccgggcugauguggaucgggccgugaaagcagcccgggaagccuuccgccugggguccccauggcgccggauggaugccucugagcggggccggcugcugaaccgccuggcagaccuaguggagcgggaucgagucuacuuggccucacucgagaccuuggacaaugggaagccuuuccaagagucuuacgccuuggacuuggaugaggucaucaagguguaucgguacuuugcuggcugggcugacaaguggcauggcaagaccauccccauggauggccagcauuucugcuucacccggcaugagcccguuggugucuguggccagaucaucccguggaacuuccccuuggucaugcaggguuggaaacuugccccggcacucgccacaggcaacacugugguuaugaagguggcagagcagaccccccucucugcccuguauuuggccucccucaucaaggaggcaggcuuucccccugggguggugaacaucaucacgggguauggcccaacagcaggugcggccaucgcccagcacguggauguugacaaaguugccuucaccgguuccaccgaggugggccaccugauccagaaagcagcuggcgauuccaaccucaagagagucacccuggagcugggugguaagagccccagcaucgugcuggccgaugcugacauggagcaugccguggagcagugccacgaagcccuguucuucaacaugggccagugcugcugugcuggcucccggaccuucguggaagaauccaucuacaaugaguuucucgagagaaccguggagaaagcaaagcagaggaaaguggggaaccccuuugagcuggacacccagcaggggccucagguggacaaggagcaguuugaacgaguccuaggcuacauccagcuuggccagaaggagggcgcaaaacuccucuguggcggagagcguuucggggagcgugguuucuucaucaagccuacugucuuugguggcgugcaggaugacaugagaauugccaaagaggagaucuuugggccugugcagccccuguucaaguucaagaagauugaggaggugguugagagggccaacaacaccagguauggccuggcugcggcuguguucacccgggaucuggacaaggccauguacuucacccaggcacuccaggccgggaccguguggguaaacaccuacaacaucgucaccugccacacgccauuuggaggguuuaaggaaucuggaaacgggagggagcugggugaggaugggcuuaaggccuacacagagguaaagacggucaccaucaagguuccucagaagaacucguaagagcagcugucagggaggcccagucacaguccagcaauuccacaaccaccuugacgaaugcuugccaagcuguuuuaaagccaagaacacccuuucuuuguuccaaauuaacucuuagaagaaaccccacaaauaaagcaauucaaucaaggcuguucuauuuaaaucagagauggggaccaggcucagaguucuaccuaucuaacccccaaccacagcccccuugguggcccaugaguugcuuccaugaaaucuuaggagucucuggaggacagauuaaaaaccagugaucuguaauuuguagcucuuccugcugauccaaggacuuucccaugggugcgcuugaugguuuaguggaucgacucaacucagaacacaagcuuggaaaguguuagggguuuugaacuagguggauacuaaaucucggccccacucuucauuggcuuaaccuaaaaaccagaggugcuuuuccuugucugugugccaguugcuggcuguuuuaguugcuugcccuucauuuugcuacugauuuuccuuaauuugugggaaggaguaggcaaagaauaugcuuacaugauuacaccuguaaaguaagcccaaacaucccaaauguccgucaacugaugaguggauuaauaaaauguuuccauggaauauuccuuggauuacucagccauaaaaaggaaugaaguacugacacaugcugugacaucagugaacccugaaaacauccuucucagugaaacaagccagagagauguacaaggcuacagacuguaugauuccauuuauaugaaauauacauacuaggcaaauccauggagauggaacauagauuagugguugccaggggauagaggaguaauuguuagugggcaugggauuuguuuuugggagguuuugaaaauguucuggaguugaacaauaguaaugguugcaugauuugguaaaaauacuaaaaacuauggaauuguuuaauuaugguauaugaauuaauuuc

SEQ ID NO: 13953 - RNA, 38937 nt, Homo sapiens
uggcgucggcgcaagggccgccgggaaaaccauugagaggccaccgggaaaccauugagaagccccggaggaccggccugagcggaggcggagacuagagcggccgccggcacgacccgccuucaggcguacgacgaccgcggcccgggggcucugaguggccaaagcggcggcacuuucugcguggccccggaaggacauagagcggaaggcgggagaaagaaguagccggcaggcggaggcagcccgagggggcgguugcaugugugccagacguucguagcccacugagcuuccucacgccggcugucgcagcgccuagccccacccggcggccucuccugcgcuuccggggccguggcgagcuagugcgccugcgugccggcccauccgcgcgccuugcagcuguccuugcgucggccagcggccagacaguuccugcagcgcuuaccgccuggccucucgguuccgcggcgcaccggagggcagcaugucgcggcggcggcacagcgacgagaacgacggugagugccugcggcccggccacggaggccgcucccgguugggagccgaggcucggcgucuuuggguguccacggaagagacuggaagcucuucuccccgggaacgugcggggagccgcggagggaaagaggagaauaugguggcgguguggucgggcggcuucuagaaagcgacuucucccccgccccaguucuuugagucaagggccgauccucgggaaagaaggccuggugaaccccauggguagacccuuggucucuaaggaugcuucagaauuucguccguaaaaccacggagcagggaagcacaccugugucugugcugccgccucuuagggacccacugguccuagugucucguuuuaaccuucaaagcugcaccugaaaagggcucggaagaauucacugaaggaaaggacugagagaucucaugaguugcagucugaacucuguuccgguagugguuauccguugauuucacuucuuucaagcugcagggaaagaauauugucuuaccugcgcccaagaggucccuaauaaacagacacagguuacugcagauuuugaacuggccguaagcgcauuucccuugugugagagagagugcuagaaaacuaacuucaggccucugagagaguuagaacagggguucccaucuccguuuggaugauugugcucguggagaucaguguugccuucauaaagauggaauaauucuaguuuuaacaacaacaaaaaaaagaugcuuauauuacacauaagccuuacaaucggucaaaaacacaaauccacacaccaaaaaaguaaaacuuagaguaauucuauuguuaacauuuuaguguauuguuuuuugaagagaguguauaguagugguuaagagaugagacuuuggaaccagaggguuuagguucaaagccagacccuaccauuuacuuggugaucuuguccagguuaugaaaucuccuuaaacuuuagucuguaauacagaaguaaugauauuuauaucuucugguuuuugugaagguuaaaugagguaauacacaucagcaacaaugauguuuuaucauuugccaacgcuuaagaggcgguaaacguuagcagaugcugucaauguaagaaaaaaacccauaacagacauuuuaaauugaguaaauuuuaucuacuaacguuugucucuccuugaguguuguggcaguugagguggaggcagaaucgcaugcauuuaguuuuaauagugaaacaccagauuucuacgaaggaauggcuugagaggauauucuaguccagcuuucuaucugacaccuaagggucuagagacugagcauaacuaagauggagggacagcugucaguucccaaacaccagcaagagcgaauccaguccggggcucucuucacuacacagguauaaauuaaauaacuaugcugcgugcuuugauuucuaacacgagguuucuuguguaaccucuguacaaggcacagaaaauacaauucccucccuuuuuuuuuuuuuucugagacggagugucauucuuugucaggcuggagugcaguggcgcgaucucggcuuacugcaaccuccgccucucaggcucaagugauccucccaccucagccuccuaaguaacugggaccacaggcgcgggccaccacgcccggcuaauuuuuuuuuuguuuuuguauuuuuuguagagacgggguuucgccacguugcccaggcugaucuugaacuccugagcucaggugauccacccgccucggccuuccaaagugccgggauuacagaugugagcuacugcgcccgccgauaauacaauuuucauaugcuuuguaauugacuagucaaaaacuaauauacuucucaagucauuacuugggggcuggagaacuugagucuuuuguucuuuucuuuguuguucuaaugcuuccuuuuucucacuuagagguaaucccuaaagagagaggaaaugucauuguagggcauccuagagaauuggaaugcuaauauguagaaaaauaacuuuugcuuugguuauugggagacuuacauaacuuucuuggaguuggcuuguuuuuaacaccagcuggcagccaaaucacuguccauuugggucuugccgcgagaaccucagaguaaauaagacaaguaaaacaaagcauucauuaagcaaagguuuuuaugguugauauuuuagugugggagaggcagauacaauucauguuugauaauacagcaaaucugaaauuuuugucaguugccacaauuuggauaacgaucgcuggaguuuacccuacacagugaucugaaucagauuauuuuggaugcuuuccuuuuaguuaaaaaucuauuuuuuaaaaaauaaaucuuagaagcuuaaggauuauagaaggcuauuuuaaaauaggguaggaauuauuacagucagaauuaaauagaugcaucugagcauuucuggacaauugucagcugcugucagucacugcccugacuuuccguaugcuugacucucuauauauagaguguguguauauauauaaacuauaauagaauguauuauauauauuuauauauuauauaaauuuauauuuauauauuauaaauuuauauuuauauauuauauaaguuuguuuauuauaaguuuuauauaaauauauacucuaauauauauuuuacauauaauuauauacuguauauauagaagcaagcauauggaaaguaauacauauauauauauauauauauauauauauauauauauaaaaucauuuauucaacaaauacuuaacagugccaagcucuguccuaauuacuugccauacagcaguggacaauauaaagauagagccuccccucuagaguagagagaagacagucaaguaaaguauaguguaucauauagugacaggcgcuauggagugauaccagguaaagaggggagagauuucugugagggagaaguuacuauuuuauguaaguugauuagagaaggcuucggugugaauggcauuugaacaaagacuugccggagguaagguagcagccauauagcuguauggggaaaagcugugauccaaagguaaccaugggcacaaaagccugaagacuauaggguuccugucauguuaacagaagagcaaggaggccaguggugcuggagcagagugagugagggggaaguuguaggagauaagauuagagagauagcagaggguugcaucuuauagggagauuauaaaauuauacuucuguguugagacucgacuaucaaagauuaagggggguaggauuaggaggcuauaccaaugaaguucauguaguaguccauuuauaaacaaggaaaaggaaaugcuaaauggaaaguaauguguauggauacuaguccagugcuaaaucuuaacuaauugcuuagacuugcuuuaaaaaugucucugaagcuuuuuaguuacuaugggauaugcaguccauuguuuguucuuuuaagaaaguauuuagauuguucaaaaucuuagcuagaaacaauacgaauacaauuuugggaauuugggcaauuuacaaaaauuucagauuugcuguauuagccccauuuaagcuucuuagaauuagguccuugucuuuuggacuguggcugauuuuuuuacuuaacuaaagaaaaaaauagaagugaaaggauuuguuauuuugagagaguauaguuuauuucagaagugaugguugccuguuuuaagucugcgggcucaaggcauguuaucuuucaaguuguucaauaucaaaauagaugagccaaaaagaagggaacagugugcuuaagguuuaaaaacguaauguugaaguuguugguuuuaguuacuuuacuuuucuauuuuacaggguugguuuuuguuuuccauuuugugggucuaaaauuucuuguaaggcuauaagauguacaguguacccguauaaaauuaggauugacuuauagaggggaaauuuauuugguuuauuaagauccuuucagauggauuuuauaccugcuucucuauacuagccaagucugucugagugaagugguaauguuaucuuuaauuuacauuuuaaaacuuuuacauaguuaaauuuuaauaaaaaaucuguucuugccuugggaacuaccauagauacguuuucuucaggguacauugagcgaauuccccaaauuguauucguauuguuuuauuucauuucccuguucccuuacccagguugucuuaugaguucaauaucauguuucuguucguaaguucagauuuugucuguagucuucaccccuuuauagucucucaacuaucaggugaaaguggaacauuucuuaccucuuaauacuuucugccuccucccauucuccagacaaauauuguccuuuaauauagccaaaaugaacaaaggguuugcaguucagagaugugacuauguacauguauuuucuaguuguuucucagaaaucauaccuucucuucccacagcacuauuuuccccuuuucaagcuuauaagagggccuaggaggguugcuuuaaaggcugugguaugauuccaaacuggaacaagccagcuggaaaguuaaguuaggaagacuguagagguggaauaaaggguuggcaaaauagaugagccagaaagaagggaacagugugcuuaagguuuaaaaaacagcaacaaaaaauaacugcucucauucagcuaguuuuucagcaucugcauucucccaaccucacugaaauuugguucugaggagcucugcuuucuagaauacgguuucuuaacaucagcacuauugacauucuuggccaguuauuuguuuugggagaugcccuaugcaacgugagauauuuagcagcaugccuggccccuacccacuagaugccaguugcuuccccuaguuuugacuacuaaaaaugucuccaagguuugccagaugaccacugggggcaaaaucuacacccuguugagaacuacugcuguagaagaaggcuauuugaauguccuagcuggcagcuugcguaaauauuacaucaauuaugcuuuuuuucaauaagugaauccuggaaaugaaagaccuuugugugaaauuuggcacuuugggugguggaaccuugauagguccugugacuuagguuugaucuauacuuaagaaucaaggucccugaaccucugugccacacaugucuacaacuuuacacaggcagauaucuccaggaauaaauacaucucagcucucaugcugcaugcguauuauacuuuuuguggcauuauccuuucaaaauuauagucaguggacauucagucagguuaucaugguaauuaauggguugggaaguugacguacagagugucuuacccuguaaccuuuauaauacccccccucagauccuauguggauaguaauagauucguuuuauucagcuucaguucaugugguaucugaagaucauuucagucauucaauagauuuaacauuccaagcuuagaauagccaggugcuguguuuuaugagaaucaccauacaucauuuucaagccaaguguuccauaggcaaguaagugauuaugaacuuuguaacaauaauuccuuuggcuguucagaucugaagauugaaguuauauguaacuugcuacuguguaaccauauauccaacugcagauuuucauuauuaauaccgauucccugcacaguuacaggcucuugcuuucuuguccauaugccgaccaaauaauugaaucaauggaagucgaaaauuggauuguauuagacuagccaaaguguuuagcagcagcaucagguuccauacuuaacacuauuauuuuaauuuuuuaagcuuuauguuauaccacaaaaggacuuaggugaguguguuaaggcuuuaaacaaagugguaagagauacaaacagcaagggucuuaauagacagguguuugagguuaauuuuuagcacaccuucauucaacuugaauuguugagcaaucaaaaagacagaugcuugguaaugauuuuagaaugguagauuuaaaaaacauagagauuauucgaaugauaugguuuuuaaauaaagcaguuaucaguaauucaguuaauaaaagcuaguuaaagcaggaauuguaaaacgugguccuuuuuuccaccaauuuuuugauauagugcucaggacuuuucuuugaauauacguauacugacugucguucccauuauuuaggauaaacuauaccguugugcugcaucauaugcagaacugaaauuguuaauugaagacuugagauuagagcuuagaaacaugugaagcaagugagaaauccuaauguuuuaugcuccuuuuucccaucuuuugaagcuuuccucuuuauagcugauaugacagcuuuuuuuucugaucaagucuuuccaaagcauucgacuugguuuugcacccuuauuuugucauuuacauaauacauuauuagacuaaugaauacuacugguacuaacagguuucggaacaagcaacugaggaucaguaaacaacucaaguuaaaagaaugggaguagcgguacaugaguauucuaacuacuaguguuuaacauguuguuggcagcuuuccagcuuguccacagaaauggacagggcugcugauugcauagcuccaugggcacuacucacacaaaauuuaacauaaauaaugccuccuggaguuauuguauauaguggcucugggaaugggaggcuguugguuaaucuagcuuagucugagaaauggagggucugugaagagcuucuacucuguaaaaacauagggccugguagaaaagagauuauaaccuaaaaagguuaaauaaaauuugugauagcagauuuaucauguaauguuaauuuuuuauguugcugaaauaggugggcagccucacaaaaggagaaagaccucugaugcaaaugaaacugaagaucauuuggaaucuuuaauauguaaaguaggagaaaagguaugucacacaauaggcacaggcugugauggguuuaagaaugugguuaacugugcuuugauuaauuuuugcagcugaaaaguuggacuacauuuuggcaaagcugguauuaccaugcaucuguaucccaaauugaauccauguugaagccccugggauguagauaauugaucauuuuuaguacuuuaguaauuaauaauuuucauagaagaugagcccuuagaagggaccuaggguauagaccccuuaauuuaugcaugaacuaaaucagcccugaauacuugagguaauuugcccagaguaagagagugaauuaguaaaagagguaaaauggagcccaugguguccucccauuucuaauacuuauucuguuaucauagacugcuuaguuuuuaaauuucacucguccacuuuucauggauuucugaagaacaauaacuaucugaauugauuuauacuaaacccauuauagcucuguaugcauguaagacuauuuuaaugaucaugcagaaguuuuuauuuuaguucacuaaaauagcaauugaaaggacagaugauugguaaugauuuuaaaaugauagauuuuaaaauauguauauauuuacauuuaaauagauuuuuaaaaauaaauuuauguugcugaguacuugacagauauuuaaugugauguccucuacagagugccugcucuuuggagagcaaccuagaaggcuuggcugguguuuuggaagcugaucuuccuaacuacaagagcaagaucuuaaggcuucuuuguacaguguauguaugcaaaagauuuaugaauccaggugauaauguauuaucuacucuuaaaugcuuugggaaauguucaaaauacauguuuauguucuauauguccuuggcuuuacuucuauggggaaauuuguacaaaugagccaaccuuuggcgcuuuggcgaacucuuuuucuuagggauaaaacuaaaauugaacauuuuccuuguauguucuuacaaccuuagaaucauuuuaguugacuuuuuauagagauaguagauacugucucauucagauauauauuuuuaagcauguacauuuaaauguaugauacuuacauuuuuaaauuaguaccagacaaauuugggaauugguaacucagguaauagcccuucuuggaagacugaagaugcuuuggaagccacuguuaauaggcauacucucuggauaaaugggagucuuuguaguuacaugaaauuguaauguauccaugagguguuuuuaaauuaugaaggugauguuuaucacuucucagccuuuuaguuuagaucaagugaagguaacuuuaagaaacuacuaaggaaaucuucugaaauccuuuauuaaaauggaguaguauuuacacuuaaacuguuggaagccuuguuuguuuaaggcugaacuuguauugcuucgcaguguucuuuuuuaauuuuugguuuugggaggguuucagggaccacaguuaccaucaacacagguauuuuuuuugaagaccuugauugucccugauguucugcuagguacuuuaggaaaacaagucaaagagaaucucuugcccacuuaaugauuaugaauucuuauugcuuuuugagcuaauucuaaaggcugccuaaauuaggaaaaauugcuuuuucuaaagguuuauuguaauccuuucccauacuuuuaaaauaacuuuaaugaaaucagcacacuuggaguaagcaacugagacguaaacaaaucuuaacuauaucagaguauguuuuuaaaaaauucaauaauuaaacugguaggaacuuagaugaaacucguuuuaauugugcaucuuuucuaaacaacuagaauaguguuucucaaaguagaauucuaguuccaugacauuugguuagcuaaguuuagaaauucugaaugcugcacgcccccccuuaaugauucuguauuaaagaggcuuguuucacccaggauuucugagcuauuuuaccauggaaaccauguucuguggaaaugcuauucaguuccacuaagcacacuugaagaaaaacuguuguagcauuaguuuuauuuauuucaguaugauaacuuuacaauuaaaucauuuacuuucuuaacucuuagauuaacugaugaauuaaaaugaaaaauuacgggacuaugucuguaacauuucucaaugacaugcuuuuucugaaguauuuuuaaagacauagcuaaaaguaauccuguuccaaaguuaauggaaugauaaaaagauucacauaaaauucagcaacuuaacgccauuguuuugggguuuucuuguuauacuggguucuuaaaucagugcacgccuauuaccugagaagcugacaauuuauacaacauuaguuggacuacugaaugccaggaauuacaauuuugguggagaauuuguagaagccaugauucgucaacuuaaagaaucauugaaagcaaacaauuauaaugaagccguguauuugguaaguuaguuuguuuguugguauguuaugacuacuguugggauggagggaaaaggugaacuacaaccaaauaauuuaaaaugcucuccuaaaacauucucauucacuuucauagcuucauaagccaccuuuauuuugacgauacccccaaaucuguaacuguaucuccaaccuuucuccugagcuccaguccaguauuccagaugcuagcugcauagccuucagauaccuuacuaggaagugccuaaauuaaugcaucauucauaccuccuuuuuucugcccucuccccagcucauacaguggccacuguguacugaauaacccaucuagaaagcugagcauuaauuuuugucuucccuuugcccucucguaccauagguguucccaaucccugucaauucugucucccuaauuucucucaagucuguccuuucuuagucuccagggccucuagcauaguuuaugccuuccuccagauguucuuaauagccucuuaacugaucuuuuugcaucuagauucucugcuuuucacuuuguguucuacaguggcaccagacuggucuuucuauaacuaggcucugcacauguugguuacugguuaaaaaaaccuuaguuccuucccauugucuacagugaguggucuuaaaagccuggugcacaagaugauuccuuggguuucaggaagugaauauuaagaacucuuauuuaucuuaaguggaaaugaaauuaaaccuuacuaauaauacauagauuaauggugauccaguguauaucauaaauacauauguauguguugaagauaugugaucaaauucuuuuuuacugaguacacaaucaaaaaaguuuggacacccaucaggcuauaggauuaaaguccagacucuuuagccugacccuuuaugguuuccccagucuguuucucuauucuugucucccauaugcuccccagcaauaucaaaauaacuugcagaucccuaaacacaccuuguuuuugaaccucuaugccuagacugcccuccuugcucacuacuugaggcuguugcuauccuuuaugaccuagccuaauuguuaccuccuuugugaugcuuuccccaacucccuuugucauuguuccuaaaaaaugcuuaauuugccuuuuagugugggagucauuccuuuguauugagauugugcuuguuccacuagaauggguccccuaacagugacuuuuaguaguguuuagcaauagcacacuaagcacacccaauaaauauguguucuguaauuuccauuucuguaauucagugaaaauuacagccaaacagaaaaggagauuauagguugaaguagcuagaauauuuuacaaucuggauucuugauguaguauagcauagaaacguaugaacucacagauuacuguccuuuauauagucuuuguuacaacuucucaauucugccauuguagcacaaaagcaaccauagacaauauguaacugaaugagcguggcuauuccacuaaguuuacuuaugggcacugaaacuugaauuucauguaauuuguauaugucauaaaauacucuugauuuuuuuuucacgcauuuaaaaauguaaaaaccauuuuuaguucccagcuaugcaaaaaacagguaguaggcuagauucagcccuuaggcuauaguuuuuuagaccaauaguuuagccuauacaagauugcuuauuuuguaguuauuauaaagaacauuuagguuuaauagcagaaauuguuugccccaacagguccguuuuuuaucugaucuugugaauugucaugugauugccgccccaucaaugguugcuauguuugaaaauuuuguaagcguaacucaggaagaagauguaccucagguaagagaaccccucaugcugaaucuugagggguucuugagggguuacugaauccugguacuuccauauaguaccaggaauuuuucgcugauaacccauuagcaauaaagaaaaaaauaacagcagacuaucacacuuuaaguucuuacuaucuaaaaauuaagcugacuggcacacugguggguucucauaauaucuguauguugauuuaaaugaugcugucuaguaagauuagaacuaauauaucuagaaaugcucuguauaaaccagaugucuuauuuaaguccuauuaaauagcuuccauaggauuucauucaagaauaaauaaaauaugaaugaauauaauuaaagcauauuuuaaacuuaacuuuuuaaaaauccuuuaggugcgacgagauugguauguguaugcauuucugucaucuuugcccuggguuggaaaggaguuguacgaaaagaaagaugcagagauggaccgcaucuuugccaacacugaaagcuaucuuaaguaagggcacagcucauaguacucuuuguugcuuagguaaaggauaucuuauaucagugauaccauuugaguuucucaaaaauaagcuguagaguuccugaagguauuuucuagguaauccuguucuccugcuguuuuaacucacugagaccucaaaguagucagauaugguuugcuuacuuuugccagugcaaaggacaguuggcaauauagcuucuuuuaagcugcuuuuauauguuuguuuauaaaagacauaaaacacccuagugcaauaguuccucaaauauuaguguggauaagaauuaccugugguacuuaaaauacucagaccccaacccccagaccugauaaauuauacaauuugagagagagguuuggacaucuguauuauuaacacauuucacaaguggagaaccacuguccuagcacauacaguauauuuaguucauguaaauuaaucuuaaaucaagcucuuaaaacagugguccuuaacccuccauccagccaguacuucuuaaguaauaugacacauuucaauuaaaauagucacaugucuucccauuacucaucucuccuaagccaauguaaaagcuugguuuauauuguuagauacaauaauaauaaauaggucuuuuuaguaaauuuaugcuuaacuauccagcaacaugguaaugguuauguggcccuuagguuuuuacagauugauuuuguuguuaaguuucauuuucucuuuuuuaagugcuuuuuuuggauaacuguuaauagcuacuuaguugguuauuaaguaaaguuaaaagaagcuuaaaaaauaagaaucuuuuggccgggcgcaguggcucacgccuguaaucccagcacuuuaggaggccaaggcagguggaucacccgaggucaggaguuugagaccagccuggccaacauggugaaaacccaucucuacuaaaaaauacaaaaauuagccgagcgugguggugggugccuguaaucccagcuacucgggaggcugaggcaggagaauugcuugaacccaggagacggagguugcagugagccgacauggugccgccacugcacuccagccugggcaacagagugagacuccgucucaaaaaaaaaaaaaaaaaaaaaaagaaucguguguguguguauacauauccuuucucuuuuuuauucaaaugauagcccaauauacacacuguucuucacuuggcuuuuuuuuuuuuucuuacuauaacuuggauuuguugcauaaaaauacuuaacucuacuucauucuuuuuaacaguuguaggguauuucacuuuuuaauguaccaugauuuccguagucuccuguugguggacguuuagguuauuuucaaucuuuugcucuuauaaacaauguuucagugaauaucuuuguguauauguuuuuauguacaugugcaaauauauuuaugggggauauaaauuuuuagaaauggcauugccgaguugaggguucuaaacaauuuugauagauuuagucaaauuaccuuccaaagagauuauacuuucccaaagagauuauaucaguuaaccucuuugucaacaauguuugagacugaaucuugaccugcaucuugaugauacacaguacauuaucaaaacaguugauaucugccacuccaguagguaaaauguuauuucauugcuuuaauuugcauuuuaauaacugugagggugacugagcaucucuuguuuuuaaaagccuaaauguagauuuucauuuuuaucuuuagaagacgccaaaagacucauguacccauguuacagguauggacugcugauaaaccacauccacaagaagagguaaauggauuucagucccuugugauacaaacacagucagcucuugaauagauucuuaucucuguaagauacucagaccauuccauuuuacccuuugacuguguuucuacauuucaugauaguuccuucucauagcucaagguguaugguaggucuuuaauagaugauagaauguaauugaaauauucccuuguucuuuggaaugccagcuauuacagaguugacauauauuuauuuaaaugcuuaauuugaaaaaugucaaaacagacaguuccaaacagguagacuuuguaaguaaaauaaaaacaaaaacuuagcaccuuuuuuuguaccaucuuacaaguuagcuuacuuuuguauccuguauuuuaaaggguagugauuuuuucauuuugucuagucaaaauguuaauuauauuaaugauuaaaaauuaaucugucuuuaguauuuagauugccugugggcccagauucagaaauugaaaaaggaucgcuggcaggaacggcacauccuaagaccuuaucuugccuuugacagcauccugugugaagcacugcagcacaaucugccuccuuuuacaccaccuccucacacugaagauucaguguacccaaugccaagggucaucuucagaauguuugauuacacagaugaucccgagguaagugaccgacuaaaaguccuagauauugaccuguguugcauugugcuuguggguuaaucccgcuugaauuaugccugugguauguuuuaauuuugaguuguuuuuaucuaagaaggucaguagcaaugaaguuaacuuuuuaauucagugaaugauaucaccucauuaugcaagaaauuauauuuggcauguguaaauagauuacagagacgugcacaguuugcaggcuaagaguguggguuuuggguuuuuagagcuacguugguuuguguuuuaaucuugguuuagccaaauacuagcuguguuaauuugggaagguuauuuaccucccugugcuuucauuuccugaagguaauaauaauaguauacaucucauaauaguaguauauaucucauguuaugaggauuaaauuauucacauguaaaaugcauagaacaagaacagugucugucacaugaugaaugcucagucauucuggcaauuuuucuuucuuauuuuuuucuuuucgaaauggggucuuacuuuguugcccaggcugcaggugagaucuaagcucacugcaaccucugccuccugugcucaagcgauccuuccacuucagccuccugaguagcugggaccacaggcaugugucaccuagccuggcaaauuuuuuguagaguugagauuucgccauguugcccugguuggucucaaacuccugggcucaagcaauucguccgcuucguuuucccaaaguguugggcuuacaggcaugagccacugcaccuguccauaauuauacuuaauaagguuauuucucaguaaaaguaccuaguuuuagguauggucccucucuaggcaacacagccugucuugugauuauucauauuguaugauuauuugaaaacaaauguuggaaguauuuuuaauuaaaaaauuccaaagauuagucuaagcugacuuuaucauuuuuaauauacauguucuuuauuucaaagucaaguuuccuggcagccauuguacuguuauaauuguauauuguacaauuaagaaaauuuauaauuuucauuguggguacuauccuguguauuguaagaugcucagcggugucccugaucucuacccucuaaaugucaauagcacucucccugccucaguuuugacaaccaaaaauaucuccagagagugcaauauguccccucaagagcaaaauugcccccaguugaaaacuauugccauaaaaauuaauauuaccaccuaagucaaauuugaguuucuucuauugucucuuuucuguucuaugguaaagugcuaaugaccaguaggaauuuaguauauauguaaucuauuuuggaauaaaaauuucucagauaaucaguuacauauacaaaauuaucagcuugcugccgucuuugcuauauuccauauguaaccaaauacuuuagucaaaauuauguaaugaucuacuuagauaugucuaacugaaaaucugguuuacauuuaagacugcuaauguuuguggucggguauuuuuuuuuuuuugugcaggggaaacuagaaugggaccucaaaauuuguuucuccugaauuuguauuuaauugguaucaccucuguaaggugcauauccaucccuugcuagaagaguauaaauauauaaaauacauauuacucccaaaacgaacaggauuuuguuucuguucuggccuuuuacaaguuguuuauuaaaaaacauuagaaauuguaaaaaaaagauuagaaucauccaaaagucauuauuaaagguuuauuuuguguguuuugaaccuguuugcuaugaauauacuuaagaauaaaauaaugccauguagggaauauguuuugagcuuagacaguauauuaugggcauuuuucaauucaugcaugacuuuuuauggcuaugugguguuugaauagaauuuucucucugcauaguuauuaauggaaauaauucacucucgguuuaaaaaauaaacucuguaagacuuguauuauccaaaauuauuuaguuucauauaauaauugguguguaaaguaggcagugguuguaugguuagguaugagaugugguagaaaaaacacuacagcugauacucugggguauaagugaacaugacaauggaauuuccugaaauauagagcuuuaacacuucagaacuuuuauccccaucacccaguuuagugcuuggaacauaauagucucucaaauauuuguugaauaaguaaaagaaaucuguuuucuaggccuguaguguacacauuugguuuucuuuccaggguccugucaugccagggagucauucaguggaaagauuuguaauagaagagaaucuucacugcaucauuaagucccacuggaaggaaaggaagacuugguaagauucuuuucaugguacuuuuagaagggagagaagcagcaauuuugauaauucaguaagagcaaaauauauguugagaguguaagaaaauuuuauccuccugacucccugucuugcuaaaaucaauuucuaaaaacacuugcuuuacuuucucaaggcucuucacccuuguauaguacuuuucgaggugcuuuauaguaauaagcguaugaugccaguguguuugguguggauauuuaguauaugcuauggagagcuugaauggcaaguuauuuuggguuuggauaccaauaguuuugcucuguuuucuagcauuuagacacccaagcuuuggaauuuuuuuuuuuaaauaaaauuuucuuaaacuuugggaaguuugguuuagauuuuaagguggaaaugaauauaguauuaugagagugaucuacucuauuaaaacuucuuuaaguuaguacaucugaauaugcuuccuuaguauuauuaccuagacuccuuuugagcuuucaagaaauuuuggaugcaguaaagauuuuccuugugguagacagaauaauuuaugccauaguuaaaugaaguaacugaaaucuaggacauuucaaaaaagauuuuucuuugcuuauaucuaaacacauugcuuuugaaacugcuuauuugacuuuucuugugucuucguauacuuauuaaacuuaaauuacacuuuuuauagugcugcacaguuagugagcuauccagggaagaacaagauccccuugaacuaccacauaguugagguaugaauuccauguggagcguguuucugaguuucagaaucuuucuguuggcuuuaaaguaugaucuacucuuggcuuauuuauuuauuuauuuauuuauugcuacuuguccagcauucagaauuaauagaagcaaggaaauugcugucgguuuuggugcucuauuagccauguuaguaaagagaaaaaagauuggaaccaguagccaaauggaauuuugaauugccuauaaguuauuuauauaguaugucuucauucauggauaguuguuguggauaauguaaguuaccucuagcucugucaauacauuguccacuuaacagacguauaagugauuuaaauacuuuaaaauaucauuuuagacagauaacauaucuuuaauuguguuuaucuggccucucaguacuagcauaaacuuaguuaguguauuauuuccuguaacacaaaguguagaugaaucaucauuuauucuuagaaaucuaaagagccaagcaguuuagaaauagaguagcaacacuuuugacuucauauuaacucauacaaaagguugauguuaguauacaguugaauacauuauagagauuuauaucaaaaaacaguguucacuugacacgugagucaaacuguuaacugcauuuuuuuuuuuuccaaauggagccuugcucugucgcccaggcuggagggcaguagcgugaucuuggcucacugcagccuccgccuccgggguucaagcaauucuucugccucagccuccugaguagcuggaacuacaggugcacaccaccacgcccggcuaauuuuuguauuuuuaguagagacaggguuucaccauauuggccaggcuggucuugaacuccugaccucgugaucugccugccuugggcucccaaggugcugggauuacaggcaugagccacugugcccagcccacugcauuaugucuuuauauuaaaguauucaugggccaggcuuaguggcucauaccuauaauuccagcaauuugcggggcucaggcaggcugauagcuugagcucaggaguucgagaccagccugggcaacauggcaaaauccugucuccacuaaaaauacaagaaaaaaaagaaagagccagccaugguggcacgcaccuguggugccagcuacuuaggggugggaggaucacuugagccuaggaggucaaggcugcagugagcugaaauugugccucugcacuccagccugggugacagagugagaguccgucucaaaauaaauaaauaguguucaugaaagagacagcauaggauguauuaagagucguauccucuaccgacugagcuagcugggccugauaggauguauuaagguucauauuuuguuaauauugcacuuuggugccuuuuuaaaaaaaguacuguguauuuccuaucuuuacaaaacuuggauauacuuaaugcugugaacuuggcucaaugacaugucugaaaugcaaaaugucauuuuuaaaucugcaaaauguauagaaauucaucagaccgaaguguagaagugugagagauagguaagaguaaaggaugcagacuagggcuuuagaauucuagacaggugguccaccaauuauacagagagaguaggaaggaaguuucugaauaagaggcauggcaaagaagucuuggacugccagaaagaucugagcaucuauuucaaguaacaguguggaaugacuugauuuucuuguuuccugaccccaaagucuaaaagaauucuuuuuuuuuuuuuuuuuuugagauggagucucgcucugucgccuaggcuggaguacagugacacgaccucaacucagugcaaccuccgccuccuggguucaagcaguucuccugccucaggcucucaaguugcugggacuauaggugcccaccaccacaccuggcuaauuuuuguauuuuuuguagagacagaguuucaccguguuggccaggcuggucuugaacuccugaccucaaguaaucugccugccucagccucccaaagugcugggauuacaggcgugagccacugcgcccagccuaagaguucuuguuauuuauaggaaugaaacugucauggaucuuuugagccccucaaaaagcuguacauccuggcucagcuguggugcuuucaaaguuggaauuuaauugcauaguucucugggaggaguguagaucgaauaagcauuagugucguguguuuuuauuugaucgaauuauagagagaagaaauuuucauuacaguuuucaguuuuagauuuuuguguuugaaagagcauaauuuuaaauauuaaaaaguaauuccauuuucauaugaaugccauggaguuagagcucagauuuagaauguuaaggucuuucuaauagaagugcaaagauagcaguuggauugaauugugacucaugauucuuuuguaggugaucuuugcagagcuguuucaacuuccagcacccccucacauugaugugauguacacaacacuccucauugaacugugcaaacuucaaccuggcucucuaccccaaguuguauccuuuucuuuauuuuuaaacuuaaucucuuuggccuggucuuaaaagauuauuaaauauuucugcuuguggguuuaaauuuuguagguaaaaaauguggcuuuugaaguguguuguguguguguauuacauguauguacuuguaugucuguaaauacauauguaccuauacauauguagauacauccuucacuauuugggucagggaguucaaaaauagacaacaauaaaauuuguugccuagauugacuuuuccucucacaauagauuucucugaagcaugugaugcuugcuguuugauacagcauuuuacccacaguagaacuucuuucagaguuggaauuaaucuucccaaacccugccacugcuuuauuagcuaaguuucuaugauauucuaaauccuucguugucauucagcaguguucacaaggaguugauuccaucucaaaaaaacacuuucuuugcucauacauagaaagcaucuucuuauuuuuuaaaguuuuauuaugggauugcagcaauuaauaauggaaaagcuuguuuuauuguaaaaauuaccaguaugugacacagagacaagaagcaagcagaugccauuggaaaaauggugccaguagacuugcuuguugcaggguugccacaaaccuucaguuaaaaaaaaaaaaaagaagcaauuucugcuaagcacaaugaaacaauguaugccugugcguauggaggggcauggggaaauuugggaggugaugaaaauauuaucuugauuucacgaguguaugcaggucagauucauuauacaucacugauauuucaaagcuguaagaaaaaacaaaaacaagauugauugugugaaaagauguucagcauuauuaaucauuauaaagacuugaaauguuuuauuucuauucuugucuauuacaacuuauuugggauaaaaguggagaauaguuuuccuuauccuaaauucacagcuugcacaggcaacugaaaugcuauacaugcguuuggacacaaugaacacuaccuguguagacagguacaguaaucgcuuuacugcugagcugaguuagcagcuuuuacuuccuguacuucauaaaggaauuugagaaagacauuuuuaagaauuuccauguuuaguuuuuuucuugccucccaaaauaaccuuuguauaauaaccagacucauacuuaauguaacauuacguuuuuugauguccaugcuaugauuuucuuuaauuucauucucuagucaaguaucaaagacuauacuuuggcucugccauuuauaaaauguuuuaucugcaauuucuuuuuuuuauuugagacagggucuugcucugucacccaggcuggagugcagugggaugagcauagcucauuguaaccuugaacuuaugggcucaagcaauccuccugccuuagucuccaucccgaguagcugggauuacaggcaugagccacugcaccuggccuacaauuucauaaaauuuuuuuuuuucuugcuucaguuucaucaucuuuuauauggagaaaauaauauguaccuuggaaguugugagaauuaaauaauaaacauguuaggugcccgcacaaaacagguacuagaauuauaucugucauugaccuaaaaaggauaaagagaguuggcagaagauacaacugcauguaggggaauaugcuuuucauuaacucuguaaagucggguuuuaucuguuugaaggcuuauauaaguuucuguucuaaaucccaguuauucuuccuuuuucucugccuaccucccccuucucuacguagguuuauuaauugguuuucucaucaucuaaguaacuuccaguuccguuggagcugggaagauugguaagugaugguuuguuuuaucuuuuucuguagucaaaaaacuacuaauguuuaaaacuguaacauaaaagugucugaaauauuuaauuucuuggaaacuauuuguaguuaaguacaaauaguuacaagugcaauuauaacuuaacaaaacuuguaaguuguuauaaguuaacagauaauuauaguacaaauggguguaagugcagauuauauguaagcauugauaaaacuacauuuccuccuuaggucagauugucuuagucaagauccugaaagucccaaaccgaaguuuguaagagaaguucuagaaaaauguaugagguaaguuuuuuguguuuucuccuuuuaacuucuuugggaggauuucuuucucuucucugcacuugugauguguguucagaauauuggauucaaaauccacuuacucaucuuccaucccauuuuuaaucaagacuuaggcuaagaaaaauuaggcaaccaugccauauagauuccaugugaauuuaagccaauaaguucuuuuaaagaugucacaggccgggcgcaguggcucacgccuguaaucccagcacuuugggaggccaaagcggguggaucacaugaugugaggaguucaggcuagcauggccaacauggggaaacccccucucuacuaaaaauaaaaauuugcgaggcguguuggcgaacgucuauaaucccagcuacuugggagguugagggagaguccuuugagccaagauggcgccacugcacuccaaucuggccgacagagcgacacucuuaucucaaaaaaauaaaauaaaaaagguguuauauaugaaaugaauucagauuuauagaaaaguuggcacaacauuacaaagaauucuguauccucuucaccuagauuccauagcuauuaacauuuuaucauguuugcucucaugcucacucccuuuucgucucucccuagagacccauuacguugguuuuccuuugagaauaagcugcauacccagcugauguaauggcccauuauccuuuaauguuccauuacauaucuucccaaaacaaaaccacucuccuaccuagccagcauacaaccuuuuagaucagaaaauuagcugugguacaauccuaccacauaauucacaggugcugcugaaauuuugccagccgucccaacaccuguauuuccugucuggucuggaguguuuuuuuuguuuuguuuuguuuuguuuuugaguuggagucucgcucugucacccaggcuggagugcaguggcacgaucucggcucacugcaagcgccaccuccggguucacgccauucuccugccucagccuccugguagcugggacuacaggcgcccgccaccacgccuggcuaauuuuuuguaguuuuaguagagacgggguuucacuguguuagcugggaugaucucgaucuccugaccucgugauccgcccgccucggccucccaaagugcugagauuacaggcaugagccaccgugcccagccuggucugaaaucuuauccagguacauauauaguguugaguugucauucucuucagauuccuucagucuugaacacuuaacucuuuuuucuaucuuuguguuuuuaccaguuugaaagagucuagaccuuacuuggauugcucugauauuucucaugagcagacugaggucuuaaauuguuaaugcucuuggugugucacuucuagaggcacaugauucccaccacuggugauguuaauccugauccaccuggucaugucaauaucugccagcuuucucuaccuuaaccucaccauuuuucccuuuaguagaauugauaaguauuuuagauauucugaaguuuuacucuuacucuguucuucaucagaucuccauccugcuuuuagcagcuaccacuaagaugguugccaagugaugauuuucucauuccauuauuuuuucuacauuuauuagugggccuucuguaagagcuguccuuucucccccauuuauuuauuccuuuauuuauauaucaguagggacuaauuaauuuauauuucauucgauggguuauaaacuaugaggauuauuuauuuugaugcccaaauugucccugguauguacaugaggagccccgguaagcucucucucucucucucucucuauauauauauauauauauauuuuuuuuuuuuuuuuuaacguccccagccauucauugagcauucccuuauuuucuagaacaacauauuuaggaucaucuugcguuuucuugcccuaucacuggaaucaucuauuuauucauggagcccuaguuucuaguaaaguaguaauggaauaugguauuuaggagccaagaucugggcacuugauaugcucauugccauuggggugucauugguucuaagccucuugguggacacacauccauccauccauaacuguuuuuauguccaccuguguguauauaugccuccaauuccaacucaauaccuuauuucuacacuucuucucuaccaugauuuguaaacaccuucucaggcaguaacaaacuuggcuuccauuauccucaauauuuauuuauuugauagaauauagccaguuuccaaagcgugcagucaucuccaccaugccccaucaucaccccacauacuuggccaccaggcucaugagcucacucacccgcaccucagugcaagccagugaguuuugcaguaugccugagauuuggugugcuggcuuagacaaaaacucaaaggauuuuuuuuucccuuucacuucuugguugucagcugaguucaaguuguuggagaucaugacuuuccagguaagucggguguuaccgaagaaugggacugauaaaagauauuuucugaggcuguuauuuguauuguagguugucuuaccaucagcguauauuagauauuguuccuccuaccuucucagcucuguguccugcaaacccaaccugcauuuacaaguauggagaugaaaguagcaguaaguaaugaaacuaaucccucugucuuuaaaagguaccaguucaaguauaucugaaguuaguuguuuaaaguggagaaauugaacuuuuucuuuucuugggguuuauauuuccuguauuugaaagguggucuaucauuagccacuguuuuauuugcccugucaucauuuugaggauuugguugugauaaaauuaauuacuacuggcuuaucauuuuuucucuuuugaauguguuaaguauagcaagaugaauuuauaguuagaacuuacuaaacugaaaacguguauuugucauggugauggagguuacuugaauucauuaucuuguucaggugugguauugagaacauagaugcacauauuuguggcaguaugccuuuaaaaguaaauucuuaauuaugauuuucuuaccuuuuggucacauaaucucugaaauugcaccauaaaucagggaguguaauuugaugugccauuuugcccuuugcauaguauuuacacuuaaugaagguaaaguauuauacauuguugaucacugguagaguuagguguggaguuuuuccaacuuguucuuugcagauuacacuuaacacagccccuccaugauccuuccauuuuguguuguguagagguucuuuguaucucacaacuuucugcuguucuuugcuuuucauacugugugccuguuucuccaccucugucucugacuguaccuguuuuccuugaaaugaacugugucgguccugguacauuuccuauuucauuaugucaacucugaagaauagauaugauuaucaaaacuacaaugaggaaaugacuuccaagaggucaagcuagaaugagauugcuuuugagugguggagcccaaauucaggcguaggugcacuaacugaguggccaugcuguuagccacugugcuuuuuggcagaucaaagguuuaugcaguacuuagaagugcuggguuuugaguuuuguccuguacugguuccgagaaugauaagguguagucuuugcuaucagaaagcucaggcuuuuguugaagauuaagcuuucuuuuugccccauaggaauaacuccgccuaacauucaaggccuucauaaccauuguuccuacuuuguuauuuuucacuucuccccacauggaccucuauuucugccagguccauguacuuuuuuauuuuuuccauacucccuguucuugacuuugccauuaccccagucuggaaagcccuuucuagcuccacuuccuuuucuccuucuagauucuagcccaagcucaauagcuguaaauauuuuuuaaccguuagcaagccaguuuuguauugcuuccuggcugugucuaaugugaauaucuugguuccccagcuagaauguagacuggugacaggggauucuguuuuucuucgccuucuuuuuuuuagagaaaaagcucacagcagguguaauaugacuguccucacaugacuguuguaauuuacuuuauucauuccaguaacucauacucuauaacaggauugccuuuuuuguuaccucuuugucuaccuuacauuaaaagcagauuucuuguugcucuggugaugccuuacgguguauauuagcacaaauuuuuauaauaaggacucaacugauaccaaccaauaguaaauacaaggagucccaucacgugagcaucugacuuacguagauucaagcuuguggacucagcaaaaaagaaaaguacaaaaacaaaaccucucugaaguuggcagccauuaccuuguugagacucagacuucauuuccacggucccgaggaaagaaagaggaaguggguguuggcaaaaugaaagagaaguacguugguucugggauuuugagcccaggagaguugagggcauuaaaagacaguuuaacuguguccacuuuucuccuuaccauucaucuugaggaugaucagcaccuugugcucuaaauuuuacuuagcuaaguguccuuaaugaauuguugaaaugagaauugucccuuuuuaggugaaaaaccauuaaccuauuagaaaaagcuuucacauacgguauuuauaugugauuaaauauugaccuugggauaaagagcauccuauuuugaaaggaagaauuuaaaaaaaauuuuucucaguuauuuaacuguucauuagaauagucuugaaaccugaucugucauuccccuuacccccaauucuguguuuagauucucuuccuggacauucuguugcccucuguuuagcuguugccuuuaaaaguaaggcaaccaaugaugaaaucuucagcauucugaaagauguaccaaauccuaaccaggaugaugacgacgguaaguggaauucaguauuucuuaaguggaacuauguauaggccaacuuaaagcauaaacauaacucuggcaacaugaugcucuuaaagcaauauaucuauaucuguuugaccuguucagacuguuguucuuagcaccccagguauuuuccccuuauauaaaaagagauccuaacauuucugugauauagcuuacuuaagaauauaaacuucaucguaaauacaaagugaaauauguuaccauucaaggauuuuuaaccccugcuuucaccauagagaaguuccugaauagaaagacuugguguguuauaaaguuggauguuuucuccaaguuaagcuauuagaauaauaauguuuaacauuuacucaguuauauaccauguaauuccaaccagaauccuaggaguuuuucugggcaagagugggaaaauugacaaaauaauuuauacaguugccugaaucaauaaauggauaugcacauagaaaaacuacugaaucaaaauaagauauuaguggccuuuggguauuuauuacugggauuuuguuuggauaucucuaagaaauuuguauuaugauauuagagaaaaugaguuuagaaagaauaagccaaaaugauggcauuaaauucagauguugucagacaucuuaagacauaagcuuaaguguuuuuuuuuuuuuuuuuugguauuaauauaauagaggcuaugaauaaggaaaccugugugauuuuuuuuuuucaaggaauggaugauagaauuaagacagucacauaaaacuaagacuuaaaauuacaagugguuucauauuuucaguguuugaaaucagugacggucuuuuauuguuuauuagaaccaaaaaacauuacacaaauaucuguguauagaugugagcaaccaucuauuuagcauuugagguaaggcaccaaggaauugcugugcuuacauuuuucuguuuuacuauaaaauauuuuucagaugaaggauucaguuuuaacccauugaaaauagaagucuuuguacagacucugcuacacuuggcagccaaaucauucagccacuccuucagugcucuugcaaaguauguaugaguacagagccuugcuugagaguuuggaauuuugcuuggugaacaccagugguaugguaauuuuuaccuaagauuguugaauaugaagaucuuaauaguguauaauuggacacaguggguuuggguuugugguagcugaaauccauauccuaaggcuuccgucagucuguuuguacaguuggcauauguacaugguaagugcuuuuuuucauauagacauuuaaagaaacuagugaaaaaccuagguuuuugggacagucauaugcaguuggaaguucccacgcuaaauaucuuuccaaagcaauguaagaagaaauuagaaucagcuacacuguugggagucacgcaaagguuggcaucugaagacagguauuuuuaacuugucagacaggguccaaaggaagaaagagcacauagauuuuccuucugccaagcagagaaacuggacaucucaccccaucucugucuccaaggcuuuauauuacuugcaggguucccacagaagaugcaguuugaauauuucaccauguuugaagacaguuccuuaguccuuaccuauucuuuuaaacuguagcccugggcuaacgguaguauauuguaaaugucuugagauuuugugacagcuuccuuaaaaacuaucaaucugugaucacacuuuuugcauccuuaaugguuaauacuuaguuauuuugcauuuauauauugcauuauaaauugaguaacauugaaaaggcuuugaaaacacuaaaauguuuaaugaauaaguauauaugguauuuuuuucccaucauuaucaaaagguuucaugaagucuucaaaacccuagcugaaagugaugaaggaaaguuacaugugcuaagaguuauguuugaggucuggaggaaccauccacagguaaaaauuauuuaauuagacauguugaagcucugauuguauggguauaaaaauaaggccguuaauugccauuguuuuguuuguaaaacaugaaauuugacucugccuagauaaugguuuuuagaucuaauucuuucagugcuaugggaguaaugauguuucauucauucuugaaagaguaagcauuauuaugauuugguuuugaacuauaauaucucaauauguuuuaaauguucaggaaaagguuuaucuagucuauccaguuucuaaaugcaagcuccagauuucucaaaccuugauauauauuguguaugacaaagaaacauuuaaauaaauuucauaaaacagugaguguguaaugauaaaacauuguuuuacauuuaacuucugggguucauugaaauuauguauuuuuuugaauacguauuaguaccugaaauuuaaauuuuuuuuuggagacagagucucacucugucacccaggcuggagugcaguggcgcaaucuuggcucacugcaaccuccgccucccggguucaagugauuccccugccucagccucccgaguagcugggauuacaggcguccaccaccacaccuggcugauuuuuguauuuuuaguagagaugggguuucaccauguuggccaggcuggucuggaacuccugaccucaggugaucugcccaccucggccucccaaagugugcuagauuacaggugugagccaccgcgccuggccaguuuuuucaaauuuuaacuguuaccauucagaguuuuuguuuagucaaccuguuucuuguagugcuagagcaaagcaaaggggagaauaaaucuuaagaccuaaugaucaggccaggcgugguggcucuuaccuguaauccuagcacuuugggaggccgagauggauggaucacuugaagccaggaguucgagaccagccuaggcaauacagugaaaccccgucuauacuaaaauuacaaaaauuagccaggcaugguggugcacaccuguaaucugagcugcucaggagguugaggcaggagaauugcuugaaccuaggagguggagguugcagugagcugagaucgugccacuccacucccgccuaggugacagagcaacucugucucccaaaaaaaagaccuaauggucagauugaucaaucaauuccauagccaccaaaacuaaauuuuauagcccuccuauuuuacuuuuauagcagcagugugguggcacauauauauguguguguaugugugugugugauuuacuugaauaauucucucauuguagaugauugcuguacuaguggauaagaugauucguacacaaauaguugauugugcugccguagcaaauuggaucuucucuucagaacuaucucgugacuuuaccagguaauauaaauuauuuuaugaaacuuguguucccuaagaauugauauauguguggucucuuauacauaagcuucaaauucugguccaaaccagguugauauuaauauacuaaugguccaaucugguaggauuggacauggcaaaaauuccuagacaguggaaacauacacagccuaucagguugcagcgucucuuagcagggacacucuuaaguugaaucaaggcuaagccagugaaguagaaauccuguugaaggauccagacuguugggagagaaaacuagcaagagccagcuaugugcagagucucagcuaguccagauggaacucgggaaggguuccagcuucaguggggauggcaccuagaaugcacaccaggaaguaggagaaaucaaagucaaaguagaguaaaucauggagggauccaggaaagcuuggugauuaacaagacaccugagggaugggggaaagggguucucaccacagucauaaucuuagguuuaaugcagaagauucauucugcccucauucccccuaacggaaagaaaguuuuugcuguuugguucuuauuuaugaaguucacggacuuuacagcugauaggaccagggcagcaggaguugacacaaagcaggaaacuaaagcaaauuacuuguaaaaacauaaaaguccaucacaaccuuuaacuuuuccacuguaucuguuacugccagaggacacugaucagaaauauacugaauuguuagggugauagggugugaucuaagguugucauaccggccagguuggccuucauaaacaaagacaacagaagaaccuuuucagauuuguaaacucucagaaaacuaaccacccgaguauguuuuaaccauuguccugagugauuuacguuuucaauucauuuuauccuuaccgcaucaccguagagaagguuccauuauuguccacauuuuacagaauagggaagugucacagagugcuuuauccugcccaaagucacacaacuaagugcagagccagcauucaaacccaggcauucuggaaucuguauagugcucaacagcuccaucuguucuuuaacaccuagcucaaauauuuguaacucugcaaaccuuucccugacuauaguccacccccuccagaguuaaagugcucugcucuuuuguccuguuuccuaacauucuagacuuggaguuuuaugaacagauuguuuuauuaucuuccacuuaaacuauuauuugggucaaaauuuguagaaggaaguacaguucacccuugaacaacaacagggguuagagacaccgacuucgccccacccaccccaccccacacagucaaaaaucugcauagaacuuuuaacugcauggaaaauuuaacuaguagccuacuguugaccagaagccuuagugauaacguagucaauuaacacauauuuguguuguauguguuauauccuguauucuuacaauaaaucauaagagaggaaacauucaugaagugagaguggaucaucauaaaggucaucuucauuaucuucacauugaguaggcugaggaagaggagggguuggucuuauugacucagguggaagaaaacccauguguaaauggaccugcacaguucaaaccuguauuguucaagggccaacuguacuauucugugcuggguuaggagaccuaguuuauagacacaaaaguagcugagaaguuacuuuuuaaaagaaaaacacuuaugcaacaaacauuucaaagcaccuacaaagugaucuuaguauguauuugcuaguaagaaagcugacauauaauuaucucauucuuagagcccaucaguugauaccuauuaucaacuaaugaguuucuuaaacauuccaagagaauaauuggcugagugugugcuaguuaaauaauauaaagcaugggaaauaagucucagguuaggucaccauuuugagaaaauuucuacacauaauguuuacauuuaggagaggaaaaauguauuuccauuuuuaauguuaauguccaucauaguuugccauuucaauucaguaaguauguaccucugguaagggauggaaauaagaaaaaugacuacacagugcugcccucagggggcucgccugaaucuaaugggugugaagauagauacuugcacaauuuacaauaaaagaccaauuuguaaguauugcuggagaaagaugacuaauucagccccaaggacagaaggcuguaucagcuguuaagaaugaaauuacaaaaguugaaagauuuuauuuucuguaaccauagcuugacauacaguaaccaaaugccauauuucuuuaagauuguuuguuugggaaauuuugcacucuacaauucguaagaugaacaaacauguccugaagauccagaaagagcuggaagaagcuaaagagaaacuugcuaggcaacacaaacggguaaguuuuguguaaacuuguaaguaguuaaagaaaauauaccagaaacucuggagaggauucagaguucauuaucuugaugauauuucauuuuuucugagcccaaauuaaugcagagcagaaauuuuucugagcccaauuuaaugcagaagcagaagaggaggaaggagcagguaguguguugugugcuguuacacugcaugaugaaccaguucaggaagccacaaacuucacuucccauaguucacuaucucugggucggccucacguuugcacaagggaaguagcagaagggaagaggacacuuguauuucuguaggagucucugggggaagagggagaggacuauagauacuuaacacuuuccccguacugugaggaggaauggggcagucauucccaaguuaacggaauacuucucauaguauuaauuuaguauuuuagccauuuuggagggaagcagugagugacuuaacaugauacuacuauucauuaugaaaguauuuuccaguguuaugcauauuuaccauaguagaaggugaaaaaaaguugaguuuagugcccuauaggaaccuuucgcaaguuugaguaccagucuccauguagacauaccuguauacauauauggauauaaacacucagaccugaaauacuguaagguaaauggugucaucucauuuuguagauguuauaaagugagacauagagaaguuaaguaacauagcuaguagguugcauagcugguaaaugaccagagcuagguucugacacaggucugucagacuccagagacuuuucucucaugccacacuguuucuagaagugugcuguccaacacaguagccacuagcugcacgugacuauuuuaguuaaauacaauuuaacauucaguucuuuggucacacaaccauauuucaggugcucaguaguaacgugugguugcggucguaacaggcugcacauauuuauauaacauuggccccauugaagaaaggucuaucuauuagguaguagugcucuagaaccuuaccuuugagugguguuaggaaaggacagucguguacccacgugucuagaacauagagcagaccucauaaaugggcuguguuuauagagagaaaagcaagauucugugauauccgagagcaggguucugauaauuuugcuuaaaguggagagaucaguagauggggccuuagcaguuaaguauuaaccucgaagaauuaccaggcuuucuagauucagugaugccaccuucuugcugaaaguaccuugguauguaacaccuuagagccacguucuggcucugccacuuucugacugggugaugcugggaaagucaucuaaccucucagccuuuuuucucuguaaaauggaaauaaaccaugccuuguuuuucuuuuccuuuaaaaagaaaaaauuaaauucuauaaacucuucagagugagcugggggcagggauuauuaaagcuuuacaggaguauauugagcccaucauugccagcagaaagucuuaaacagcccacuuugaauuauuauaugucggcuggagccauuucuaaauuauaacaagaaugagcagccuuggcccauaggacuugcccaguuuuucuguauggcccauuagcagaugaaugauuagcaagcugucucccuguuguuacugcucaaauggucaaauagugauaaauuguagccaaguccccccauguuguuaccaagacaagugccacuaaauuucccuggccuagauaagaacccauggaauuucugaaugagaagacagugucucugaaccacaacaggacuuugagguauauauguguggguggcgggguggggggguacuuucacuauagaauauaagucuuaacauuuggccagacacaguaaaaugcuuccccuggaggagauuuaacacacuggaaucuaaaugguauuuuccuuuuguucauuugccuucuauagcgaagugaugaugacgacagaagcagugacaggaaagacgggguucuugaggaacaaauagaacgacuucaggaaaaaguggaaucugcucagagugaacaaaagaaucuuuuccucguuauauuucagguaucuuggcuugggacauuuauacauaaaaggaaacaauacauuucuuuaguuuuaguuuuuaaaaauguuauuuuucauuguaaaaggaauacacauucauuuauagaagagauuaaaaauacaaaaauuuaggaaggaaauaaaaguucacuacucagaggcaaccauguaugucugaguuucucugcuguuuacuuaguauucucgcaugagcauuucuccaugcuugaaaaaaaauuguggguugcuuuuuuuauauaugucucguuuaauuauuccucauugcugaucauuuuccuuccaugaacauuuuaaugcauagauuccuguuaaaauuucugauuacuucguuagaauagauuccaggaaguaauauuacuaggauaaguaauuuaagacauuaaaggucuuuauguauugccaggaagaauguaccaacucauguuauuaccagucugcccuucuagguugacuucaugaauaauggaagcuaggcacacacaccacaaagacaggguggaacaggcaauacuuugggguuucuuugucaugaauuuuuuuccaaaguauaagauucugucuguaguacuaccuuaacuucuucucccuuuccagcgguuuaucaugaucuugaccgagcaccuaguacgaugcgaaacugaugggaccaguguauuaacaccaugguauaagaacuguauagagaggcugcagcagaucuuccuacagguauguggggaacuucgauuagguaauaacacuauucucagccacaaagauuuuucauuaaaaaaaauccuugucaaauuuguuaggagguuauauaguaccuguuagacccuuuaguucauguccauuugcugcuaccauugcucaucagaauauuuaggcuuaaacugauucuguaccacuuagauuccuaauugccacccccccaacaaccccccgccccaccuuuuuuuugagauggcaucucacucuguugcccaggcuggaguucagugacacgaucucagcucacugcaaccuccaccuccuagguuuaagcaauucuucugccucagccucccauauugcugggauuacaggcacccgucacuacuccugccugauuuuuguauuuuuaguagggacagaguuucaccauguuggccaggcuagucucaaacuccugaccucaggaggccuccgccucccaaagugcugcugggauuauaggcgugagccacggugcccagucuccuaauugucauuuucuaugcuggggauccuagcuguaauauaaaauguagaggacaaaaauaucaagaggacaguaauuggauuuauaagucccuaaaaagccaguguuauccaaugugcaggugguaaacuguccacagaaucaagguaagcucccuggggucucucugcaaaagcaaaaugccggcaccuauucucaccuagauuuaaguuaaagguauauaggagaguggagcuaauucauuguaucuucggacacuacuccccuaaaucuucauuuguucauucuagaagaaugauuaauguagaagucacucuaaguucaauucuuugagccuccaaauaggaauucccucugauuuuauaguuacugccaguuuuaaaagcuuuaacagucucuaguccuauaagaaucucugagaguauucauggcuuauagaggaacacauagacaagaguauuucguuuucugacuguuuaucuuccugucaguccgucuggcugcuuuuuaaaaaguuacaauguauuaugcccugacuggggagagagcuagcugagccuaguccguaauaguacuaggagcaagcaggcacugcugccacugccuugaaucaugaauucuguuuacauagaaguugguaagaacuggauuuuuuaaaaagcuauugagcauccauuuuuuucauuucccuuuuuauuuuuuuaauguuggggauuuucagggguccauuguuccuaucagcacuuuuuuuuccccuuccucuuuucaucauucugcagcaugggugggcugcugaaggaaauguuccacaagauugcuuauaugcuuuuuccugaccuaacuacccccuuuuguguguccacagcaucaccaaauaauccagcaguacauggugacccuggagaaccuucucuucacugcugaauuagacccucauaucuuggccguguuccagcaguucugugcccugcaggccuaagggucauuuuuuccucaugucaagguuuuuuuugauaucuuaaaauaauuugucuuauuuuuugaugguuugaaugcuugcuuucuuguaguauccuuucacuucuuaaaggaaacaaaggggaagaggacagugaaugaacauggcauuacuuuuaauugcccugaaaagcaaauacuuccuaacggcaguaaugugacuaugaccaugauauauuauauaugugacagauacaaauucucugugaucaguuuguuauuuuuuuucuccuuaaggcacaaaauaauugguuugagguaugugaaacacuagaggucaaccuuacauaguauauagaacugauggguuuacccagcuacccaguagcauaacuuuucacagcucggggaugaauuaacauggcugaaauaaaacuaaaaguaugguuuuuaaacuuuggcauuucaugauuuaucaucucacucuacucuaaaacuggugguuucuuacugaagguguucuccauuugaaauuuuaucuucaaaguauuuuuaaguaguaucuuuaagacaugacuuguuaguaauaaaaguguuacuaguuggaagaguagcucucaaauuugucuuaauguaaaucaccugggaaucuuucaaguuauuuugaaauuuaaaccaccgucuggggguggaacgcagacauccucaguaauccuuaaaguuuccccaggugauuccagguuuggucaccauuaucuuagagcaucuacucacuuccucuagccuugggguuauuuguccaaggucuuguagugaguuacagaauacuaaaguggauguagaaguggucagauugacugaaacuauacccugaauuagaugugaguuuagauuuuguuuauauggaaccugauccaaaaaacuacgaaguccugagcuuguuuccuguauaguacugaugcugaaauaagaugacagcaguuuguaaaauaauacacaaauaugaggaauugucugacauuccaaauuucgaggauuuuuagacuuuuuucauuaaaccuuagaaaaaaauuaccaguaauccuacaacuacugguaguguuguugugcauuugcacaaaauagguauaauuuuuucuuauuacauccca

SEQ ID NO: 13954 - RNA, 3296 nt, Homo sapiens
agcuuuuuuucucauuacauuaaauugcugcuguuaaucaccagauaagcuacugucaauuguccucauuuucgaagaguuugaauuugcccugaaguuuuucauagaguuagaccucuugggucugguuucuuuuucaguucgcuuguuauuugaaugaaggaugucuuuugaggacauuuuccaaagugguuacaugagugauauauuuuccaagugucucuguaaauagaaauguuuuacugcuuuugugcauaugaauaccuaaguucuguaacauuacuccacugucuucugguguuuaaugugcagagaggucagugugaugccuucuuuaauuauggcuucuuguugauuuacuuuagagguuguucccgccuuccugaauaggccacaaagggcugagacuggaguagacacuguagagauuagacacaaggagcuuacugugcaguuuucucagaaggcucagaacagagaggaauaaaagcaagucuaaaaguauuuuaguugaaaagaaauuggaaccugguuccucuuggucuucugauuuugauccacaaagaagcugacacaguuuacuucuuuaugggaagguaagagauuauauuuaccugcuuugagaauaugaucuucuacuuuagcaguuugagaauugaucuuacuaccaaaaagaauuuuacaguuuaaauaguauaagguguguauagauagauagauagauagauagauaaaaauaaggugaaagacaagaaaguguuuucuuguuagugaauucaaauuguucugccuuguuagauacaaggcagaaacugcuguucaguuuuuuuaacugguaucaaaacucuguaucaaaauauucaaaggaccgauagagaguauuuggagaguucuuuugaauuuggccuuuuaaucuuuucagugcccuacaccaguccuuccucucuucaguagcaaggagagccuugaaggauaaaguagugaacaggcaucuuaaggagucugaaagagaggacuguuacacauuacagaaaucaguuacagaauauagaaauguuuugauuucaaaacuucaggaugcacaggccuuaauauuagaugggaacguucagcugguucaaauguacagaacguuuuggguuugcaugucuacucuauaaauaagguagagauaaggcauuucuuuaguuauaccagcuuucucuuauuccauacugguagagguuacccuucuaaaaaaaggaaaauaaauucauuuucauuauuuauuacuauguacuuuccucccaaaagagguagguaagaaaucucuuaugggggucccaaguuuguggacauuguacauugugggccugugguuauauuuaugacucuggagucaucucucaagagaguucgggagacucaguucucuguuacucugcuuuaguuuauggaggacuaaagaagaccaaagcaucauauugucauugugucuuuuccuuguaauuuuuuuuccuccuguuaacaaggggcaccaugagucaauacuuacuguccuaccauaaaguauuuagaaguaucuugucucucgcagcuaguugucuuuuaaauuuaccucagaagcagcauuggguuuccaugaauacagaccaccucuuuugcaaaaccaagauguuaaacugaauacaaguuuuagauugguauaaaauaacauuuucauuuaaaaaaggauuuaggagaauuuuuucgucuguaaaaaguauaagcagucccugaauauaucaguaacaagacugcuuacacugaaaauuguuauaaauuuccaugaaaggcaguccuuaguuaauagcuuccagcauugugaaauucuaggccaauggaacuaggagguuggaacgugguaaaccacuguuuugucuccagcuucaauuaggccuucaguacugcguaggaccugcacccaccccagguuuccucagcuccccgaaagucgauuucagaccuacagaccuuuuuucacucuucuaaagccuuaccuuguuuuuaaaacuaccuccuucucauucucagcaguagguaguugauuucugcuuuccuaaguuuuaaguuguuaaaugaaguaaugugaaaaaaguauuuaucuuaaauuuuuuuuauuuaccugauguugacauuugccauauuuacuuuuucuuucacacacacauauuuugccaagccauuuaaguugcagacauugugauucuuauaaacacuucagcauguuucuccucagaacaauggcauucgacugggagcaguggcuuaugccuguaaucccaacacuucuguaaucccaacacuucaggaggccgaggcggguagaucaccugaggccaggaguuugagaccagccuggccaacauggugaaaucuugucucuacuacaaauacaaaaauuagcugggcaugauggugugugccuguagucccagcuacucaggaggcugaggcaagagaauugcuugaaccugggaaguggagguugcagugagcugagauccccccauugcacuccagccugggcaacaagagugaaacccugucucaaaaaacaaaaaacaaugguguucuucuacauagcuaaagaacaacgaucauacucaagaaacuuagcauuaauauaaugcugcuaccuuguguauaauuuaauauucuccaguuguuuugguguccuuuacagcuuuuugucggauccagguguuauucaaggaugaugcauauugauagcugcuuuuaaacuagucccucagccuuuuuugucuuucacgacauugacauuuugcagugcccaggccagcugcuguucagugugucccuccauucagauuuguuagcugcuuguuuccucaguuagacucaggucgaauguuuuugguaggaauacuuucaaggugauguguuugagcauuuaucaguagacacaugguaccagcucugucuuuuaagggagugguaguuugacugcuuaguuaagguggugucugccagguuuuuccauuguaaagguacccuuuauccuuuguaauuagugagaaaucuaauacuaugugaauaucucauuccuuaccuuucacucagugguuuuaguacacagggcugagucuuacuuuaguuauuauauuggauauaaauggugauuuucuauuucuuucacuuucuguaauuguuauuuggcuuuuggaaagaagagcuuuucuucucuuagaaacugauuuuuuuuuaagcaucagcuggacugauuguuucuuauucugaagucaauguauuauagu

SEQ ID NO: 13955 - RNA, 16753 nt, Homo sapiens
ggugcagguuucuucuagcgcgugugcugggguaccuggucgucauggaggcgguauugaccgaagagcuugaugaggaagagcagcugcugagaaggcaucgcaaagagaagaaggaguugcaaggugaggcggaaggaagugggaaucuggaagccgccgcgacugggggaagggcgcguggcgggucgauucuggggaaucucaaggcgugacuuaucuggaucacccuagacuuccccuaguagcaaguggccucuucucucuucaccuaccccggcggcccuuuaauuccccaaccuucagaggcuuccccuucugaggccugcggcgugcccccuaccccgcgccgccgccggggugcaggugucugaaaauaccuagaagccgccgucuugguccgcucccaaacccacgaugccucccuuuucuauaccugccccaguuaccgauacuugucccuaauggguguauuuugaauggacccgccucaguuuaggagguucagaaaggauaccggaaagauuuaaaacuggcuacagucagguuuuuuuccuucucuuaucucgccaaacaaccgaaacauauucaagauuuuguuaaugaaguuuuuuuuuuuuuuggucucagcuuuaucugggaucuucucucucuguagcugccuguuacgugaugacucuuucuuccauaauuacuuuuucuguacccuucgcccguuaccauccccuuauugguuccuguuucucaucuccuuuuacuccugcgugucugacuuaaugauuuuaauggcuuuucagccaaaauucagggcaugaagaaugcuguucccaagaaugacaagaagaggaggaagcaacucaccgaagauguggccaaguuggaaaaagaaauggaacagaaacauagagaggaacuggagcaauugaagcugacuacuaaggagaauaagguaugugaaauaaauguuugucguugccuacaccauuugaaaacagcuguccacuucuguuaaauguuaaacugcuuuuuuuuuuuuuuuugagacggugucucgcuuugcaaaacacgcucaaucuuggcucacugcaagcuccgccucccggguucaggccauucuccugccucagccucccgaguagcugguacuacgggcgcccgccacuacgcccggcuaauuuuuuguauuuuuaguagagacaggguuucaccauguuagccaagacggugucgaucuccugaccuugugauccacccgccucggccucccaaagugcugggauuacaggcgugagccaccgugcccggcccuguuaaacuguuuauuaucuaaaaucauaaaauugguagggaaaugaaaucacuuaguuaugcucaugcaucacuucucauuaauguuuuugugaccaaguuuacagggcaguguguuucuauaagggagaucggcaaagaaagugcuauacuucuuuaccuauuuacuugcccaaaagaugaagcuucaccaaaucaaaguuggaagaccaggcaucugaucccagaauugcgacugaaugggauuguaaccugagcaagguuacuuaaucuuucugagcucaaauuuucccacauauauaauacgauacaaauauuucuacacucuaagcacagguuuuuguaagaaucaagaaagugaacgugaagucauuuuuguuauaaaagugcuuuauuaacaaguuguaaugaaugaaauuuuacugauguuucuuggguaaguuggagcauccuaacuuucauaauuuuaacuaauauuuauuuuaucguuggaucuaauauauaugugucaaauacuuugguuuauauguauuaucucauuuaaccucaguaacacacugugagguauuaccuaugaaguaaguauacauaaucccauuuuucaagugggaaacaggguuagagagauuaagaacuuuguccaggagucguaacagcuguugauugccaaagccagaauuccaaaugagaacuaucuuacuccaggaagugaauacugaauucuguuacagcuuuguauagugugguauuuauuguauggguuuuggauaugaagggucauauagaccccacaaccucacuccaucuuugauagaaaguucuuaugucuauguaaaaucuuaaucugccauacuuaaauuuugguugauuuuugguuugcuguugacaaguacagcuugucugugcuuuuuauaaugguccuuacauuaaauauagucuaaauuucuuuaacuuuguuaguuaucaaguucccaacuuuccuugccuuuaauguacuucaucuccagguaacaaggcauauaugauacuccaggcguuaaauuguguugugacaauuguguuccuaauugucuccccaucuuuucuauuaaugagauaguuuuguuugcucccucagaccuuuccauuuugagguuucuuucccagguuuccaaggacaaaaauguuugauucauaagcuacauggaguccuacuguuaaaacacaaacucccauuuuaguuugaacuauuuaucuguuucauuaauuuaaauugguuuucuuuucugaauacuaccaaaaacuaaugccauugcuuuuuuguuuuucagaugcaucucuuuuaucuugccuauugucaauauagauguuuguaaauuuuaacagcuuccucugaagaaucacaggacuccuaauuucacuauaguugauagccacucuuugaagucucuaucugauuuugauauuuugaucauuugggacacagccuuugcagacuucugucucuguguauuaaaggccuugaguuguucuaugcauguguuauacuaaaaacuggcuuaccuuagaguugcaguaauaauggcuacucauccuuauaguuaaaagucuagcaucuuuuuuuuuacucuagcaaacacacacuagccauuuaggauugauuauaauaucaaaugauauuacaaauuaaauauauuuucugccugcaguuaucaguuuguagauggaaaaggguaggguaggaaaagcucaacuugcuacuagggucaaggauuaguacucaucagguucuggcuaauuaagauggaaaaaggccucugcugccaguagagguuaugcagguaauaaugaacugagccagcacaggaccuuuaucuuauauguacuggcaguagucagagaaaagaagaguggagugcuaaaugaguuggcgcuuacaggaaguacaguacugcauuuagauuaauggaguaggcauucuaagaaggaaggaaagcaugcagggaugagcaugaucuuugaaagaaacuucuugggaacuugucaaauucuuccauaaaaauagaaacaggagacaaaaccauauuaucuaauacagugucuauugcuguuacucaaauuugaaaugugggauuagauauauuuaugauuuucaguaauuuaauaaguacauugacuuguuaaugcuuuuuguuuccuucagauagauucuguugcuguuaacauuucaaacuuggugcuugagaaucagccaccucggauaucaaaagcacaaaagagacggguaugaaagucaugucaccaaguauauaaguuagugcuguguguucaauacuaucuuagguacuaucuuaggucuuguuauaggaagagaaugaaaaaaaaaugaugcaguuccuugucuaggcacuugaacuaacauuuauuaagcaccugcugugugucacauacuaugcuaagcugcuuauaugacaucucauuuaguccugacaauaauccugugaaguaggauuucuuauccccauuuuauggagaagaaaaugauccuaagauaauauaaaauaacguauucagguugcagcucucauaggagagcgaagcugggagugggagugcaaaguaguuuuuuuuacaaauauauuaucccagacuuaaaaauucagaaugugggcccaggggauucugaugcacaacccuagccaagaacuauaccauugggugagaaauaaggauuugaaccuagaaguuaacauguguagguauacaaaauucuuagagaauuauguagguaucuauauaaugguuaauuaugaaaauuuagagaagggaaaguucauuaugcuaauaauggguuggaauuugaaagaaauauuauuuagauaggauauuccaaauaggaggagcagcaugcacaaaaacaaaugugggggugauauauugcauuauugaagagcuauaaggaaacugauuuauuggaaguagcuaguucauaucagcauuauggaaaugagauuagauagguaagucccuuugaauuugaaaaagaaaaaugauuaaauucagucuuuuuaguugcgaguauuauuuuauuaacacuugauguuuucuaugguuuaaaugcauauuuuuaaauucauuuugcaucuuaugacauaguauguaauuuaguagagcauggaguuuagugucaaacagaugagguuuuaauuucauuuacuguuauacuuuggguacgguucuucuuuaagccucaguuucacaucuauaaaacgggggcaaauuauagcuacuucauaagcuaauucauugugaauauuaaauacuguacuauuuccaaagccuuuaacacaaggccuggagaacuaaugggucaacaaaugauaguauuguuucuauauuaaguaguguauaguaugccucuuaaaaauguaaccuaaaagcaaugucuuuuucuguguuaaguagugcauacuaugccucuuaaaaaauuaaaccuaaaagcaaugucuuuuuuuguuugcaagcugaugaaaugcacauaguccaacauuucucauucuuguguagaauuuuauuuuugaguaaauauaauugugaauuuuguagauucauaaaauuuagaucucauggaaucuuggagauugucugcuuaggauaugcauucuuuugugaugaucucacaauugucuagcuucuauagaucaaaaaggaagggcagaauuuuugcaugccaguagcauaacaaaacauuggaauuacgucuacuuaguaauugaaacaucuuauaauagccuauuuaauucuggaaaaccuaagggcacaaguucuuccuaucuuuaucaaaacuuguuccuccccagcuggaccucuaacaacaaaacaaacaaaacgaaaacucccuuaccuuucucaaaaauuuuguuacuuuuucccuaagauacugcacaacuggaauuaauacuuuugucaguuauacucucaaaccauuuaguaucuuuuauagucagcugcuuuaacacuugguagaaaaaaugcccaaguaauguuuuuacaggguuauauuaaugggauuuuagaacagaaaacauuaaacguuuauaaugcuuaagaaaauggaaccugaagucaggaugcacaaucggguguuagauuauuuggaaccuccuuuuugcuagaagcaccaaggaaugcaaagucauuuaauuaaugauguuuaucuuugggaaggauacaacucuggaagaaaaacgugauaaaacuuugucaagauuuauuuuaagaauaucguggaauauuguagagcauaucucuuauuuuuagucuagaaaaacaguauuuuauucaaagaacuuacaaacuuuuugauaugagagaaagagucuaaaauagaacuuagaagagcuggguuucaaaaauauggaauuugagggcuggaaugagauugaauucaauuucuguauuuuccaaugagaaagcagagacccaaguuaucucaauuguacacuaaaaguuugauacaaacccaggacugguguccagcucuuaauauucccuuugaaucuucuuuguuauauuacuauaucaacaugacuguaguuuuauugacaauauauuuaugauuuacaugcuauuuucaucuuuuauacguuuuuauuagaacuuauuagugccauucuaucuccacuacuauagcuguagaaaccaaagugccuagugcucuugggaaacuauauauugcuggaaaaagaauucaguggauuucuuaccuagugcccugaaaaggaaacucaauugcuuuguucuaaugaagcaaagcaugaagggaaaaaaaugaaaugauuagaauuaguauuuuagaggcuuaaacaguuuugcagauaagauaaagugccacucuuucaguaaauaguacaugacaucauuaacuccagcucccaucugcuccaacuuuuauucugauucaggugccuggauagaaggagcucucuguguuguccuuggucccugcucugcucuuaccagcuguauggccuuuggaaaucuuucugcgugcuguuuccucagaagaggaaaaugagggguuuuggauuagaugauaucuaaggugcuuauucuuccuuuccccucugaaacuuuuuuagucuuuuauaaaguaauagugccaucuuguguuuuaagauauuaugccucugugauccacaguucuagguacacagugaaauaaauuuguuccuauuacuuauacaaaccuuaaauaggcuauguuuuauuagggagauauuacugcuuuugauucagguaacuuagaaaucacuuuagguucaucuagcauggcacauaacaggcaaguaguacagguacaugacaauaaguuuaauugaaacuugccuucccauucacuuuuguuccaaggagaaaucagagcuaguguuauggaagucuuuaccuuuuccuauucuuggcuuaccaaauccuucacuguaacuuauuaaugucaaaauuuauauaacuuaguuuuuauucuuaaauuauaaagcaguuuccgcuugaguguacaaacaaaauauaugauagagaauuagaaagaugcagaaaaacauacagacauacacacacauacacauacacacaccccaaaauaaaacuuauuuuggaaucccgucauccagaaaaaagcacuauaaauacuuuguguauauuguaguuucuuuuuaguccuauguuaaguauagaccuacuguauauuaauuauaugccuaugcuuuuugccuccaauuucaucucuugacaguuuucucuggcacuguagcucuaggaacuguuuuuagcuaugaaacauauagugcuuucuggcuuuugaucauuacuaguccaucuguuaggaauuuuuuuuccuuucuucuuccccaaccuucccuauacaccuccugucuauucuucaugucacaaaucucucauuuccgucaccccacuccauccuugcauauguuuccaugggaggagcuuaucagacauuugcauaaggaaagcaaauuguagaauguaacauaugauaccauuuuuauuaagaauuuauacauauuuucaagaguauaccauauuuauuaaaaugaauggaaaaacaaucuagaaggaugcauaccaaaccucuagagcaagcacugggauggcagugguguuauggggagcuugagucucucucuuauauuuuaauuuuuuuuuuacaaaauauuuguuaauuaaauguauguguauacagacauuuuaaaaagcuugauaaaaagggugucugccuguacccuuuuaaaggcugugucauauuaacacguuacugguggacugauaagaagccuggauuagccugggcuuuaauauaauaauaaugugcuuuaaggccuaggauaacucagucuuaagagaauacuuugaaaucaguaaguaagguuuuuagaaacuuggcauguagccuuuaaguagacuuuaaagaaaaauuagagggcuuucuuaauguccaguauagagcaaggugcuggaaacacacagaugaguaagagaguaaggagcucaccuuguagaaaauucuugagaugaucaaugugauaguguuugugcgagaagggagaauaaacaccggaaaguuuugagaccuuuacauuucccuucccuuaauaaaugagaauuaguccaaauuauuaugaauuaacuuucaugcauucugcuuuucuuaggaaaagaaagcugcauuggaaaaggagcgagaagaacggauagcugaagcugaaauugaaaacuuaacaggagccagacauauggaaagugagaaacuugcucaaauauuggcagcuagacaguuagaaauuaaacagauuccaucugauggccacuguauguauaaagccauugaagaucaacugaaagaaaaggauugugcucugacugugguugccuugagaagucagaccgcugaguauaugcaaagccauguggaagacuuucugccauuuuuaacaaacccuaauacaggagauauguauacuccagguaauuuauuuuucuuuacuauguuuuauuguugcuuuguuguaguuguuuuuaaauaaggugcuucccagcacugagcguaagaagaacccagaugauccuuaugaggaaaaaacaucacaagauuuaggcagaauuauuuucuguaauuuuaauagauguugguguauuuuucucuauuaagauuucuuaauuacuuaguuauuuuguaauuauaauaugcuaaucauuuuauguaagauagaaguaggaauaagagucauuuuugaaaaaaauguaaguucuuauuugacaaagugaaguauugaggaagguaagcuucaggaaguauauauagggucugaagaccauaaggagagaaugacuaggaaaaccauuuccugcuuuuaucuuauaauuugggaacuuuacuuuuauuuacaauaagcuauaauuaggaagauuaguguucaaguaaaacaaauggguuaauaaccugcuuuauucuauacaauacuaucacaguuaagauaaaauauuuaugaggaaguaaaaaaguacacaacuagcagaugaggaagagagcaaguaaaaaucugaauagguuuugggguaguaaugaauggaauagaggacuauuaguccuugagagaauauggcagguuuggcaguauccauuguucccacaagucauauggccagaauggguugcagagagaaagguuaaaauugacuuuccuuuaguggagucuguccuccauggaggaaagguagagagugaugcagaauugauaagaaugagcauuggcagucaagugugucuccuuuagugugcauggcuuaagguaucuguugauagauuucaagaaugacuuaagcauaaucuaauucuguagugaauuaauuucccauagaugucauauuggaaauguuaacuuaucucuugcuguuuuaggucauugcuguuuucuacauaaacagaauuugcuaugggacauaaaacacauuuuuccauauauuuugauauaugcauaggcaaugugauaaaugacucuucugucauuuaucucccaaaugauuacugaaucauugaaacuccccaauugcgcuaguuguagggcauagaggagguggcaguucaguaugcugagucagagaaaaacacaaaagacuuaauuaauuaucuccauuuauucaaccaauauuaauugaaggccgcugugugccaagcacuacucuaggcacuguucugaacgcugaggauuuaacaggguaugagacaaacacaugagacauauuuuucuucuagauguccauaauuucuuuccuuccaucucuguaguaaggauaauuguuuuccauuuuaacauacuguguaaaaagguguaugcacaaaauauacccauuguaaauuuagugauuaggucuuuuauuucucagggcugaugugaaaagccuuuuccuugguuagaacugauacuuaugcaaguaauguaagugcuuccaaaauaacaaguggaggcacuguuugacgcuaucucuggggaaggaauuucaauucaucuguacuuuuacucgaauucucuucguauauuucccagagucuuacaguaaaccugauuauacaggaacuacauuuuuuuugucuuucaugguauuccuuuggaugcagguuugggcuucaaaacacaugucaagauagugaauaugguggcaauuuuuggggucaacgcuugggguagagugagguagguuuguuauauagggaggguaucugggccuccaacagaagaagaaaagcagaaauggacugcuuuguucuuggauggaaaugugguagaaaguuggggugaauuaaguuuggaccugggaguuagauuagauucuggaggauaaugguagagaaggagaauguucauaacuugggcauuuuugucaggaauugugggaacuauaaaagggauuuuguaacaugaguuacaaaaauuauuaagugcuguauucugaccuaaucucuacagaagaauuucagaaguacugugaagauauuguaaacacagcugcauggggaggucagcuugagguaaguuuguaguuauucauagugauuguggguuguuaaauuauuucuaaaucccuucuguaguuuuuagauguuucucagcugaucccaauuucucuuugaagauuccuuuucuuuauauauuugcucuucucaacugacaaagaaauagggaguuaacaugauuaggucugugauuaaaguauguauguugagggauugaaacacuauuacauuuuaaauagcucaguguuagaucuguguguuagaaauacauauguguaagucuuuucaucgugauaguaguauuggcaauacauuugauuuucuggacuuaggaaaaugaaaauuuuacugaaguaaaguaaaauuuagccuaguagcucagcugaucaaagucacuauuggaaaaauaucuuuuuuacaucagaaauggaaaaaaaaaauuaugugaaauuauaggccaaauccuaccacaacauauauauuaaaaucguauuuugaauuccuaauugauagugacugacuuacuugaaagcaguaguuggugcauuaaauucauauguaagaaaacaguauguucagucacuuacaggaaguuaucaagauuacuuuuuagcucuaauuuuaaaaaaaucuuacuguuaacuuuguuuuguuaaaaacaaacaaacaaacaaaaaaaacagguagguaggccagauggugaugaagcagccuggguauuaaauaggauaagaaagaaaguucuggguucagguccuggcauuuucuuccaccccucuguuuuguggccacaggggagucagccauccucccaagcuugaguuucuugauuacuauauggccauaauaaacccucucuguguauucaguugagcauuuuugagcauuaaguaaggcagagaguaccugcauaaaaguuuguaagcugaagugccagauggaugaaccuaggcaguacgauuaguaauauauaaugaugauuaaucaucaugaauagucuguggcucuaaauaauucacuuuaagaacugcuucauuugaagaugcaacaugaauguugccccaaaaucuuuuucuuaguacugcuguguaugugcauuuccaccagagggaacuguauccauuaguuuuguaugccucggaaacucaggaaauguucauaguagcuuuguuacuacuacauuaggaauaauuaaaaaugcuugaacuuucuuaaaaggaucauucauaugaguauuagagauuaaaucaagaaauuaagaaaaaccuuuuaaaacaucuuuugagggacacuuauacauuuuuuucaucugugaauucauuugaaguaagaguugcaguuuucacaauagaguaaauuuaaguuauuaaagaaaaucauucuaugaucucugaaguuagaaggcauaguaggauucccagaguuugguucgcauccucuauucuaugcuaguuucuuaaaaaugauauuuuagguauaagaaaaauguaccucaaaggaacguuuuugauuuaccaccaugcagcagagugcuuuccauauuuuugaaguaauuucuuaaauucuuucaaaaccucaggaaggaguauguucaucaauggaauguucuuguaauggggcaaguacauaucccauagugcccccauagaucggggcauuaugauuuuuacuuucuuuuugagacagagucucacucugucacccaggcuggagugcaguggugccacccaucauuguucacuacagucucaaucuucuaggcuuaagcuuuccucccacuccugaguagcugcaccaccaugccuggcuaauuuuuguauuuuuuguagaaacggggucucccuguguugcccaggcuggucucgaacgccugaguucaagugacuuugacaagucuuguaacccuuuuuuugccucagauucuaggucuuuaaaauaacgacaguacccaucccauaaaguuauugagaggauuaaaggaauuaauacacauaaaguacuuaaaaugcuugaguguuuggucauaugucuuuuuuuuuuuuuuuuuuuuuuuugaaacagggucucacucugucaccccaguuggaguacaguggcgugaucuuggcucacugcaaccucugccucccgggcucaagugauccaucaugccugguuaauuuuuguauuuuuuuguagagacaugguuuuaccauguugcccagucuggucucgaaugccuggacucaagguaucugccuaccuuggccucccaaagugcuggaauuaugggugugagccacugugccuggcccguaaucauaauaagucuuuaaaaauguuagcauuaauguucaauauucaccauuauucaucuggcuuuaggcucuaauuuuauauuguaugguaugaaauuacuuaaaauuguauauuuuaaucaaauagaaauucauugauagggcaguacaauucauauacauauucuacucuuugaaaauuauagaacagugguugucaacaguauuuguagauuagaaucaucugaaaaacuuuaaaaaaauaaauauuuuguucuucccccugcccauuuucucacauuguaauuuauuugguccggugcuugagcaaugguauuuaaaaauuuuuuuuguuaugaacauuuucaagcguauucaaaaguagacuaguauaauauaccuagucuacccauugccccucuucauuaacuguggcauugauauuuuuuacaaagcuuuugugcaggcagggcuugagcagucucugcauuugauuuaauaaauacaaguugagcaucccuaaucugaaaauuugaaauucgaaaugcucccaaaucaaauuuuuugagggcugacaucacaaguggaaaauucuacacuugacuuuaugugacaggucacaguucaaacuuaguuucaugcacaaaguuauuuaaaauguauaaaauuaccuucaugguguguguguaagauauguaugaaacaugaaugaauuuuguguuuagauuugagucccauccucaagauaucucauguaguauaugcaaauacucccaaaucugaaaaauucaaaaacuaaaacaauucugguuccaggcauuuaggauaagggauauucaaccuguauuauauuuauuuauucaacagauauuuauuaagugcccaguauauaccaggcucucuguguacaguggugaacacagcguaucccugcucugacugguugcccguucacacauauuugaaugugauuuacauuuuuauuuuccuuacugauacuuuuuuucuuccuauagcuaagagcucugucucacauuuuacaaacaccaauagagauaauacaggcagauucuccucccauuauaguuggugaagaauauucaaaaaaaccacuaauacuuguguaaguaccuagacauuuuuacuguuuuauuuuucacaauuaauacaaaaaggaauauuaaaaaauuuagauuauauguguuaaaauaugugacuuagauaauuuuuuaaaccucuagcgauuuauuuuugugugugaguuuagaauaaagucauuucuaaagguuauaacauuuuaggacuaguuuguauacuguccugguuugacauuaguaaugcuaaaaguuucaacaaguguuaaaaguugaaauacauucauguugccuguuuauuccuuagauuuauuuuucuucauuuuaugaaaauaucuuacaugauuuagaaaucucuucugaaauacagcaugcaggguuugcuauuggcuuuaguauuuuuuagcuaaaccuauuaagauagucaucaauggcuagaugacaauuuaagcugauugaaccuucagcaucucagccuuuucguuuuaccccagugauugaaccagaucuugcugacugcugccacuuuucaaaugguguugaacucuuaauuaauauguccacauagucuauugagugaaacccauguggacugagucauucagaaucauugguuuauauauauauauaauaagcauauauauauagaaaaauugcuuucaucaaaacuacucauuucuuuuuuuuuuuaauuucagauauaugagacaugcauauggcuuaggagaacauuauaauucgguuacacgguugguaaacauaguuacugaaaauugcagcuaauuuauacaauguuguacaauuauguuuuaauacagugugcugaacugaguauuucuaccaaguguuggguuguucuaaaugcuacugaaaaacacaacuaccuuauaucaguuuuauggcaaagcuacuaacagguguuuuuagaaauaugucagagauaaacuuuaaccagugucuucuuaguggaauuuuaaaaauuuguuaaguucauuguagagaacaccauucauagaccaagaugguccccuauuagcugauauuuucauuuauguaagauccuggacauucuguuuuguguuggaacaaauuuucaauguuuuuaauucucccuuuucugccuguuccuaaaaacuuucaaaauaaccauuucaauguaauuugucuugaagaaguuuacccaauaucuuugucauugcaauaauguaguauggugauggucaauuuaauuauugcuuauaaaaugaacuugauugcaguaaccaugguaucgaugagacuaaugcagugaagcuuuauuacuaauauauauagccuuaucaaagcaagcuaagaagcuugcuuuaauaauuaauaauuuaaaaauauuuauuuagaugggauucaguuguuuaaagaagugagauaaauucaaagguaaauagguauucucugucaaauuuaaaucucuaaagaauuagagauuaguuuuuuauuuguguauaauuuaaaaaagaccuaauagguuacugucuuuuuaaugcauuuguuauucuuucguauuuuuuaagcaucggacuggaguuaguaccaucaucucuugagucuuucauaacuacacauuuuuauauuuccuuuuguguuuucuacuuugcuuuccuugaaggaacaagcauuuuguggccuuuaccuugugcaauuuuagggaguagcaguguaaaagguccaagaccacauuuacuugaaauucuuccucuuuucugauuugucuuaccagauauuucccuucuugccucauucucuaggauuugaauaaaaccuuugccacuuauuuuauuagccuuauuaaugucaccuuuccuucaacucaaauauuugagaaauuuuauguuacauauaugaaugaaguugaaagcuacuguuuggaagcuaagacuuguauagaguaguuuuguauaugaaugguuguucuagcucagauuucagguuacucacaacaguauucuuucuaagaggauauauacaaaugucucucauaauuuauguaaggaaauauuaugaaaaugagacuuuuuuaguuugauguguguuucccaaacuagagauaaaacuaguaagauuuaguaucguuuauaacauuugaauuuuugcuccaugaguacaacuaauuuuuauaaguaaauauuggguuuauaugaaaaauggggugucagucuuuucacacgcccagcagguaacaaugugggaagcuggcagggucauugauagcaaguaaguacuuccugaaggcuuuccaguucaaaagauuacaagccauucugccugccaaacaaauuauauucugaagaugccuguuuuguaacccuugaugugaauuuuuuggugucugaaauuuacaaaagaaugaaauugaaauuguaaaacacuaaaugcuuuggguuuauuuugaaguaaucuguuacuuuaaaaugucaacauuaggaagccauaaaacaagauauuaugaaacccaguauuauaaauguuaucuacaucuaaaguauuuuaaaauaacuuauuggcagcuuuauucuuuuuuuccuuacaagauuuagaaucuuuuugguuauaugucuauuuuucaauuuuguuauauuuuuaauuuaaguggccaaugugguuaugaacaagauuuguauggucagcuucuguucuuuccuaaaacuucagauaaauaucauuuuagcuauaaccuaaaaaaguguuuaaauaaaaugacagauguuaauuuaaaagcagcauaugcuaauuuacuuuuucauaugaugauggucuaauggaaguuacauaugcuuucuuuuguccuaacucugaaaaguauaugucagaguucuggaauaugucuuuagccaagaauuuuauucacuuaaauuuguuuacaacuuguauaaagcaaaaaagaauguguguaacuauagugaacgcauaguuuugcuuauauuaugugauguuugccaaaaaaagaauaaaaaaugaaugaauuaaaucaa

SEQ ID NO: 13956 - RNA, 25405 nt, Homo sapiens
cggaagguugaaugcgucgggugggcaccucagcaaccaguagccaugcgcggcuuggaggagucggggccucggccuacagcgaccccgugcggcugcguuaagccggcucuggagacagguaacuuccaacaccggcggugccacacucuggagagguuuaggcccaggcagcggacuucguugccgagagggguguaaaacgcacgaucuggaacugacgugcgucauucuuuuaccuacggcgaaggcacgggucacgugcugcggagaccacgugaugugcuuuggcgagcgggaugacgucaucuggcuuguuccgcuuuguuauaagacuuguacugucugcguagucuuggcucaguagcuggagcagcuacgugcagcguaggggcuuuucucuuagggguuuccuugccauagcguaugggagaugguguuaggcggguuaggaauuaauaaaugccauagagaggcauccugcgcuguaggaaugaggacagagaagggggaaaguuucugggggagaaaauaguuuuaaauugggccuagaaagacaaggcaugaauuuguuucucuuuacucacacguuuucauagaggaauauauuagcuuuagaaacuggaaagcaaauggaagaaaauuaaaauaaccugccagagaaagccauugucaauaucuuggugucuaccuuccacgcuuguuucuuugcauacacacuuggaaagugagguacuauacgaccuguuuaguaacguuaaaauaauuuaaaaaaaaaucuuaacagggcaguuaauguuaauuauaacacuuugggccgggcgcagcggcucaugccuguaaucccagcacuuugggaggccgaggugggcggaucacgaggucaggagaucgagaccauccuggcuaacacggugaaaccucgucucuacuaaaaaauacaaaaaaaucagccgggcgugguggugggcuccuguagucccagcuacucgggaggcugaggcaggagaauggcaugaacccgggaggcgggcuugcagugagccgagaucgcgccacugcacuccggccugggcgacagagcgagacuccgucucaaaaaaaaaaaaaaaaaauuaacacuuuguuuuguuauuauuaauuuuuguagaggcaagcucucaccguguugcccaggcuggucucaaacuccugggcuuaagcaauccaccugccuuagccucccaaaguuuugggauuacaggcaugagccacugcaaccagccuaacgcuuuguuuuagauaugugcucuaauuuaaccagcuuccuguuacugagcauuuaaguuauugccaguuugcauuguucuaaaagaaagcucuugaagccgaaauguuuguguacauucuaaaguuugaacuuuguuaaauuucuuggaagugcuauuaccuggccaaaugugcuuauuuaaaaaaaauuguugcacacugccgauuacaggucucauauuuugacaggaaggaaaacgcagaagccagggcucagaagucuacacaguauagguuuggggagcuagaagucuaaaguguuggauggaacagggaggugggaaccuuuggauucugauugugaagaaacuugaguaccaggcuaagaaauacaaagucuguuaacaguggagaauaugaaaaguuuaaaguuaaagaguuagcauaacacaagaaacucuaggaguguugaggauucgucuagaguauuuugagaaggggaagaacuugcaguggggacagaaagccuaagaaggguaauuuaauaguacagguggaaaugaaaaggaccugaacuuauuuucagagcaagacguguagacaauccuguacacaaaaaaccccacauugauugcuugcuggcuuuuuacuuauuacacaguuaauacaguuguaauguuuaaaugaggaaaaagccugagcagggacuuuaaaaagcacuccuugcugggcaccuucuauuuuauuggaugcuuuccuauuuuauuaguacuuuuacagcuuuccaaaguagguaguaucccuuguuuuauagaugagaaaacggauucagagagagaagcuaguuuuucccauggucacacagcuaguguaguggcccuguguuguuuuuauccuuucuccauucugaaaccaguccuaauucucucaugcuccuuugaggaaccacuucuccccauuuccaugagguucuugugcugguuuuugucauaccugugcuuauuuaucucuaucccugcaaaggcaccuagcuagaauuguugauuuacuugucuuucucugucaauguacuggaaacccuugaggacgagaacugguucauauuuguaccccaaguccuuagcacagugcuuaccaaaaugguagguguuuacuguucuuuuggguuuuuguuguugucguuuugagauaggcaagaagaagaagaccagaauuccccuuggcaaacggugucaggucucugcuucaaauagcauuuauauuucauagcauuauccccaggagggcacagagaauguauaaauaugucccagaagaguucagacguacuaggauauggauauuugguauuuugagaguggucccaaacauuuuagaguagcagaguuagaagaacucuuucaaaguagcucuugaguauacuuccaguucauugcuaauccaguguugucuugcuuauguucuuaaggagaugcacaaagaggauagaaguaaaucuaauuagaggauagaaguaaaucuaauuggcagccacuuauauuuaucauaucauauguguaaucugugaaaaacaggcauagacugauuuagugaagugauaaaucagcuauaauauaaauuccuaggccccaaaucaaagagucaagggcagaagucuuugauuacuuuacugcugacaggacauuucccaugauauugaagcauggugugauagucuccucaacuauuaaauuccacuguaguaagaguucuugguuuguaucuuuucuccaaacuuaacacaaugucuggcaauuguagacacuuggaaaauaguguuucucucuuucuuuucuuuucuuuccuuucuuucccuuuccucccuuuccuuucuuuucuuuccuuuuucuuuucucuuuucuuuucuuuucuuucuuucuuuuuuuuuucuucucuuuguggagcagagcuaacucaugggcagugugcccagaguaucagccagaaaauguuucuugaacaaaugaaaagaagacacagggauuuuguggcugggcuaggggucuuuuuuggccauuuaucuuccagacauaaagaagauaugccaggucguuuggccucaguuucuucauuuuuaagaugucuacuauaucuguuccauagaagcauggaugaggauuaaaaagaaaaaacaaaaaacuaaaaacaaugccuguaaacauacuugaacaaaaauuaaaguugucaaaaacauacagaguauguauggaucuuagccucauaauauugagagagaaaaagcaagucugagaagacaacuuacaguuuggugccaguuuuuauagaucuuaaagacaaaaaucaaugaaauacuguuuaggcaugcauguacauguaacaaaaucauucucuaaaaggaagugaaugauaaagaucaaauucaggcuucuguuuaucucagagggaaaagaagggugugagguaagagaaaaacaaccuaaaaagaacaagucguuaguaacgcucuaguuuuugggaugggugguguauacacgggguuucaucauauuaugccguauaacuuacauguauguugcauaugauauuuauauauaucaaauaaaguagcuucuagaagugaagaguaaugaaagauacugugagggacagccccagaccuauagucuuacugcuuaugcugguaggguagauuuaaggaagcaggaaauaaagucugaagugucuuuauaucaucucucagaaauugauaacgcugucaugaaaugugagaauaauaaaaaaguuaucaauaaauucaaagugguagccauggaaaccuuggacuuuauauugauagugucuggccauuuuuuuucuuuugaaauauguuauuacuuaaaaaaauugugauuuuuuuuuuuuuuugagauggagucucgcucaccuagguuggagugcaguggcgugaucuuggcucacugcaaccucugccucccagggucaagugcuucuccugacucaguuuccugaguagcugggacuccaggcaugcaccaccaugccuggcuaauuauuuuuuuuuuuuguacuucuaguagagaugggguuucaccauguuggccaggcuggucucgaacuccugaccucaggugaucugcccaccucagccucccaaaguguugggauuacaggcgugagccaccgcgccuggccuaauuugugauuauugaaaaaacuucaaauauuauagaaauuacgaaguuaaauuuaaagguaauuaaaaaaucucaccacccagauuaaccacuguuaaaaaaauuggugaauauuggccaggugugguggcucacaccuguaauacuagcacuuugagaggccgagaugggcagauugcuggaggucaggaguuuaagaccagccuggccaacaugguaaaaccccuucucuacaaaaaaaaaaaaaaaaauuagaugggcauguuggugcgugccuauaaucccagcuacuugggagacugaggcacgagagucgcuugagccugggagguggagauugcagugagccgagauugugccacugcacuccagucugggcaacagagcaagacucugucucaaaaaaacaaacacaaacaaaaaauaaaacacagcauguggugcauauccuuccagauagcuuuccaaacauaccuguauguguuuaagaagguaaauauguaacaaauuuccauaagugggauuauauuauauauauuauuauuuuacuuuuucaauuuccacauuaaucaguuuagacauauaugaucuuuucuucuaugcaacaugaauuuuuugaguaccuacuccguugcaggcaauguacuagacaaugagaaugcagcgauaaaugagacagaaaaacugcccacauggagcuuacauucuagaggggcaguaggcuacuggaccaagccuaacuugaaauuuaccuugccucuagauauuuuagcacuaugagcuuauaagcucucuuuauugcuuaaauuaguuuauuucauauguucuguugcuuucaauugaagauauccuuacuuauguauacccaguguuuccucaucuuucauuauucucugccucuuauuucauacuccagccaaucaaaauagcuuguucccugcauaugcuaugacauuucucauuuacuuuuguguacacucucuccucuauuagaaauacccucauaggccaagcacuauggcucacgccuauaaucccagcacuuugggagguugagguggguggaucaagaguucaagaccagccugaccaauauggugaaaccccgucucuacuaaaaaucccagcacuuugggaggucaaggugggcgggucaggaguucaagaccaaccugaccaauauggugaaaccccaucucuacuaaaaauacaaaaaaaaaaaaaaaaguugagcgugguggugggcgccuguaaucccagcuacuggggaggcugaggcaggagaaaugcuugaacccgggaagcagaaguugcagugagccgagaucgggccacugcacuccagccugggcaacacagcgagacuccaucucaaaaaaaaaaaaaaaaaagaaagaaauacgcucauagcccuggccagagucacaugacuuaguauugguagcauagaauuuuaauuauggucauaguagguauucugaaaaugcccccuuacuuucauucuuucuuucuuggaccauuauucuuucuaguauaucuaaagggauauuacuauguauguaaugauguauguguauguguguguauguaaugaugagaauacuuauacguauucaugaauacuauaaaaaucauuuuuauaguugcacgacacuaagauuuuaaaacuaugaaaccaaugcauuagagaaaacauguuuucuuacaacuugguuugaccuuuugacuaauaacuuuuuaccuaauuuucuccuguagggaaucuuuuaacugagccagucggcuacuuggaaucuuguuucucggccaagaaugguacuccaagacagccauccauuuguagcuauucucgagccuguuugaggauuagaaagaggaucuuuaauaauccugaacauuccuugaugggccuagaacaguuuucucauguuugguaaguugcuuuauaguuagauguaggauuuugggccagaacuugcccccgaauaaaguacucuaguugaaggcaaccuuggagucugccauccagaccacccucaucuuuguuuuguuuuguuuuugagucagggucucugucacccagguuggaguacaguggugcaauagcagcgcacuguaaccucugccucccgagcucaagguauccuuccaccucagccuccugaguagcugggaccgcagguguaugccaccaugccuggcuaauucuuuuuuguauuuuugguagagaugggguuucaccauguugcccaggcuggaacucucaucuuuugcauggcuuuuuuauuuuuuuuuauuuuuuaagacaagugcaguagugagaagaggggaaaaguagaacaaaaaguucaaucuguaacugacugugaacaaucaauugagauaacucauuaccuuugaaccagccuguuguauggaauuuuguacuguauuugugcauaugauuaucugugucauuuagagauccucagggaagcuugggauccacugaggugacauguuccauuugcaguugguucuaauggugaugaaugccuucuguugaguggaaauuauagaccuccuugacucugccccugggucauuauucuacccucuagaccaggggucaguaaacuauggcccauuuuuguaaauuauuuuuaugggaacaaagucauauccauuuguuuaaguauuguuuguggcugcuuucgugcuauagcagcagaguugaauagucucuauagugacugguuggccugcauguccuaaaauauuacucucugaccuuuuacagaaaaaguuugcagauccugcucuagacucauguagaauuaaguauacuccuaaaagacaagacacuguagaaaucuggauacuuuaaguguuaccuauauuagggccuguguuauacuagcauuguuuguugucauuucaaauucuguccguguucauucuuccucaccccagcaucagcagucugaaucggucuauuuuuauugguagagaccuaaaaauuaaguguauauucugaaauaguuuauuuuucaugucaauuuggggacaagaguagauuagaaagaaaauguauguucugaccuaguuuguauuaugauccugauugaauuauuuaaguuaaaaacauugaugauggaaaaaauggguucagaaguauauaaagagauuuuuccuuaucccuccuauuuuccuccccucucucccuaaccccaaccacucaucagagcuuauuacuguuaacagcaugguguagauccugccagaccuuuuaauuuuuucuuuuucaaguacacauagaaacaaauauauacauacagaguggguauuugcuuuuuuuaaaaaaguauguuuucuucacauaacaguauauaccauggagaacuuucacgacaguagauuuaccuuuuuuuucuuuaauagcugucuauuauuacaaaauauagauguauauuuuguaauauacacacucuuguuaauggagggcuauguuguuguuauaauaacugugacaaacccccuuagacacauucuuggccacuuauguauuuuuaugaacaggauaucagaaguggauauauuggguuagaagguaagcauauuuagaauuuuggggaacuacuuccaaauuauccucuaaaauuaaccaauguauacuucaauaauauaugcaaaugaccuuuuucuuacacccuucccaacacaauauguuaucaguuuuuuacauuuuugccugauggggaaaaagaguauuuuggauuuuuaguuuaauuucuaaauuuagaaauuucuaauuauuagugaagcucaacaucuuuucauaugguucuuagcuacuugccauuuuuuugugaauuacuuauucauguucuuugcauaguguccuauauuggguuguccuuaguaauuuguaggaacaauuugugugccacagauauuaaccuaugguccauuauguauguagcaaacguuuucucuuaggcugacauuuuguaguacauaaauguaaugauuucaugaguucaaaucuguuaguuuuucuucuuggcuucuugguuuuguaucuuuuuuaggaaggucuagucaugccaaauggaaaaagaaaggaaggucugguaaagguauuuaacauuucugaacuucaauuuccucaucccaaaaaugggggauaaauuauauuacuuaagacaguuaaggcgauuguaugaaaugaguguaaaaauguuuuaccguacuaccuggcaaacagcagacacuuaguaaauauuguuuguugggcacuugauaaacgucucucaaguuccuacugugugccaguuguuguguuagcugcaaaggauguggagaugagauucugucucuuccuuuaaggaaaggggaugguguuauuuucuuccuaccagaugacaaguuaauacuauuuaaaacaugauuucuguuaauuugugggagauugcauuuuuuuccccaucagaucauugugguaaaauaacuugugcucuuuucuuauuccgugguuuguuuuguuuuguuuucuauaggauuuuguuuguuuuucacaaaaauggucauuugagcuguaaggcaaaagugcagccuccuaggcugaauggugcaaagacuggaguuuuuuccacaaggagcccucaucgucccaaugcaauaggacugacccuggccaagcuggaaaagguagaagguaacccauuucauuucuacuuuuaccuuuuuccucacccaaaaaagccuuauaaaauaaacagcauucaccacuggcuguuuauucagacgaguaccaaugauguuaacuccugagaaccaccagacauugaagaaaauacaaugauuaaaagaauguuagcauugaaaaauguugaaauaaacucauaggaugcucagagcuuguuuauauuauugcauauauccaaaacuauuaaauuauuuagaaauaacacaaauuucacaaucauuaaauuaguaaccaaaguuucucugacuuggaaugcaguaaauacaaaaugauuaaaaauaaauggacacuuuccaauuuaacacacaauaacucauuguacaugcacauauggaaaacacauagacuggugguauaucauuccuuccuugcagccuuggggaaauggacagauaucauggcugcagugcugaugucaacugugcuguguggcaggagucugggaugaaucacacuacaaggacaaacauuggucagguuguagaaguuuuaaacuaguuuuaacuguguguucguauauaaccuaguuacgcauuuauggaaagcauuccauucugaccuaacagaugcauuuguuauagaggcagcagaugaaauggcagguaaacuaggagucaagagaccauuccaggcuucagccugcugguugugaagugggcaaaggagaaggaccugcuuccucugugauuccacagaauauuuugagaaucuuguaagagagaaguucuaaaacuacuuuuucaggcuauuggacacuaaauagaugagagcaguuauuuugcuuguucuuucccagaacuugaacucucccacuggauuguacucaacugggccuuagguaguuuucucagaaaaauucaguagcugauccaccuugaauuuuaucaauuuguaauggcuaacaaacuuggauagcaaguacuagaagauuuuaugauuauucagggacauauuuucuagcacugaauaugugccagacauuguccuaggugcuagagcuauagugauaaacaaaucagaugaaaguagaaauccaugcccuaaagaacuuaauguuucaauugggaaggucaagucagauagguuaaaaggcaaacacaguagcacuguagacauuacuauauaagcuuuauggcaacuaguguuugugcagugcuuuacaguuaguaaacaguguucacguaccuuaucucacaguggcuuuguggguuugacaaaguagcaauccucaucucauaggugaggaaacuagggcucuuuaagauuagauaaucugucuaauagcauccagccagguggucaucugacucuaaauccuuugaagucuuacuuaugcuacagugccuuucuuuuuccuacagauauuguuaggcauaauucaucaucuagcaaguccagaaucaucuuuccagaguuccagcucauucauaauaacauguuucagaaaucaggguccuguauuaguuacguuuuucuuaaauggagacggaaucaaaugugacugcauguaguuuuucuguucucauuuggccuauuuuccaagaguaagguuaguagauggcuauuuguagcaguaacuggacagcaucuguccagugggacagcuggagacuugucuuuaguauuugguaaugcugacuuaugugcugcuuaaucuuuugagucuugauggauguauuagauuucuauuguuguguaacaaauuaccacagaaucaucaguuuaaacaacacacauguauuauguguuugaaacauuauuauguaucugugggucagaaggaugggcacagcuuaacuaggucaucugcuuaggucucacuagacugcaauuaaauugucagcugauaugaguucuuaucuggaggcuugaccauggaagaaucugcuuaagcucacucagacuguuggccacauugauuuccuugccaucguaguaggacugggggccccagauucuugcugguuguuggcuggaggcugcccucagugucuaaaggcuguuugcaguuccuugcuaugugggcuuccuagcacgccugccuacuucagcaagccuucaaggagagucucucgagugagucuuccagccagcagcagugcuaaugaaaagcauagucacuggagggacaucauaccucuuuugccauauucuguugguuagaagccagucacacucaaggggaaggauuauauaagggcaugaacuucaggaggugcgggucacagggccacuuuuggaucuguuugccacaguaagaaccuucauuggucccacagagauauacugaggacuacuauaucccuggaacagaagcaccagugauacaaagaugaguuggucccagccuguguuaaggggccugccugcgucuagggaugaagacucuaagcaggucacuacccuaccguggggaaagcgcucuagcagagguuugugcacaggcuucucuauggggacuguaggaaagaaugcuuuugucuggaggagccagaaaggcuuuguaaaaggugugcuuuugagggccucaaagagcaaguaggaguuugauagguagagaagaggaugggcuaccagguagcaagaaggguguguguugguacuaggucugugugagagaauuaugaguaagugcagugaggcguaagcagacaguguuagaggauucuggggcgugacuguauucuccaaguguuugcacuguucuucauuuuucacguuuuuaugucauagguggagcuauauaccuuucuggaauugacaugauacauggcacacccguacuagacaucaagcccuacauagcugaguaugacucaccgcaaaaugugauggagccuuuagcagacuuuaauuuacagaauaaccaacauacaccaaacacugugucccagucugacagcaagacugacagcugugaccagcgacagcucucagggugugaugagccacaaccccaccauagcacuaagaggaaaccuaaauguccugaagacagaacuucagaagaaaacuaccugacacacagugacacagccagaauucagcaagcauuuccuaugcacagggagauagcaguggauuuugguuuggaaucaagacgugaucagaguuccagcguggcagaagaacaaauuggcccauauugcccagagaagagcuuuucagagaaagguacagacaagaagcuagaaagaguggaaggagcagcagucuugcaaggaagcagggcagagacacagcccauggccccucacugcccugcuggaagggcugauggagcuccccgcagcgugguuccugccugggugacagaggcuccuguggccacuuuagaagugcgguuuacuccucaugccgagauggaccuugggcagcucaguucacaagguaucuucaguuucuucauucugaaugagagaugaacuuuuacuuugagauuuagccaaguuugguauuugugaaggcagguauguggaguguuugucaguaugacugguuuuuaggaaacagguauaaaauaauauuuuugcaguaccaucaugugaugacuuuuguuggacaacuguguggucagcacaguuaguuccaggcugucaguaaagcauuggcagagaguggcugcugccucacaagguggccuaugacuuacagccccuugucuacuugcuacaguaguucuuagagucuucaaauaucauucagaagcuaaauugugcuuguucuauacuuauguacauaaaguuuucuuauuuguuuuacugucugacuugagaaauguugcauuguauucugacugucagguagucgauagcucagccucuggcacagaggacucuaggagcccagagucacaggggaagagucucuuagcacagaacuugccccaacaaagucccacugcuagaggcauacacuuugcugcagaagagaggccacagggcucuuacauggagccugcuuacuuuaacacaugguucuuaacaaauguuaucugguuuccccagcccacagcagaucccaagcaguagccuaggaugaaggaaggggcuguuaagauguggauacagcgauaccaguaagaaguaacuaauuucaggcugggcacgguggcucacuccuguaaucccagcacuuugggaggcugagguggguggaucacuugagguccggaguucaagaccagccuggccaacaugaugaaacccuaucucuauuaaaaauccaaaaagccaguuuugguggcaggugccuguaauuucagcuacucaggaggcugaggcaggagaauugcuugaaccuaggaggcagagguuacagugagccgagauguugccacuguacuccagccugggugacagagugagacuccaucaaaaagaagaagcugguugccaaggagaugucagauugcaaaaagcuguucuuuguguuacaacucaguaaggagccagcauaaccauauaaagagggaaguucauuuauucauucuacaguuguuuacugagcuucugcuagguaccagacauuggucuagguucuuggaauacaucagugaacaaaacagauauaaaaaaccccugcugucauggagcuugcauucuaauggggaggagagagacaaauuaaaaguauaauaagcaaucaaguuauuagaccaaacauauucaacauuauauaauauuagaaggugauaagaguuacugaaaaauuuaagaauacagcaggcuuggaguguuguuacuauuuuauuuuauuuuugagacagggucucacucugucacccagacuggagugcaguggcaagaacauggcuuacugcagccucagccuuccgggcucaagcaguccucccaccucagccuucuguguagcugggacuacaggugugcaccacaacaccuggcuaauauuuugauuuuuuuuuuuuuuuuuuuugagacggagucucgcucugucgcccaggcuggagugcaauggcucgaucucggcucacugcaagcuccgccucccggguucacaccauucaccugccuccgccucccgaguagcugggacuacaggcgcccgccaccacacccagcuaauuuuuuguauuuuuaguagagacugaguuucaccguguuaggcaggauggucucgaucuccugaccuugugauucccccgccuuggccucccaaaguguccagauuacaggugugagccaccgugcccaaccuauuuugaauuuuuaaagagacggggucucauuuuguugcccagacuugucuugaacucuugggggucaggggauccucugucucagccucccaaagugcagggauuacaggugugagccacugcaccuagccuguugcaauuuuaaauagguggccccagugggccucacugagaaagacacauaugagcaaaggucaaagaggugaagacaugagccagccuguccagagaaaggacaugcuggccugagggacagccagugcacagccgcaaaguggagggugcauggcacguuugaggucauguggucagaguggacugaggagggcugagcggaaggauaugaggucaaagaggcacuagaaaagggacgaggucaccuaaggguuuuauaggccauuguaaggacuugaguuuugaucuugggagaaguaaaaggcagaggaacuugauguccguauccccagagagcaggggaccaucucuggggucagaucacuaccugugugauuucugggaugucacaccucagugacaugcaaaggcaagcuggaguuccuuauugagacaaugaagacuuucauucuauauccagaaaauaaaggcuuacacaaccaaagauacuagauuuuccccugcuuuacuagcagggagagaaugaagaggcuagggggguauuuggcuuugauaauccaaccugaaggagguuuuucugaugggaaaaagaagucuaaaaguugggacuggagauacaugccaacugacucugagauuuccccauuucuuccugucagagccacagccagcccacacuguugccuuuugcaaaggaaaagccaccccuuccucuggguggaggcagccaccugccagggcccaggaacugguuuuagccccaacaugcaaacuucagccaagugccguaugcagggcacccccugcacuucuggacacggcagucucguggucaugaguggugaugccacuugaggguugugcuucucuuuggcuccuaaggcuuuacuuuuaaacaaagcuuuugauuuuaaaauugaucuuuuuauuuuuaaaaguuuuguugauagaaaucauuacaucacuguauacaguugaugggaggaggcuggucaguuguaaaaggauuuuaugguggaacaaaacaguccugccuucuagacacuuuaugcuuaccacuuguccugugguuauugucuaaugcaaacuacuauggaaaguuuuguuuuucuuucuuuucuuuuuucuuucuuucuuuuuuuuuuuuuuuuugagacggagucuuacucugucacccaggcuggaguguagugacgcgaucucggcucaccgcaaccgccuccucccggguucaagcgauucuccucccucagccuccugaguagcugggauuacaggcgugagccaccacacccagccuggaaaguuuuguuuuuuaaacugcagugcaguaugugucagauguuugaaauaugccuuacugauuaaaaaaaugauuaaaaugagaaauuacgcaguguaacuacaaaacaggaacugauugauagcaaacagcaaaauucagagcuguugcagaaauaagaagugacuucaggaaguucugagucuagaagagguuaaagguguugaaaugggaggaaguuuggugcuggaguaaaggucugggcagagugcugugggcacucugagaggagaauccugacuugugucugggagggaguguggaaggaaacagugcuugagcugagccuggcaggaugaguaggcagggaauugggggaaggcacccaugccagauaaacggccaagcagaggccuggagccucucccagaaacgccgucacaggggagugugaugagcucuccucauuuuugaguggccuucagagccauuuucuaugagccaugcaguaaaggaaccuuauugccauauaauugauuuuuuuuuuuuuuuuugagauacagucucuuucugucacccaggcuggagugcaguggugcaaucuuggcucacugcaaccuccaccucccggguucaagugauccuccugccuccugaguagcuagaauuacaggcgugcgccaccauaccuggcuaauuuuuuuguguguguguauuuuuaguagagauggcguuucaccauguuggucaggcuggucucaaauuucugaccuugugagccuccugccuuggccucccaaagugcugggauuacaggugugagccaccgugcccagcccauauaauugauuuuugacuaaaaauuguacuucauggcuuuauuuacccaaccugcuuauuagauauggcccacagugauuuuuggcugcuuguagaaaucaaauccacuccaagagggauaaagauccacugccaccacagaugauauuuugagcagggacaguguuuuuaagaucuguaccuuccuggaaggggcauuuggauguaugugauguuguaguuaugaaaaacuaggucacaguuacuuucuaaauuuauguuuuauacauaccauauuaaaaauaaaauacauuaaaaauccuacaaacauaggaaguuuugcuguuucuuagggacacagaugugagagagucccaaagcaaagggauguuacugguaacugcgggucugugauacuagcuuucuggugcagccucucucgccuguagcugguguucuggguguguguggguuuaguucucuuucuuguggcuuucugaggaugcugggacugucaugcauuuccuugucucuguucugagaagaaaaugacaaggaauuaaagucuacauugaguauagaaaagugacauuuuggauaucagaaaagugacaucuuggcugacagaaaaugaaagcucaccugucuuaggagacuaaggaaaaauacuaccaugauuuuucuguccaguaaaacaaaaauuuggggguguacaaguuaaaccuaaugauaauaaacaccucuugacggugacagucuccguaaugaucaaauaguuuuccaaacccuguccaugucaagugaucuuuaaggaaccaaccagauuccauauugaaguuuguuguaauuaaauucaaccugcaugauagugcucauuaaguuguguuuuuuucauugcagauguuggucaggcgucauuuaaauauuuucagucagcagaggaagcaaagcgugccauugaggcugugcugucagcggauccucggucuguguaccgccggaagcuuugccaggaccgccuuuucuacuuuacuguagacauagcgcaugucacuugcugguuuggugauggcuuugcagaggugcugaggaucaagccggcuucugagccuguucauaugacuggcccugugggguccuuggugucucuagggucuuaaggagccucccucaugucuuuaagguagcaucauugaucuuuggauguggcuuuuggauuuucugaacaagcuaauguugugucgagaagcaacacuuugugaucucauggcuuugauugauuugggcuguucaaaauguuuauuugaaaaacguauacauuaauaaacuuaacaaagagauauaaaauacagagaaaucaccaaaugcuuuuugaucuguugauauuaaagaaucaaaaggugaugcugucucgauaauuucugaaagaagcuguucuuggugcacuugauaaaauuagacaaaguucauuccagcagagacuuucuaguugaggggaucuauucaguaauucauauugguuuuccugucugucuggaaaagccugaccuuucuauuugauuccaaaucaaaccuauaucaggaaacuaacaaauaaaaaacaaguagagauaguuuuugagauuaaacuuauguguuucagagacuuugugacauagucacacacacauauauauauguauauauauuuaauacugauucuaaaauagagacucucugagauuucuuuggaugucuuuguaucagaaaaggaaaucacccucagaaguucaagaaaauuguuacuguuuuuuuguuuuuguuuuuguuuugagauggagucuugcucuuucgcccaggcuggagugcaguggcgugaucucggcucacugcaaucucugccucccagguucgagcaauucuccugccucagccuccugaguagcugggauuacaggcgugcgccaccaugccuggcuaauuuuuguauuuuuaguagagaccauguuggucaggcuggucucgaauuccugaccucgugauccacccaccucagccucccaaagugcugggauuacgggugugagccaccgugccuggccuauaauuacuguuuuuuaauauacucacuuugcaacuauuuauugagaaccuauggguuagguuuuggugauaaaauaagaugacaagauguaguucuuguugcaaucaugguuaauggaagaaguaagacauaaauaaauuauuguauuauaguuuuagaaauacaguaauuauacauggauccucuguaguaccacauaggaaacaguuguaagaauguauugccuauaggugauuuuaaugaugugcucccagauaacugaggauuuaugaucaacauaaccaaauuagacaccugucaacaugauacaugcuuuccuaaucaugauuguaaaucuuaauagcugaucgaaaugagcugauugaaauagucuugaauaguuuugaaaugaguucugcugccuguggauacuugugcagagucauuuguggcugaugacacuguacuccuaaaccaaacugauuuguaauugccuuugauguuacuuagaacuucuuggggagguaucuuuaauuugauuuuugguuuuugauuuuuuuuuuagagaugagucucaugcuuuugcccaggcuggagugcaguagccugaucauagcucacugcagccuuaaccucccaggcucaagggauccucccaccucaccuuccugaguagcugggucuacaggcucaugccaccaugccccacuauuuuuaaauuuuuuuguagagacaagggucucgccucauugcccaggcuggucuugaacuccugguaccaagcaacccucccuccucagccucccaaagugcugggauuacaggcaugagccacugugccugggcuaauuugauuuuuuaaagcuuuuuauuuugaaauaaucagagguucacaggaaauugcagaaauaguagagguccuguguacccuucacccagcuuuucauuuaacuucuuccagugguugguuccaucuuacauaacuauaguaaacguuaaagguaggaaguugacacugguagagccuacacuuuaguuugauuuuguuguuuuuucuuuugaaaaguuauuuugaagcuucaucagggcuugaagcacaaaauguuuuguuuaauauguuaacaaugacucugggggaugguaaccaacggccuuauaacaagaggacuauuaaauuguuugggguuuuauuauacagucucaggauuuuagagcuaagaaggauuuuaggcugggcgcaguggcucaugccuguaaucccagcacucugggaggcggaggcggguggaucauuugacgucaggaguucgugaucagccuggccaacauggugaaacccuaccucuacuuaaaauacaaaaauuagcugggugguaauggcgcaugccuguaaucccagcuacucgggaggcuaaggcaggagaaucgcuugaaccugggaggcagagguugcagugagccgagaucgugccacugcacuccagccugggcgacagagugagacccugucucaaaaaaaacccacaaaaauaauaaaaaggauguuaaauauaaucuggcucaguuuucugccaguuccugagucucuucaauguucccacuaucuggccuuuccaggcccugccuaaaugagguauauaccccugaccugugcagcuuauucuuuaugggcagugcucauuauuaaaacauucuuccugaacgugagauccacucuguccuccgacagcucugcccacuagagaggccacacaggcugguugcccucccaaguuagccugucauaccaccccuuggucuucccuaggcugagcacccccguuuucuucagcuguuucucauaacaugaucucaagccucuucugaaccccaggcuuucuugagucuccauaugagcauuugccucugugggcacaacuucaaguguccuuugugaggaaaugugcaucucugguuggugaacuuccaucccucagagagaaauagaagcacaaauuugaaacaagcugucugucugucuguuucuuuaugucuuggaaacuuuauuuauccauccaagcuuuuuuuuuuuuuagccuuugagagcaggcaaccauccaagcucauuccacgaacccagagaauuaaauauaccugauuuguagcacaaaauaaauaaaugauaaaaguucccucaaaccuuccaucaagugguuuuaaaacugucauugauuuuauguccggaauugaaguuguuuuggugcgugcauguacacacacgcauguacacacacacacaaauacacacuaauccuaaaaaugagauggaaaugagcuacaagaaaacucaaaagugccauaauuaugacugucaaaaauaguguuacagcucuagggucguuuuguguccuauuuguaucaaaaucacauuugguccuuuauuaagugggaggugaguacaucaagaggaagagguugcuugauucuugguccuuuagauuuuuaagacucuuuggccagaguuuuggaaaagggauugugucaacaagcaaaguugugguuucaggacugccuuagaaacuuuuucaagagaagaaacaauucucuacuaggcguaaauggcacccaccuuaauuuuuagccuuugcuuuuuggugccuguagggggagcccuugauagcagauuuuauucccauuucacuggcuuggaggaaaacaccaggaguucaagcuguuuagguaauuuuggcguuuggcccaccugccccagcuuuaaagaacaguaacuuguacaagcaaugcugacugaugauugucagucacaugugagaagagauuagaaagaugaguggcauuuauuaauuuuuucuuaaauuguaagcuuggcuucaggggugggauugauuauuccagcauguggaucugugcacaaccaggugacucauuaagcccaugagcacacacggacaaggcauugacuuuguuucuguguuugugacuuuuuuucuuggagagaagaaaaugaaguugacgugaaucaaccucuuguugguaggguuuuuaaaaugcuacagucccagagaaagcaagagaagacucaauaaaaaugaaagccugcaucacuuacugaacuuuuaucauguccuuggaacuggacuaugugcuuuucguacauuggguggagguugaguaacgugcucaagcugcucggcugcacagcuaggauuccaacccaccagucuggccugaguccucuuccuucucagccuggcucuacgccuuagcaaaucaugcugguuuauuggaaggucagcaguuccauaugauucagcacaugagucuuuggcagaaugaaguccauggaaauccaaccacucgugaagaaugcacaggggaauaagggcagaaacgcccauucccacaggaucugcauggaaccuccugggaagcaagaugggaaauacgaagagcacugggcuuggccucagaaacuucaagcgcuuucugcccugccaugggcuagcucgugaccucaggcaagucacugcacccugccucuagcucugugaccuuacagaguuguugccaggauaaugcuugggaaagugucuucugaacucuucaaugaccuauaaaccuagguaauauuuuuauuguguuucucuucauugauagccuuuuucuaccacucuguucuggcuuaccuggcuagauaagcagacuucagggggaucuagggggucccuaaaauucaauguaugaauggcuucuguuuuuguuguuuuguuuuguuuuuugaggcagucuugcucuauugcccaggcuggaguguaguggugcaaucacggcucacugcagccuugaccucccaggcucaagugauccuccugccucagccuccugaguaacuguuugccaccaugcccagcuaauuauuuuuucuuucuuucuuuuuuuuggagacagagucucucucuguuacccaggcuggcgugcaguggcucagucauagcucacuacaacuucugccccugggcucaaacuaucuuuucaccucagccucuugaguaguggggcuacaggcgcacgccaccaugcccagcuaguuuuuguaguuuuuguauuuuuuguagagacaggguuuugccauguugcccaggcugguaccgaacuccuggccucaaguggucugccugccucggccuccuaaagugcugggauuacaggcgugagccaccgugccuggccugucuuuuuaauuauagaaauauuuuuuuaggcugggcucaagaggcugaggugggaggaucauuugaccuugggagauggagguugcagugagcugagauugugccacugcacuccagccugggugacagagccagauucugucucaaaauaaauaaauaaauaaauaaauacguacauaaaaauuaaaaugacuauuuuuaccaagcaauaugauguuuugcuaagggaaguaucacaaagugcuccucccuaaaggauucaguuaccccacaaaacaucuucccccucucaucuggguuucuuuucugggguuacacgugcaguaccgugaaccaccuucacugcccgggcaggcagucaccagcucacggguuuuuuuuaguacgcuuucucuucuacuuucuuuccuaauccuagcccugguauugcaggaaaaucucugcauuucauuuaugagaaaauaggccgggugcgguggcucaugccuguaaucccagcacuuugggaggccgaggcgggcggaucacgaggucgggagaucgagaccauccuggcuaacguggugaaaccccgucucuacuaaaaauaaaaaaauuagccggguguggugacaggcgccuguagucccagcuacuugggaggcugaggcaggagaauggcgugaaccugggaggcggagcuugcagugagccgagauggcaccacugcacuccagccuggcugacagagcgagucuccaucuaaaaaaaaaaaaaaaaaaaaguauauauauauaugaaaaugcaauuauaaucauggugugagguuauugaagcaagcccuaccuccgugauggagaaggggcaagucauaaguuuuaaagcucaauuaaauauauaauagggauguuuauauuguaaaaaauaaguuuccugguggggcacggcagcucaugcuuguaauccuagcacuuugggcugcugaggguggcagaucguuugaggccaggaguuugggaacagucuggguaacgugaaaagcccgucucuaaaacaaaauuuuuuuugguauacaaguauauauacaaauguauauauauaugaacacaaaauuaaaaaacgggguguaguggcucaugccuguggucccagcuacucagugggguggggggcugagguaggaggaucaccugagcccaggaagucaaggcuacagugagccgagaucauggcacagcacuucagccugggcgacaaagacccuaucucagacaaaaacaaaaaauugaguuuccugaucuagguaagucauaaaaugacucuccagcauuuacccuauucuuauccuuucugcuccuucucugccuuuguagguuccagcagaugcaauucacagaagguucaagguuuaggccagugcacguggcugugaacagcaaauggaggaagagccuuuucaaugcccgcagugcaaaaacucagugauauacucucuguuuuucaguggaggggggcacuuggcauaugagcuuacaccacaagaaucacauuuguguuaauguguguuuauguuguguugacaaaaaguguaggaagccaagcgugcuggugugugccuauggucccaguuacucaggaggcugaggcagaaggauugcuugagcccaggaguucaaggcugcaaggaguucaaagcuaugaucaugccacuguccuccagucugggcaacagagcaagaccccacaucuaaaaaaaauuuaaaaaaaauuuuuuaaaguaggauuagcaguaauacaauguuaucuucugccucguagauagcuugaaaauucugagauucuuugcuaauauaucuaacucuucauccaauucaagauauaaaaaacauuuuuaaauuccauguuaacuuuuguuuuaaaaaguuauccacgugcuaaacacugaaaaacuacauaauucuucauauuaguauagacuuuacaaugcaauuuaaaauauauuaucuuauuuggcaucucaguaauauuauggauuaauugugcuucugggagcuaagcugugggccuaaccaccacuuagaagaggggucagcaaaugauaguccaaaggccaaaucuggcccacagccuguuuuggcacuaccugagaucuaagauuggucuuuacauuuuuaaaggauuguaaacaaaacaaaacaaaacaaaaaacccagagaagaagacaugacagagauugguggguaaagcugaacauacucacaaucuggcccuuuacagaaaaaccccugaucccacuccuugauuuagaacauuauuucucugaaacucguugugaguuccagaaagguuauuuacagaaagguuauauugaguuccagaaagguuauuacauacagaaagguuacauuuuugggauaucacaugcuucuaagucagagacuguuuuuauuuuuaaaggauuuauuuagccaugugagaaaauguaugaa

SEQ ID NO: 13957 - RNA, 6215 nt, Homo sapiens
caaggucacacaguucagugguggcgaaaacaccaauccccagacuucagagccaggcauccuuuccucuauuucauggaggaucuauggaagcaaaauacaucugaaacauuccagucuucuugaauuucauuuauugggugaaguaaacaagguguuuguaaaagaucuaugcagugacagccccaucaggccucagccauguuaaugugaccgccuccaccuuucugagucaaagagggauagugguuuagcuuucagcugguguccugacaccauggugauccugccuuccgaucuuucuuccccaguugcugcagauguucuaccggcaacaggaggagauccgaaggcuccgggagcuguugacccagcgagagguccaggccaaacaguuggaacuggagaucaaaaacuugcggaugggcucagagcagcucugagcagagaccucugcccuccucacccucagggacaccacucggcuccauggggagguuuagaaccaaaccacaaguccccucaaggacaaccacuauuucuauauuuuuuaccagaaaacaaaacucuccaucgcugaaagagauuccagugggacauggugccguuuuucuguuugccuucuugcaacaacaguuucugaauugacuuuguuuucagaugaugccuucuguugaauucuguuauuaagggcccaugaugagcuguaacuucucaagaggaaagaacacaguagaaaacuagagcuggaaggaucuagguugaccugucugugauuuucaaacugugguccagagaauaggggaagacugggccagacgcaguggcucaugccuguaaucccagcacucugggaggcugaggugggcggauugcuugaggucgggaguuugaaaccagucucaccaggcgcaguggcucacgccuguaauuccagcauguugggaggccgaggcugguggaucacgaggucagcaguucgagaccagccugaccaacauggugaaaccccaucucuacuaaaaauacaaaaaaauuagcugggcgugguggcaggcgccuguaauuccagcgacuugggaggcugaggcaggagaauugcuugaaaccggaaggcggggguugcagugagcugagauugugccacugcacucuaaccugggcaauaagagcaaaagucugucucaaaaaaaaaaaaaaaagaaagaaaccagccuggccaacauggugaaaccccgucucuacuaaaaauacaaaaauuaggcagggcguggugguucacgccuauaaucccagaacuuugggaggccaagcugggcggaucuucugaggucaggaguucaagaccagccuggccaacauggugaaaccccgucuccacuaaaaauaaaaaauuaaccaggcaugguggugcaugccuguaaucccagcuauuugggaggcugaggcaggagaaucgcuugagccugggaggcggagguugcagugaaccaagaucaugccacuucacuccagccugggugacagagugagacuccgucucaaaaaaaaaaaguuggccagccgugguggugagcgucuguagucccugcuauucgggaggcugagauaggagaauugcuugaaccugggagguggagguugcuaugagccacgauugcggacugcacugcagccugggugacagagcgagacuccaucuccaaaaaaaaaaaaaaaaagagagagagaauaggggaagacuaagcaggaaggcugugucucccuuccccacacuguauuccaaccagacagcucccuucuauuuuauauguugggcuaguaugaaaaacaauucugcuaggaaaaaaaaauuuuuuuagaaguuugaaagcuagugauuugacccaaguuccucauuuuacagcuggggaaacuaaggccuagagagaggcaagugauauuuguuucauggcagggcugggcugagauccugcuuuucugggucugucuuuuugcucuuuugggucugaugcaguucucagcccaaagaguagaaaucuguugcuucuggccucagcugugccccagcuuacucagugaccucuugcaaguccugcccucucuggucucaguuucuucaucugaaccagggguacccuggaacaagcugcucucugcaggaucugccaccugaaaccuugaccuaagagaaaacuaccuguggggugaucuggguuugcuacagaaacuaacggacacuggcaaggggucagaggcauucaacccaauucuacaacacaggcagguggucaaaaccaaccuuuccaaccagaaucagccugauauggauagaugcugucccuuauggagggacgcagacuucagaacugugcccaugacugcugacugccaccaccaaggcccucagguacacagccugccuccugcaggaugaugugggcagauuucagcccuaguuaacagaagagucccccaggagguagggggcccccaucacuggagacaugccagcagagccucuggccaccuaaccaggaggucuucugaaaugacuauacgagguaaagaaguaguaccagauggucccaaaguucccuuuuagccugaaagcuuuucuuugucccuccuuagugaaucuguguuccgagcccuacucuaaaguucaguggucaauacaauaguccaccaagagacugggaaugauuagaagugaaauuggucccuccuuaccaaggaggggcagaugaucuccauugcacagggcgauuagauucuggagcugagguggggacugcaggaggccaccuagucugguagguuucaacccaagcuguguacauuagaauucccuugggagcgugcaggaaauacagaugcccaugccacauuccagaccaacugaagcugaaucuccagaguagggccuguauggucauauaagcuccacaggugaucugcaguacagugaagauggaagacugcauguguaccuauuugcaauaaagaugaagaggacagcaagcuccagacaggagcugggacucaacccagaucucuuaaguccugccugguggcuccuuaaaaguccagaaguguugccccaagcccucccucaacaucucugggaaccgcagcugcagcacgauggggguucagugccccuguuugccccuuacccagcugugguuuauucugcuuguaugucugcacaggccggaugcucguguuccuugucuuauucuccauuuacucagucacuggggcucacucccgucugaugcacuagccaagauugccuuagugugcuccagaaaagaaggccaaaucccaggcauugucagggcagcagagcucuacaggauaggcuuaccuuucccaccuguguggcuagcacuucacaguuuacaaauuccucccaccuccacucagugacacaugcuguucuaacacaggucaggcaggcauuacaguccccauguucagaaucaaagaccuagccucagagaagugaagaaacaucaugccaaggucauugacugccaagcgguagaggugggguugcauccagagagcuucccgguaugccucugcacaaugccauuccuuggccagcucccuccaccccaagggacccagacugcacacuuaacaaacaggacacaggugucuuugaacaaacuuuuuuguauuauuauuuuuacaucuagaauaaauuauuuaaauuauuucacagcaagggagagggauagguaauuuuuaucagauauuuuuuuaaaccaucuguuuuuuaaauuacauuuuuguuuauguucuugagcugauguaguggaacuugccuagcacauucaggucccagccaguuggcagagcaugcucucaucuccuuauuccauacccugggcguccccuuucuguugacucaggaacuuucugagaaugaggacagcacuaggagaugagcuuuggcagguauccaccuuaacgcuacaauaauugugcuuccugaaacaaaacuugagauuguaucauagaaggaaacaggaagucagaaaucaaaucuaugcuuuuaauugaaaccgugccugaaacaguuugaaugauuguuuuaauguuguuucugaaauuccuuguaccuuugugaaaaauaaugauaauaaauaaaagugaaaauaaauagauguggaauaugcaauggaaauaauguaacaaaauaauaaacaucuggccauuuuacuacaaggagcuuuccuuuucuugauuuguuccacaaauaccaauuaacuaucuacucuuggagucagacaccaagcuggaaaacaggcagaacagacagucuuugcccucuccaguuuucagucauggcugcgggaauggggagggccaggauagggaaagcauaggcuguucuggaaggagaaggagggaaggcuuccuggaggaaaagauaguaagguagaaaccugcagaguaaguuggaauacucagggcaaagggcauuugggaagaagaauguuccaagcaggguaaacugcacgucccccagucuugaaaaagcacaggguggagcauaggcagggcggagaccaaggaucuuaagaaagagcugagggcuuuauaaguggaagucuagacuugagccugggggggcaacuggaauuuggggugguggugugugugugaaaguugucaguaccaaaacagagucacuuacaucaaaaccaaacuaaauggugcuccuguagucccagcuacuccagagaugaggugggaagaucacuugagcccaggaguuagaggcugcagugagcuaugaucgcacuauugcacuccagccugggcaacagagcgagauccugucucaaacaaacuaaauggugcugggaggccaugaaguggggggcccucaucaacgauuugccugguaacaggaacuauuauugcaaaagauuccaccaaacugcaaccuugcacaaagaaccacaaccuugcacaaaagccaugauaugaggacaucugcccagcaacugccuguucaacuuuuggacugaagccaccuguauuaauucuuguaaccaaguauuauuauuuuaaaacgaucuggccgggcgcgguggaucacgccuguaaucccagcacuuugggaggccgaggcgggcagaucacggggucaggagaucgagaccauccuggcuaaaacagugaaaccccuuuucuacuaaaaauacaaaaaauuagccgggcgugguggcgggcgccuguaguuccagcuacucgggaggcugaagcaggagaauggcgugaacccgggaggcggagcuugcagugagcagagauggcgccacugcacuccagccugggcgacagaccgagacuccgucuccaaaaaaaaaaaaaaaaaaaaaaaacaaaaacaaacaaacaaacaaaaaaaacaguauaugcaauccuccucguuuugccuuuaaaagccucugcuuuccuuugccucccugaguacuccgcguccccaccccuugggugccauggcacauuuauucccgaauugcaauccuucugcucaguccgaaauaaacucaauuggagaaucucuguguccuuauuugagguugaugaagguaucuuacaguugugggaaugauuaucuuuccggggaaaagggcaagagaggaucaagggaaagugagaggagcacccccggaaggucacagccaacuuuggucccaucaucagggcugcaguuuucugggcguuacuggaacagcgucauuaagcaggaagcccacccucuccuagcuggcucauuaggagcuucccauuucuggugggaccaccucccggccugggcgggcagagggagcacccugcuggucggaggaugcuccgaggcccgacgcugcucccggcgggcugucauccuccuaggggucggccggccggccuggagccgccccgcccacggccgagguuucgguuucccuugggagccccgcccugugucccggggagccggaggagguggagaugaauggcgggcgcggcgaccgggagccggaccccugggaggucggagcuugucgagggaugcggcuggcgcugcccggagcauggcgaccgcguggcugagcucuucugucgccgcugccgccgcugcgugugcgcgcuuugcccggugcugggcgcgcaccguggccacccugugggccuggcgcugg

SEQ ID NO: 13958 - RNA, 798 nt, Homo sapiens
gugcgcgccccgagacccgccccggggagccaggagcgcggucggggucgugggggcggaaaaggguggccagggcggacccgcggggcgggcaaaagggcggaccuugggccaggcccccgccccgcccuccggccccgcccgccgggcugcagggggaggcggcggcggcucugggcgccgggagucggcgggcggcgaggagcgcggagccggagcuggacgccgccgccgccaccgccaccugcgcggcagucaucaagguagggcggcccugcgccgccggccgugccuucccggucugcgcgaugggggcgucgggcgggacgugcgcgcugcggcugcagcucccggagagggagggaugcggggcucggagcgcgggggaccuggcuuucagccccuuugcgugaccuugcacaaagcacugcuccucuccaggccucaguuuccccgucaggauagcuugcucauugguggcccccuucucgcgggguuguugggaggggccgccucgagguccgggcucccgacggcucgcugcccucaugagcacugucugcaccgcccaccccuccugcccgcggugagggaagcucacucugggcgcggccagccggucccgacaggccccugcuguggcccgggugcuccaugggacucuugucgggacccucccccucuuggcugcguuaccugcugggccucagcuuccugguacaggaaacggugggguggggggcauccccggguccccgccaagccggccugggcgugcauguggggcaucagccggcc

SEQ ID NO: 13959 - RNA, 18681 nt, Homo sapiens
caguggccagcugggagcuacgagcgcggagcuugcgcagaagacccccaucagggugcggggugcaguugcggcuccagggccauggcggaggagcagggccgggaacgggacucgguucccaagccgucggugcuguuccuccacccagaccugggcgugggcggcgcugagcggcugguguuggacgcggcgcuggcgcugcaggcgcgcggguguagcgugaagaucuggacagcgcacuacgacccgggccacuguuucgccgagagccgcgagcuaccggugcgcugugccggggacuggcugccgcgaggccugggcuggggcggccgcggcgccgccgucugcgccuacgugcgcaugguuuuccuggcgcucuacgugcuguuccucgccgacgaggaguucgacgugguagugugcgaccaggugaggcggccgcggggccggcugcgcgagugcggaccucgccguggagggcggccgcgggcaugaccccugagagaagaccuucccugucugcgguucgcaaagaucggaacugacauggagaagucaggguugugagcgagccugugguucucuaacuuuagugugggcccauuuaaaguugcagauugcugggguuccauccuccaggaaguuuucauccaggugcccugagguggggcccagacaucugcauuuuaacugggucauagggugauuccgagguagauagucuuuggggcucugagaaacgcugguauuagaagucagcuucagucaccuuuuacuaaugaguaacucgcguguugucuucccgcuuaccuguuauuuuuguugacucuccuuucaggccauuugcaucccacuguccuuguguucggagccaggccacaccguccucagcagugucauguguuaaaaacgccaagcugaauauaucaugccccuauuaaaacuuguacauggcuccccauugguuuuuggagaaaaguucaagcuuuuuaccuugguaaauaauguccaccuggaucugcccuguagcuauucuugacucuuuccuucgugcauuuuuccccauccuaaaaaagaugacuuuaaaaaguaacauuuacucgauuaaaaauuuaguaguauagaaggauguaaccuaaaagccccguccuauucuacucccugaagauagccaccguuaaguuucucuuguauuuuuucagaaguuguggugacaccagccugugucuuuucauagguauaucuauaucuucuuauugguacauaauugguauuaugacauaccuacuauuaggcaucuuuuucagcaaaaauuuauuuauuuauuuauuuauuuugaaacggagucuugcucugucucccaggcuggagugcaguggcgcgaucucggcucacugcaaccuccgccuccagaguagcugggaguacaggugcgcgccccacgcccggcuaauuuuuucuauuuuuaguagagaugggguuucaccauguuggccaggcuggucucgaacuccugaccucgcgauccgcccaccucggccucccaaagugcugggauuacaggcaugagccacugcgcccagccgggacauucuuauguaucaauauuagagauucacuucauucuucauaguggccagaaaauccacuuuuguuuaagugugucauaauuaaacauucuccuuaaaggacacuaauguugugacuaguuuuuugugaauagaucaguguuguaaugaacauccuuuuacuucuuuuuuuuaaaauauuuuuguacuucugcaaauaugucguuugaggaaauuccuaaaguuggugggucuaagaguuguucauuuuaaauaucaauagcuacugccaaguuugccuaccaaggaggcugugucacuuuacucccccacaauguaugauagagccucuuacuccaugcuuuuguccgccuuggauauuaaccauuuuaaacuuugccaaacugauaggugcagauggcaucacauuuguauuuguguuucuuuaauuaugacuccugaguuacuuuugaucauccuugcuugcauggaagcuuucuuuuuaaguaacguggacauuuaccaaacauccugcaugugucaguagacaugaggcagcugagacuauaguggguagaggaaaaauuauuggcuuggaaauaggcaucuuggauucaaguuccguaucuacugcuuuaauuaaguggcuuugaauaaauugcacauuaucccuaaaguuaccuucuucagguuuuaaguuagcugagacuaaaaugacuuguaaagauuacccaacaagaaagucuguaguaaugccagcauguaguucaugcucaaugaugacuagcuuuaauauuuauugagcacauacugugugcuaaacuccauguguuuugcauauaucagugcauuuaauaaucacaaaaaguauauggguuuuuugaacuauaauuugucaccauguuacagaagaggaaacuaaggcccagagugggauaaauuacuugaucguggccaguuaguagagcugagauucaaacccuggcagucuugaaucuagagcuugugcucuaaacuacuauaguucauucauucaguuccuuagaaggagaaagauccuagagcggcacuguucaguaugguagccacuagccacauguggcuguugagcacuugaaauguggcuagucuaaacugagaugugcuaaaguuaaaauacaaaccgauuuugaagauguaaugugaaauauauguauauauaaaguaucucauuaauacuguuuaguauugguuacauuuugaaaugauaauguuuucgguaaauaauauguuaaaauuaauuucacccuuaaaaacauuuuuaauauuacuagauuucuauuagacagcacuauacaagaggaaaucacuggacuugaagcuuuaaauguuuagcacacaucuagcaaacgucuguagccuucuguacaccaggcauaugguacugggugagagucuuggggaauaaaacagaaucagacauugcccaugaggagcccacagacuagccagacggggugggugucuguguuuuugguuugguugaaguugaguugaccacuuuauccgcuguugauuuuugcuuuggcuaggugucugccuguaucccaguguucaggcuggcuagacggcggaagaagauccuauuuuacugucacuucccagaucugcuucucaccaagagagauucuuuucuuaaacgacuauacagggccccaauugacuggauagaggaauacaccacaggcauggcagacugcaucuuagucaacagccaguucacagcugcuguuuuuaaggaaacauucaagucccugucucacauagacccugauguccucuauccaucucuaaaugucaccagcuuugacucaguuguuccugaaaagcuggaugaccuaguccccaaggggaaaaaauuccugcugcucuccaucaacagauacgaaaggaagaaaaaucugacuuuggcacuggaagcccuaguacagcugcguggaagauugacaucccaagauugggagaggguucaucugaucguggcaggugguuaugacgagagaguccuggagaauguggaacauuaucaggaauugaagaaaaugguccaacaguccgaccuuggccaguaugugaccuucuugaggucuuucucagacaaacagaaaaucucccuccuccacagcugcacgugugugcuuuacacaccaagcaaugagcacuuuggcauugucccucuggaagccauguacaugcagugcccagucauugcuguuaauucggguggacccuuggaguccauugaccacagugucacaggguuucugugugagccugacccggugcacuucucagaagcaauagaaaaguucauccgugaaccuuccuuaaaagccaccaugggccuggcuggaagagccagagugaaggaaaaauuuuccccugaagcauuuacagaacagcucuaccgauauguuaccaaacugcugguauaaucagauuguuuuuaagaucuccauuaaugucauuuuuauggauuguagacccaguuuugaaaccaaaaaagaaaccuagaaucuaaugcagaagagaucuuuuaaaaaauaaacuugagucuugaaugugagccacuuuccuauauaccacaccucccuguccacuuuucagaaaaaccaugucuuuuaugcuauaaucauuccaaauuuugccaguguuaaguuacaaauguggugucauuccauguucagcagaguauuuuaauuauauuuucucgggauuauugcucuucugucuauaaauuuugaaugauacugugccuuaauugguuuucauaguuuaaguguguaucauuaucaaaguugauuaauuuggcuucauaguauaaugagagcagggcuauuguaguucccagauucaauccaccgaaguguucacugucaucuguuagggaauuuuuguuuguccugucuuugccuggauccauagcgagagugcucuguauuuuuuuuaagauaauuuguauuuuugcacacugagauauaauaaaagguguuuaucauaaaaaagaaacaguauuagauuuuggucuccauaaucuauuuugguauuguuacgaacauggauaugacaaccaaacuggaaaucagaacacuaggguaaaguggauauugaaaugaagcaagaauauugucacacauguguugugcaucuuguuuaggguauauuucuuaaugucaucuaggucauuaguuuuguuaauauuuguguugucuugaccaagcuccuacuaaguauaggacacaaauguuuuuuaucuuccaaggccuggcucaaaugccacugcugcaaagcuuucuuugacccucuggccaccucccaagccagaaguuaucuucccccuccauguacucuagccuuuucaugacacugauauuuucgugacacugacuuauaguucacuguuuaccuguuggucuaacagcaaaucauaaacaguaguuuucaacauacuucuaaggcuaaauucauuuccagaaguagcaaagcuuacuagccaaaggcuccacauuuaucaacucuuaagagcuagacuugagagccuaacagccuauaugauuuuguguaaauugaucucuauaccucagcuucuucaucugcaaagugagauaauuguacuauucuacuuuccucauagugcgguuauaacagauuaugauaauauuacaaaguacuuaauacuuggcauauaguauauauauuagcuauuaguauuuugcaauuuggggauauugaaaauuagaaauugcauguuaguucaugcugcacuaccauauuguucuuuuggggcucuucaaugggugaaauuccauuuuacaguuuaucaugugcaucuguaucacaggaguauuuuggcaaaaugauucuguaccaaaaaggaguacuauaaaaugagggugccaaauauauugagucuuuuaugggauuaaaaguucuguugcauuccauuuucuuuggcauugugaaagcuuaccauguaguacagaagguaugauuugguucauguguuucugagaaaugcagccuuuccaggaagccugguggcucuuaccauggaguuuagcacagauagacuuggccacacugugaccuacaacauggugcuuaccuuacuaagcagcacuaaacauuugcauauuugaccauuuuuaugcaaauccuuucaaauggacuacauggguucauggacccugauuuuagcuucacuucauuguccuaagccggagugagugacaauaagauuucacaggucugggagggauggaguccugccugccaugagcuuccagcuucugaccauuaguuccugguuccuggacccuagaauggaacuuugcccuuaagaaguguucacaccuuccaaaacuaagcugaaguuagggaaaguagaagcaugaaacauugaaggugaauuguuggggccuuauccauaguaauucugguaauuacuuugugcagggcaggaaaggagauacauacauagcagaugcuuaauccucaacaauucacugagauguagguauucuucccuuuuagaugaauguaguuaagcaaguugccugcgucccauggccuugaagaauggacagaaucucaaggcccucugauuccaaaguccaaccacuuuacuauucuucagucugcccucacccuaaccaaauucuuuguguaauguuuuuucaguacaacucccucugcagcacugcaguuguaguuguacaggucuuuggguuuagaaagacuuugcuguuuacuguccauuugccucuucccaucagucuuccgaggugaguaugauuaucccccaucuuacacacaagcucagagaggugaaagacuugccugaaggcacacaauugaaaaguaacugagccagcauuuggcccuuaguuaccugagccauccgggacuuugcgcauaccagaauuucucagucuccuccucuuugauaugcguaaauaucauuuguccuucauacauacacacauaaaaacacgaugggccaauagaagagggaguaucauguccauaaagagacccacucagcuaagggggaguaguagugcaguucuuugauccaaugacaaaugucuacugaacacguauuuggacagccuuuagagcuuuugcagagcucauuagagauugucucguuugcucuucacagcauccuuucagguaauuauaggcauuuuuagagauugaaagucugaggcuuacagcuaggaagcaguggagcuacaauucaaacccagguauguccaacuugagguuaacaguucuuuuaguuguacuacaguugccucuucagcaaaugcuucaugaccagccugaccaaaauggagaaaccccgucucuacuaaaaauacaaaaaaaauagugggaugugguggugcaugccuguaaucccagcuacuugggaggcugaggcaggagaaucgcuugaaccugggaggcggagguugcggugagcugagaucgcaccauugcacucuagccugggcaacaagaacaaaacuccaucucaaaaaaaagaguaaaaacagcaccagagcacuucacugcuccacucugcucacuccaucuuuaaucauaacaaucagcccuucucuguccaccuuugccagggucacuaaucauccugugaucuccuuccuuugcauuuccaccucccagaaucaaagccagucaaaucugacugggaccccagaggccaccuaaccuaauuugguauugcacagaugggaagacaagcccagaaagaggaagggaccugucugaauucacacagagggacaguugcagcccuccucuacuucuaucaaaaaccacuuauauucuaucacuuccuuugaaccccuuacuccauuccuaaccuuaacccucucgaacucuguccccaauagccugagaaggugucacccuccagacaccagugcucucaugccugucagcuaaggggagaggagucuucccaaugacccacuuucuaaacuguccuugauaaagcaucagcucuugggagguaggggaagggagaauuuuaccauccugaccccugagccaaggggcugcuggagccagcagcucuguuuaugccaagaggacuggaguuuugguguugguaucacaaugagaguguccaggccagaaauuuuuuguuuaugguuucugauauuuccuaaguuagauuuuuuuuccucagaaaagagaaauuugagcaaugaacuauaaaauagucuuguuggucauuuaugucuacuaaguuuucaacauaguagacauuuguguuuccaacuaaugcccuguuugagauauauaguuuguucuuuauaauccuuauuauuauauacugagauuacuccagcuuuuuucuacuauaagcaguccagaggaaaaacaacugacuuuaaauucuaaaagcaaauauuuaaaguuuuaaaaggcaaauuugaaaagcaaaaaugaaaaaucuaaagaaaaagacaugaaaagauugcaaaacugcuuaggguacacgaaaaaaaaaaagcaauuaucaaaaaaaaucacuggcgauguuuauuuucaaaccaaaugaucauguuaaccagcuugcuuucagccaaauuguaugcuuccuuugcguuagagaaccuggaaaccuaacuuaacacuucaauucaauagaguaauacaugaucauauguuagguuauaugggcaaauauuuaaaaauuuuaacccaacccuagcuuaggcagaaagggaagauuuuuaggaagcuacugggauagauuggguaauucaaggaaaguuacagaauugaaucaagagaaguacagggauguagcuaggcuagauguucaaaugaaaccaggaauucaagugccaccagaacaccauuucuuuauaugauacuucauugucuuucgguauagacuaacuucucuuuuguagcaggaaacaugcuaccagugaagccaagcccuccaccuuaauacuucuacuaccaaagaggaacuggcucucuuuugcagaguuugaaaaaauaacagagaaggguuaagauggaccuuuccugguucaggugcccuuaaaucagugaagcaagguugagaggcaagguacuauggguugccagauucaggucagcaaucuaaucuugaacccaucaauuguggccaagaucuaggaucauacagcagcagaaaucauaucgcugggagaagggaacagaguguauauugaggaagaaauuggaagcuguucccagaagaaagugagauaaaguaagagaucccuuaaaaacuuauaccuaguuggugguaugagucaucagagaaaggcauaagccaacuagaauaguuccuaaaugcaguuuuaaucuuguuugcaauuauuuugaagggguaagaccaucuggaugaguccuaaucauccaagagaaaauauauuauuauuuaauagaaacuuggucagcugaggcagcuuagggacauaagccugggaaaaagagaccuaggggaaggcuucaaaauggcugacuagaggcauuugaauagagcauccaagagaacacuagaauucaacagagaagugacaggaaacaguugaggcauggaaggagagggaaauuaggcaacuggcucagccaggauuggcuaggugcccagagaggcuaguguggggaaagggagagauccccagugagagauccccagugguccacauucccacuacagacuugcaacccuagccaugggacagccccuggaucuucaugggcccagagaccuaacauagggagcugccuagagaccacgcaacagcauugcucaagggggagaacgcaugcugggucccaugugcucccugaguccuaagcagcuauagcauggcaccguuuugcaagcccagcccacaccagacugcauucuacccuggggcaaaauggccccugcaucuccacaugccuggagcgcuacugauauacccccauguacacccagaggucuacaggagcacaauaccaaauggacccagcagaauaccaggguucccagcauucuaacacacacaguguccuacacccuggggaaugaguggugcaguggaccagggaagcuaccccugggacaaagggaaucaaaaaugcauguucccugaggccugauaacugccuaccugggagagcuaccacaagcagcaacucaacugcccccagcagaggagcugcugugcacaugcccugaggacaggcucugccacuguccacugcagccacugcugcugccacugggaaaccaaagcauaugccacuggcagugacuccaccugccaacagcagggccacugcuacauaguugcaugugcccuaaggacaggcucccccaaccauugcugcugcugcagccaccagaacauuccaccaggggucuggggagcacccugcccugcccaacacagccagcaccugaggacaccaccaggaggccugaagacaggccugccuggccugguacaacccccaccugccaugcucaagcacacuaccuggggguauggggauugcccugccucauucaccaccacuggcaucuguggacuccucccaggcaccuauggaugggucuacccagccguccccuacuaccucagcagcuccccuacuaccucagcggcucucccacccccacaugcaccaccucccaagccuguugcagccaccgcuaacaccaacauaugcuguuucagaguccaaguguugugucaccacugcuacugccauugccuaugccacauacauuauccagggguucauagacucagccacacacccagccuaccacugucacugccagcacuauagcaagggacuccuggcgguccaagaaucggcacguuuggacccccaaugcugguguucacauacaucuggaggcccacggaaagacacacuuggcucgcaacuggggcauaaggacugauaaccuggcauccccauccucaguaaaaccucaccacagccuccacuaacaacuacagccuaagucacugaggaaaucacagacaccaccaaugcuuuuuacacuagaagaaaucauauggagacuacacuacugcaugcacccagaagcaaagcuaaagugcucuacccaacaccauagauacaucuuuaggaaagagucucucccuaucaaaaccaauccaaaaaaauggaagaaguuacuguuaaaauagaugcacagaugucaaaguaaggacacaagaaacaagaaaaagcaaggacguaugacaccuccagaaaaaaccaguaauuuuccaguaauagauuccaaugaaaaacaaauuuauaaaaugcugaaaaaagaauucaaaauaauaauaugaaugaagcucagugagauacaagagaacacauuaacaauuacuuaauuguauugagauuaacaauacagugaaauuuuaaaaauucaggauaugaauaagaaauucaccagagauauagauagcuuaaaaaagaaaccaaagagaaauccaggaacuaaagaauuuaaggaaugaaauuuaaaagaauacacuugagagcuucaacaguagacuagaucaagcagaagaaagaauuucagaacuugaagacaggucuuuugaaacaagccagaaaaaaaaaagagagagagagagagaaagaaaggggaaggggaagggagacagaaaagcaacagaaaaggagaaguaugaaaaaagaagaaaaaagugagcaaauaucugaacuguggguguuccagaagaugaagagaagaccaaaguuauagaaaaccuauuuaaugaaauaaaaguugaaaacuucccaaguguaccaaguguacauccagauacaggauacaggaagcucagagauccucaaauagauguaacuccacaaguuuucuccacagcacauucuagucaagcugucaaaagucaaugacaaagagagaauucuaaaaacagccagagaaaagucacauauaaaggaacccccaucagacagccaauuuuucagcagaaacccuacaggccaggaaaaaaugggaugauacauucaaagggcugaaagaaagaaaagaaaacuggcagccaagacuacucuaccaagcgaagcuguccuucauaaaugaaggagaaacaaagucuuucccagacaagcaaaaacuagaccagcccuacaagaagugccuaagggaguucuacaccuggaagcaaaagggugauuaucuacuaucaugaaaaaacacaaaacuaucaaacucauugguaaagcaaacaaacgaggaagagaagggacucaaauguuaucacuacggaaaaucaccaaacugcaaugauaaacaagaaagaaagaaagauaggaacaaaaauuauauagaacaacaagaaaacaguuaacaaaaugacagaaguaaguccucacauaucaauaacacucuugaauguaaacagaugaaauuuuucacuuaagaguggaaaaaacugacggaacggguuuuuuuuuuuuuuuuaaugacccaacuauaugcuaccuauaagaaauucacuucaccuguaaaagacaugcagacuaaaaguaaagggauggaaaaagauauuccauucuaauggaaaguacaacaggcaaaaguagcugcauuugugucauauaaaauagauuucaagucaaaaacagggugauauauccagguaguuguggugaugcuggccaaauagugcuuggcaggugagaauguaaacccagguucaagugaaguaauaacagcuugaauguuuuuucuuucuuuugagacagagucucgcucuguuguccaggcuggagugcaguggcacagucuuggcucacugcaagcuccaccuccuggguucaugccauucuccugccucagccuccccaguagcugggacuacaggcgccugccaccacaccuggcuaauuuuuuuuuuuuuuguauuuuuaguagagacgggguuucaccauguuagccaggaugguugugaucuccugaccucgugauccgcccgccucggccucccaaagugcugggauuacaggcgugagccaccgcacccggccaagagcuugaauguuuucaugugcuaauguugcacacuugugaaaaaaacuuuggaaauggaaaauauauauuagugcacauugacaugcauuuugaggcaaagacauauuguuugguuccacgauuuguccuuaaagugaaagaacauuuaaaguuuagaauuaaccuagcuguagcaaugcuguucuguuaacagauaacuagaacuuacauucacauuuaauuuauguuaacuauguaaaaccuaguagugagcauaauagucaguaaauguuuggauuccucuuaccccucaauaaguuuauuuuuaacauauuccugccugccuuucugacccuguugaaucagccuguggacuagaguguuaaugaaauguuauugccaaagagauuaugagaaaauugguauaucauguagauaucauacaaagucuucuuguaacauaaaaaagguaguuuuauuauuguuuaugccucaacuauuuaagugaauauuaaagggcuuaggaaaaaaaagucaaaacaggaaaaagagacaaagaguguauuauguaaugguaaaaggaucaauuaagcaagaggauacagcaauucuaaauguacaugcacucaauacuggagcacccagguacauucagcaaauucauucgaucuaaagggagagauagaugccaaugaaauaauagugagggacuuaaacaccccacucucaacauuagacagaucauaucaauggaaaauuaacaaagaaauaauguauuuaaacugugcuuuagacaaaauggaccuaacacucauuuacagaacauuuucuccagcagcuccacaauacacauuauucucaucagcacacagaacauuuuccaggauauauaauauauuaggcaaaacaagucucaacaaauuucuacaaauugaaauuauauuaaguucuucucagaccacaauggaauaaaacuagaaaucaguuacaagagguacuuugaaaacuguacaaauacauggaaauuaaacaugcuucugaacacccacugggucaaugaaaaacuuaagaaggaaauuuuuuaaaauucuugaaacaaaugaaaaugaaaacacaacauaccaaacccuaugggauacagcaaaaguaguacuaagagggaaguuuauagcaauaaauaccuacaucaaaaaaguagaaagauuucagauaaacgaucuaauaaugcaccuuaaaaaacuagaaaaacaagaacaaaccaaacccaaaauuaguagaagaaauaauaaauaucagaacaaaauuaaaugaaauagagaccaaaaauacaauacaaaggauuaaugaaacguuggguguuuuuaaaaagauaaaacugauaagccacuagcuagacuaaccaagaaaaaaaaaagagagaagagccaaauagacaaaaucagaaaugaaaaggagacauugcaacugauaacacggaaauaaaaaagaacauuagagacuguuaugaacagcuauacacugacaaacuugaaaaccuagaggaaauggauaaauuccuagacacguaaaccuaucaagauugaaucaggaagaaagaaaaacccugaacagaccaaguaacaagauugaaucaguaauaaaaagucuuccaacaaagaaaagcccaggaccaaguggcuucacuguuggauucuaccaaacuuauaaagaagaacuaacauaauuccccugaagcuauuccaaaaaacugaaguggagguaauucucccuaacucauucuaugaggccaguguuaugcugauaccaaaacuggacaaggacgcaacaaacgaagaaaacuacaggccaauaucccucaugaaauagacacauaauaguuuguacauuuacaaaauacuaguaaaccauauucagaagcacuucaaaaagauaauccaccaugaucaaguggaauguaucccggggauacaagaaugguucaauauacgcaaaucaguaaacaucauauaucacguaaaccaguggucccaaccuuuuuggcaccagggacugguuucguggaagacguuuuuuguauggaucguauguggggggucggggguaguuucaggaugaagcuguuucaccucagaucagcaggcauuagauucucauaaggagugcacaaccuagaucccacacaugcacaguucacaaugggguucugacuccugugagaaucuaaugcugccucugaucugacaggagguggagcucaggugguaaugcucccucacuggcucaucuccugcuguuccaggaggguaccagucuguggcccagggucuggggaccccugacauaaacagaaugaaggacaaaagccauaaggucaucucaauaguugcggaaaaagcguuuaguaaaauuaaucaccccucaugaaaaaaacaacaaacuaggugcagaaggaacauaccucaacauaauaaagcccauauaugacaaacucagaacugacaucaucauaccaaaugaggaaaagcuaaaagccuuuccucuaagaacuggaucaagacaaugaugcucauuuucaccacuucuauucaacauagcaguggaaguccuaaugagagcagucuaggcaagggaaagaaauaaaaggcauccaaauuggaaaagagguagucaaauuaucccucuuuguuuucuuuuuuuuuugaauuuaaaaaaaaauuuguagagaugggaucucccaauguugcccaggcuggucucgaacuccuggacccaagcaguccucccucagccucccaaagugcugagauuacagaugugagccacugugccuggccuguuuuucuuugcagacgaugugaucuuauauguagaaaaaccuagacuccaccaaaaaaaaaaaaaaaaacccucagaucugauaaacaaaaucaguaaauuuucaggauguaaaaucaacauagaaaaucaguaguuuuucuauauacccauagugaacuagcagaaaaagaaaucaagaauccaaucccauuuacaauagcuaccaaaaauauauaaaauaccuaagaauaaauguauccagcaaaacacugaugaaauaaauugaagaggacacaaacaaauggaaagauguuccaugcucauagauuggaagaauuaauauugcugaaaugaccacacuacucaaagcaaucaacacauguaaugcaguuccuuacagugcaacccccaaugcaauacauuauagggcuauaguaaccaaaacagcugaguauugguauuaaaaacagacacauagauuaguggaacagaauagagaaccaagaaauaaauccacauacuuacagcaaauugauuuuugacaaaggcacaaagaacauacauugggaaaaggacgcccccuucaauaaauggugcugugaaaacucgauauuccuauucagaaggaugaaacuagacuccugugucucaccauauacaaaauccacugaaaauugauuaaagacuuaaaucuaaaacuugagacugugaaacuacuggaagaaaacauaggggaaacacuugaggacauuggucuaggcaaagauuuuauagcuaagauaucaaaagaguaggcaacaacaacaacaaaaaacagacaaaugggacuauauuaaacuaaaaagcuucugcacagcaacgaaaacaacagaaugaagagacaaccuguuaaaauaggggaacauauuuggaaacuacucaucugacaagggacuaauauccagaauauacaaggaacucaaacaacucaacaguaaaaaaaaaaaaaaaaaaauccgacauuucccaaaagacauacaaauagccaacagguauauaaaaauacgcucaauaucacuaaucauagcucauuagugauguugagcacuucaacauuuuaccucauuuagaaugacuguuacuaaaaagacaaaaagaaaaaaaaaauuggccaggcgugguggcucacaccuguaaucccagcacuuuuugaggccgaggcagguggaucaccaggucaggaguucaagaccagccuggccaacauggcgaaacccuaucucuaccaaaaauacaaaaauuauccaggcaugguggcaggcaccuguaaucccagcuacucgguaagccaaagcaggagaaucacuugaacugaagaggcagagguugcagugagccgagauccugccauugcacuccagccggggcaacgagagcaagacuccaucucaaaaaacaaaacaaacaaacaaaaaaaaacagaaaaagaaagaaaaaaaaguagaugccggcgaggaugcagaguaagggaacucauacacuguuggugggaauauaaauuaguacaaguauuauggaaaacaguauggagauuuuuuaaaauaauaauaaaaauaaaaauagagauaccauacaauccagcaaucccacuacuggcuauuuauccaaaggaaaggaaaucugggccaggcucaguggcucaugccuguaaucccagcacuuugggaggcugaggccgguggaucaccugaggucaggaguucgagaccagccugaccaacauggugaaaccccgucucaacuaaaaauaaaaaaguuagcugggcuugguggcaugcaccuauagucccagcuacuccggaggcugagacaggagaaucacuugaacccaggagguggagguugcagugagccaagauggcucaacugcacuccagccugggcaacagaucaagacucuguccccccaaaaauaaauaaauaaauaaaggaaaggaacucaguaugucaaaggaauacaugcacccccuuguuuauugcagaacuauccauaauagcaaagauaugaagucuuugaaacauguccauuaacagaugaauggaugaagaaaaugugguguauauauucaaaaugacauacuauucagccauaaaaaagcaugaaguccugucauuugcagcaacauggauggaacuggaagucauuauguuaggugaaauaagccaggcauagacagacaaauacguucucacuuauaugugggcacuaaaaaaguugaucucagcugggugggcuggcucacaccuguaaucacagcacuuugggcggucgagguggguggaucaccugaggucacgaguuugagaccagccuguccaacauggugaaaccccgucucuacuaaaaauacaaaaaaauuagccgggcgugguggcgggugccuauaaucccagcugcucaggaggcugaggcaagagaaucgcuugaacccaggaggcggagguugcagugagccgagauccugccauugcacuccagccugggcaacagagcgagacucggucucaaaaaaaaaaaaaagaaaagaaaagaaaagaaaauugaucucauggagauaaaguagaaaaauaguuaccagaggcugggagggggucggaggguugaagagagguugguuaauggauacaaauauacaguuagauugaagaaauaaguucuaauguucaauagcagaguagggugauuauaguuaacaacaauguauuguauauuucaaauuagcuagaagauaaccugaaauguucccaacaccaagaaaugguaaauacucaagauggugaauaccccaaauacccugacuugaucauuacacauuguaugcaugcaacaaaaugucauguuacacugucaauauguacaaauauugugugucaauaaauuuauuuuuaaacuuacccucaagagguccuugcaggcaaaucaugccuucucacauaccuuucacucguugcuucuacuuccacaauaaaucuuacucauauauauuuaggaccuacccugugcauagcacugaagauaaagaaaugaaauuagcaguuuaauacucuuugacuuacauaauucugcauuguucaauacuaauauccucagaccugacuuucucuuuguucacguuaaauaaucauauuuuacccauauuuuaauuu

SEQ ID NO: 13960 - RNA, 8373 nt, Homo sapiens
ccugcaaguccgggggcggggccugagucagucucgccagcugccggucuuucgggggcuccguaacuuucuauccguccgcgucagcgccuugccacccucaucuccaauaugguauggcggcccuuccaugauccccgccucucccagaagcccugacuccuccugcuuugcgccgugcuuuuccucuguagcucccuugcuucccccagccucgggugugggugucuaggccgggguucuggggcaggccugccgcgcucacccgucugucugcuugucucccucuacagccugguccgacccccaguggcacuaacgugggauccucagggcgcucucccagcaaagcaguggccgcccgggcggcgggauccacuguccggcagagguaaggaacccugcaguucguucgcuuccagacucggagauaggacccagaaccucgcugauucugggguggagacccuagcaugugaagauugacaaaggcaaaaugagcuucuagugacguggccgugggaguaguuaaaggccuuuugggaggaaggcgacauuuuuuuucucguugcucaguuuagggcacuacucuuaaaaaaggaaaguuaacaaacuggaauagagucagagauaacuuugagaaaaccgaugucauuaaacuggugucucuggaccugagguuugcacucacauuuccaucuggcggccccauaagcaaucuguccuacagauaacucguccuacacaaaacuuagucucuuuucagcucagcucucucacucucaauuauaucuccuuacuuccauauggcacuguuguacacucauuuacucagagccagaaacgucagcgucaucuuggauuuuucuuaugcucuuucucucucuagucauaugccagacuuuaaacucugcuugaaagcuuucucauaagcucuuuccuuuucccuuucuacugcuuugcauuugcuacuuaacccuuuucuucaggcuguuugcuuuccaguccaucguucgcucugcuguuacucuucugcguaguuucuguuacuuguugcugaacuaaaaaaaacaaacaaacaaaaaaaaaaaaccggggggauaccaaagcucuuaguggucauuucagccuaaccuuucuuuuuccuuuuuuuuuuuuugggauggaaucucacucugucgcccaggcuggagugcaguggcacgaucucggcucacuacagccuuugccuccagaguucaagcaauucuccugccucagccuccugaguagcugagacugcaggcacgugccaccacacccagcuaauuuuuuguauuuuuaguagagacgggguuucaccauguuagccaggauggucucgaucuccugaccuugugauccuccgucucugccuccaaaagugcuggaauuacaggcgugagccacugcgcccggccuucagccuaaucuuucuuugcuguccuaugauccagcacucgugaacccauuacuguuuucugaauucacaaacuuucucccucaucucaaggcaaauuucuacuuauuuuccaagacuaagcucagggguuauuuccucuugaggccuucucugucuguaagcagcaguagcuacuaguuuucccuuuugcccccauagcauuuuguucauaucauuauaagaccagugauguuuccauauuuaucuccuucauuagacuuuaacagagaaccugcucaagucauuucuaucccagguacccaccauaaggcaugacacaauaaauaaugacugaaggaaggaaucaagcaaccaaguuguuuugggauuuuugaaggaacuagugggguuuuaucuagggaggaaaaaaucuugaacacaugcauggaaacuucugaaggaugugaagagggaugugacauuuucuggcugcaacagguaaaucuaaaacugaugauuugaacuuacaugaaauauuucacaucagaacaaagacauucuaauagaacuggcagaaauguaaaauuauccugaaugauuuugaguucccugucauugggauguucaugaggaguguaucaggcugugguuuaacuuauaugggcuuugagugcuguccccuucccacccuggguuuuagagauuuuucgugcaggaauggaaaacauguccugugggugcgguuccuugggaaugguucugcuuaaugagaauugguaauacuguggcagggaaguuuggccauccgagaauuuguaaagaaauaaaagaaaaagcacauauuuaucaaauguacauaugauaaugaaauuauuuauuuaauaguaaaaaugaaauaacugaugcacaagugaaauggagaacugaaacauuugaagacagacagaugcaguuuuuaaagucguggguguuggugucaucuuuuaggauucagugugauagagcuaguguaacaagaaagaccaugguuguauguauugagagaccugacaguguuuccuucuagaaugguagugauuaaguaucauuucaugaguauaauguaauaaguauugguuguuuaagaauaucuuugcuuuauaagucugagaaaacauuggaaguuaaugauucauaauagugcuuuggauuauguugucuguagagcugccuucuccaugcuugaugaggugauagauacuaccuuggaggagaaauguuauuaaauuuaagcucaggccagaguugguguucuugcucuccuaaauacaauauaaaaggaacuugcugugaggagcaauaaugcuuuauaaacuguaaaggugugaagugccacauaguguucuagcaggauuaaugggaaucagggauauuaagauggcggaauagccaccaauguauagacaucaagguauugaggucuacuacaugccaaaugcuguuucaucuccgaagaugggucugugaacaagguaggcaagguuuguacucaugaaccuuauauuccagugugggagaucaaacgcaaggaaaauaagacaauguaauuucaggcaauaagggcuaugaagauaaauaaagcugggugggggauagagagugguggggauagggcaaagguagguaguuguuuuagauaggguguucacaguagguaauaccugaguagauaccugaaagaagcaagagagcaaaucacacaaugguuuggggacgaauaggccuccuaggcaaaaggaguggguaaguaugaagauucugaggucgaugagguuggcuuugaggagcaacagaagcaccauguuagaaccaaguguguaacugguuaguuuugaaaaccauuguguugagguauagaagggagagacaguuacacaguggccagaaagaaaggguaaaauagcccccaaauacaaauuugagagauucaauguguuuuauuaaccuuuaccuagcuaccccuagggaaugggaaguauuuugaguacacuuuaguauuucuaggggcucugguuuucaaauacucuucuauguuccaugcgccagcagaaauaagaaaucuuaagagaagccagccugacuccucuggggcuccuguaauuccaggaaacuuugaagucaggaacuggaggugugauauuguggaaauaguaggaagugcaugcguccaaguccuggcucaguccaugacuauaauauguucacacuggguuuaucuucuagcuuaaaauccuuuucaaugaacaaggaggaagauuucagcugcauaccccacagauggaaugacauauaucugugugugugaaaccuuuucuaagggcaugaaucuuucuguaaaucccuguacaguuauguuuugccauuuacaaucaguuuucccauaggaauggucacacaaugaaguuuuaaguucccaggcuaccacguaguccauaauuaaugugucugaaauauaauccuuguaguacaauagacccaaaucaugguuuggcacugauugcuuucaaaguucuggcaugaacacagcucuuccuguuagaaccaggacugcacucucccacuccgucauguagcagggcaggcuccccgugcuguagacagugcuuccugcauucagaauguggaguaaagaccgugguuggguaaaggaggcaugaggaccagaauggggaggaaagcaagaagagaugguagggauaggguuuucacuucucuucuuuuccguauaugcccuucccuuuuucaaaaauccagaaucaucagcccacagauacuggaaugagauuuugagggaggguauacugggauuugaugcugaauggugcaggcagcaaugagauaggcuuccccucuccuccccacuaggacuucugaguuggugauacauggucugaagaaaauugcuugugacuucucaccacuugccccuuacccccauauuguaccacuccaacauggggcacgaugagcagcugggguuggggaaguacugcagggaaggguaguugcugggugggguuccccggugacugagggcuucucccaaagaggagagaaaggauuccuugggccuauuccuuggcagcagaguccuaagugcugcuaggcugcuucugucugccagggcugcguguauuacauaguguaucuuacaagccuugauccccuugugagagacacaagggguguuuugguuggguguucccugcguuuuuuuuacauucuaccucucugugcaagaucugugaucacuauauuaaaauagugaaaacacggccaggugcgguggcuugcaccuguaaucccagcacuuugggaggccaaagcaggcagaucaugaggucaggaguucaagaccagccuggccaguauggugaaacccugucucuacuaaaaauacaaaaauuagcugggcaugguggcgcacgccuguaaucccagcuaagcaggaggcugaggcagaagaaucgcuugaacccaggaggcggagguugcagugagcagaaauuguacuacuguacuccagccugggcaacagagcgaaacuccaucucaaaaaaaaaaaaaaaaaaaaaaaaaacaaacuagugacaacacauaacaaaguaauuuuuuauaaaguguauacucuaucuugggcccuggauauaauuaaagcuuaaaguuuuugucuguuugcaguaaauauacuaauuuuaaaauacaucuuuuaaaguagccauuuuaagaucagcuuguauggauucagggcauuuuaaaacaggaauuuauuauuuggcuucaugaaagaugcaugugaggagaaagugaaaugcuuuguccacaugacacagcuggauguuuugggcaugcagaugggcuccagggucagagcuagguucagccaccuguuggcugcagggucuuagauauuuugcuuaaccuuuucugaggccaauuugccucauuuauaaaauggaaaaaucgugacugcuuuucaggguuauuguaugcauuggcaucagguaggcacuuaguucauugugguuaucaugaucaaaggaguaaaagcaggaauuuagguggauucuagcaaagaaaguuuuuuuuuuuugauuccuuaacuguguaauaaugguagcauauguuauaaugcuauucuaauaauuuccagaaaaggccauuuguaacauuuuccucucuuucaggaaaaaugccagcugugggacaaggagugcaggccgcacaaccucggcaggcaccggggggauguggcgauucuacacagaagauucaccugggcucaaaguguaagucuuaggaacaguccuuguguuucuguccaguggcagcagagcagcaguggcagcacucugucucugucaccaguagcguuugccuugaugcgauuuacuguacacaacagccucauuugugccaggcggacuggguuugguuugccuguuuaucaaccgauuaggcauuguagggccgggaaugacaucuuuucauggagugagggaaaggaaaggaaguucuucauggagcuaugucaaaauaaaugagaacagagagaacuggagggaaaacugcuuaauuagaugaaauugcucuucauuuggugaucuugccccguaccaagaaauaggaguaaucauuugaauaggaauugggugauuuuucaaaguucuccugaaggcauaagcugauauuacuacaaccugauggagguuuucccauuaggcuguguuaccaggaguuccuuggccucuuugccuuugguggguggugaguagacucaggagggugaacauguaauaccacuuuccaaguucuuaggcauuggagugcucauuaggugaugggaaauggguguccagggaccccuguccccaugccuugcucaggguuucuggugcuguguggcagaucuuaucccacagauuucuguuagguuccagaacaccacugccuacaacuguuuccugacuaaacucgguggaugaggauucgaaauaauaacagcaacucugauuuacauagcacuuuguacuuugcaaagaacuuucaaugucuguugucuaguuugaucugcccagcaauccagugaggugagagauguuaccauuuuguagaugaggaccucagguucaaagaggcaaagugacaugcucaaagacacacaacaagagguggaacuggauauucugauuaaguccuaugcucuuugcauauuguccaucuaguuaaaauaaaaaagacaaaauugaauuaauuuggauuaguuuuaauuaauuugaccagcaccuugacuuuaguuuacaaagucacaaauuuguaacuuuacaaauuuguaaaguuuuuauuaauuuuaauuaguuuuuauaauuuuaauuaguuuuaauuaauuugaccagcaccuugacuuuaguuuacaaagucacaaaaggaucacaaauuuaguuuauaaagccuucccuggaauucuuguuuucucuuauauuggagacuuauaugauaaugugagaauauaucuaggaaguaauucuugggguuggggauaugugagguggggguauccugacugccaaccuuuuggucuuugguggagguaguuugaguauuucagagagaauuuuuuuuucuccuuuagcgacaggguuuugcucugucgcccaggcuggagugcaauggcaugaucauagcucauuguagucuugaauuccugggcucaagugaucuuuacuccaggagacaaaauuggauaaauuuggauuaauuaguccugaguaguugggacuacaagugcgcacuaccaugccuggcuaguuuuuuguacaagcagaaucucacuguguugcccaggcugguuucuaacuccuggccucagccucucaaagugcugggauuauaggcaugagagggaaccucagagagaacaucuguagcccauugcucuucaggggacucauuuuaaacccuucucaagaagguugucuuuuaauuuuuaauuuuuauggguauacagguguauauauuuauggguuauaugagauguuuugauacaggcauacaauguguaauaaucauaucagggugugugggguauccauuaccuuaagcauuuauccuuuguguuauaaacaguccaauuauacuguuaguuguuuuacaauauacaauuaaauuauuuuuugcuauagucacguuggugugcuagcaaauacuaggucuuauucagaagguugucuuuaaauaaaucuuaauuugaaaaaaaaaguuugguaauggguucauuugcacugaaagaguuuucuucuuuuuauuugagaagacaacaaauacaugaaauuagauuaaugucuccaagacaucagaucauuucauuuguauauguuuugguauguuuuacuaaaagauaaggacucauccuuuuuaaacacaauugcagugccaucaucacaccuucaaaaguauccacaauaauaauuuuagaaauauuuuaaaaugauacaaauaauguuucuggaugaaccuugagugcugcccaccuuaccucuacuuuuccccuaggcaaucuuuaguauugcagaucuaauaguauauuauuacuaaaaguaagcaugcuuucucuucuuauuucuaguggcccuguuccaguauugguuaugagucuucuguucaucgcuucuguauuuauguugcacauuuggggcaaguacacucguucguagauucaguuacauccaucugucaucugaagaaggaggaaaaaacccaacauuucuuggaccaaaaguauagugacuaucuguucaugagagaaauuuucuguaagcuugcuguuuuacaggggauuuaucaauaauugauuuugaggaaucaguuuuuuucuauggcuaauaaacuuuuuaauucacuuauacugagucuga

SEQ ID NO: 13961 - RNA, 1680 nt, Homo sapiens
ucauugugaaaaagucuuuauuuuaagaaaaaaauuuaguuaacaaaaaauuuaacaaguuucacuuagcaaaauacacccaaaaggaaaucacaguacaaagaaaguuuuaagucaaggccucaccaauuccuacaguauuaguauugugucucaauucucaaaacuaacuuuuaaaaagcuuaaacuuaaccuaaaggauuuuaaaugaaaauauaaacuagaaugaacaaacaugagaaauauuucuuugaaucagggagcuagcaccuuugaguuuuccaaaaaagcacgucuccccaguguguucacugugaugugguguaaaagauccacauuuaacauacuuaaacuacuuaaacuuagauaacaucacucugaaguauacuaccaaaauguuaauugagaaaagcugaaaauaguuuuaguuuacucauuaucacaugcuagaagaaaauuuugcaugagaaaacacugaagagguaauuuuuuaauccagauuuuucacaaacucauggugcaaaaugggucccccagcuuccucuauuauaacugcucuuaauugcuuguuggcugccugugaaaaugauugaaguaacucaaauguuccuaacaaaacuagucauagccacccaugcuguucugcccacuguagccggccccguaacagccacucacugacuggcucuccaggccacuguaaguggccugggcagcagacacccccaugccuugcaucaccuggcugcuauacgccccauugcuggccccuguuguugaauucaagaagaguucuauauaucugugcugcauauuggcccugucuuuggacauagcugccacagcuucuucaugaguagcaaacucaacaucugcuucacccgucacucuuccaucugggccaaucucaauauggacucucacaggguugagaggagagaagaaguuguaaaugucguucucggucgcuuuguacggcaggccccucauguggacacaguggccuguggugcucugcacugugaacucacugucgccguaucuguggucauacauuccggagagacaguagcugaggucucucccgaacaggucgguggugaagccguagccaucacugaggccacuguacuccucguagcccccguagccugugcuguaggcaccaggccucauccuuuccaggccugccugcuucacgaugccaauguaccuccuggcagucccgggccggucauagggcccuggccgcugcacggacaugaacuucagagggggaucugaguaugaccuaacuuccuccuggcugcucuuaaacaccucaauguaccugugcccuauccucuccuuguguuucccuagagccuucucagcuaacuccugcgaggcaaacugcacgaacgcuuccccuguaaucuugccuucgggguccacaggcaaugugaucccguuuggcacaauuuccaacccugagaagaacugaacaauuucuuccuuugugcauccaaaugggaguccucgaagccgcacgaagccaucguuggcgcugucggcacuguugggaccacugugcuucaacacccaauccaucucgguucugugggacuugaacaccucaauguaccggugucccaugcuuucccugucuuuuuucagggccauuuuuacaucaucuucuga

SEQ ID NO: 13962 - RNA, 1749 nt, Homo sapiens
gggaauaucaaaauggauuuuugaggccuuuuuaugacuuugaauuaacaaauguauaggaugccacagucagaaaacauuagugauauacuuugacaaaugauacugaggccccauaugagaaaccuugcugaagacauugcuauauuuugcuucuaacuuuuuauggagcauauaagcaaauacauuaaagguuuaguaguuuuuaaaaguaacaaacauaugucucaauuuuucucucuugguuuuauaacuuccacaaaauuauuuuaaugugaacuauuguuuuuggcugucuucacuguaucuugaauggaguugucaucuguguaccccucugcaggugagcaagaauaaacuggauuuguacaggggguaccaauacuaauaaucacaguuauuccauucacuggaauggaacuuuaaagggaguucuuuucuuuuauuguuaaagagauaggcccaggugugugugugugugugugugugugugugugugugugugugugugucaauaaaaggcucugcugagauucuuggugggugguuugcaaggcuguguguguguguguguguguguguguguguguguugugugucaauaaaaggcucugcugagauucuuggugggugguuugcaaggcuggguguagaagacugacaugagcagggauugauuugcugccucccaaauacauguggagaaacagcccaaggaggcuggcauuuugcuauauccaccuuucugcuucuuccuuuuuaagugguaaaggcacuacuaaaaccucgggggugggggguucuccaaguuggagggugagagcaauaauauucauuaacugguuaaugcuuaaugugggugggcuugagccuaacaaaacuguguguucuccuaaauuugggguuaggaaaagaucauuuuauccuugucugauuuuaaaccagucaaaaauauguguaggacaaguaaguugcuuguucauaugaaguccuaagaaaucauuaaguauugauuugaauuuauuuacucugucccuucugagucucuuaacuaaaaaacuuauaugcugcuaaacaccauuuuaaaagauuucugguagucuuggauuuguuuuucucuuaagacugaaaaaugauccaguuaucuaauuuaugcuaguauuugauugucuaaaugccacuucucugguagugauaucugacaauucuguuuuugaaaugauucuuuaauuugcucagguauaaugaaagggguuuuuuuguuuguuuguuuuuaaacagacuguaggccuugauugcuuugaaaguuucuaacuaccccacccaccacucccugaucagccugucuguauuacaugaguuguccaacacuuauuaaagauuuggcaguaauuacucugucccccaccuccagguuuuugccccccaucaaaaaacuaaaugaauauuaaaguucaugcugacagucauuguucaccuucccagcugcacucuguuccuccaggaugacuguguggaucgaggaggcaggggggagcguguugccauagccaccuaugagaaacacuggaccuggcauuagcugcugacagcaaugaacuuaucacccauauuuaaugcuggugugaaugagggggcccuaaguaaaacacucuugucuugguggcugaaaagaaaguucccugagcuucuccuguaugagggaaagcacgcacagcugagccugggcuguacaugcucucaguguuc

SEQ ID NO: 13963 - RNA, 638 nt, Homo sapiens
caugacgcccagccggaauggcauggucuugaagccccacuuccacaaggacuggcagcggcgcguggccacgugguucaaccagccggcccggaagauccgcagacguaaggcccggcaagccaaggcgcgccgcaucgccccgcgccccgcgucggggcccauccggcccaucgugugcugccccacgguucgguaccacacgaaggugcgcgccggccgcggcuucaaucuggaggagcucaggguggccggcauucacaagaagguggcccggaccaucggcauuucuguggauccgaggaggcggaacaaguccacggagucccugcaggcgaacgugcagcggcugaaggaguaccgcuccaaacucauccucuuccccaggaagcccucggcccccaagaagggagacaguucugcugaagaacugaaacuggccacccagcugaccggaccggucaugcccauccggaaugucuauaagaaggagaaagcucgagugaucacugaggaagagaagaauuucaaagccuucgcuagucuccguauggcccgugccaacgcccggcucuucggcauacgggcaaaaagagccaaggaagccgcagaacaggauguugaaaagaaaaaauaaa

SEQ ID NO: 13964 - RNA, 638 nt, Homo sapiens
uuuauuuuuucuuuucaacauccuguucugcggcuuccuuggcucuuuuugcccguaugccgaagagccgggcguuggcacgggccauacggagacuagcgaaggcuuugaaauucuucucuuccucagugaucacucgagcuuucuccuucuuauagacauuccggaugggcaugaccgguccggucagcuggguggccaguuucaguucuucagcagaacugucucccuucuugggggccgagggcuuccuggggaagaggaugaguuuggagcgguacuccuucagccgcugcacguucgccugcagggacuccguggacuuguuccgccuccucggauccacagaaaugccgaugguccgggccaccuucuugugaaugccggccacccugagcuccuccagauugaagccgcggccggcgcgcaccuucgugugguaccgaaccguggggcagcacacgaugggccggaugggccccgacgcggggcgcggggcgaugcggcgcgccuuggcuugccgggccuuacgucugcggaucuuccgggccggcugguugaaccacguggccacgcgccgcugccaguccuuguggaaguggggcuucaagaccaugccauuccggcugggcgucaug

SEQ ID NO: 13965 - RNA, 147152 nt, Homo sapiens
ccguaauugcgagcgagagugaguggggccgggacccgcagagccgagccgacccuucucucccgggcugcggcagggcagggcggggagcuccgcgcaccaacagagccgguucucagggcgcuuugcuccuuguuuuuuccccgguucuguuuucuccccuucuccggaaggcuugucaagggguaggagaaagagacgcaaacacaaaaguggaaaacagguaagaggcucuccagugacuuacuugggcguuauuguuuuguuucgaggccaaggaggcuucgggaagugcucgguuucggggacuuugauccggagccccacauccccaccacuugcaacucagaugggaccggaggcgguguuaaauggggagacgauguccuaguacgagcucuggugaccccaggacucugcgcugcugcgcuuggggcuugcccgacgguggagaccggggagcaucucugggcguggagacccgggcgcaguaccccgggcucagaggggucggggguucccgggcgugcugagggcgcugcugccggguggggagagcugcagguccggcaccgagcgcugcuuuguucggagggcccugagcuggcuagaaacccuucugguugcaggucggccaguaccuacggagacaaaugccagcacugagucuucacucgguucuuaagaagcuggucuguucugaccugggaauuggcuauaugcuccccgggacuggagcggcacagucccggacugugaauccgggaacucgaguuggaggugucccaaacgguccguggugcuauugcucacuagaggccuugggucuuuguuugaccugagggguagggagguccugccuacagucuccgugcgcucagcugagcuggugucccuggcgcagagcgcggacgaguuuuguuuccuuuucuuuuucuuuuuuuucuuuccuuuaagucucggucugucgcccaggcuggagugcaauggaacgaucuccgcucacugcaaccuccgccucccggguucaagcgauucuccugccucagccuccugaguagcugggauuacaggcgcgucaccacauccagcuaauuuuuguauuuuuaguagagacgggguuucaacuuguuggccaggcuggucucgaacccucgaccucaggugauccaccggccucggccuccccaagugcugggauuauaggcgugagccaccgcgcgcggccgaguuuuguuucuuuuaaaaacaagacuuaggagagccugcggagacccggagguggggugcccaauccucccucucccacguucccugcagccccaucuuccagaccguugcugcuggucucucggggcagcuucugccugggcgcagauggggaagcugggccgagguggugccguggaaugaccgggaguaaccccggcgggcggcgcagaacucggagcuccgccgcggggcugggcugggcucugccgugagggugggggugcugggcgcgcgggcugcgguggcccccggagacuggcccgcagcgccuccuggccggaggaccuaggaaucggccggcucuacuaggugucuuugcucgcgguuccgacugugaauccggugaagaccggugguugcagacggggaggaacuaugagguugaggcgaaagcccguuuuguuuuuuuuuuuuuguuuuuuugguuuuuuuuuuuguuagcguguuugccaacucccaggccauugguaaagcaggaagguucuuggggcggcggacggugccaggguuauguguaggugccucuuuagguauaucuuuuaucaaaaagaagcaaagaaauaagauuaaaaauaaacaaagaaaaaaguugucuggcacuggcaguaauuggccugccuuugcagcacugauaccauuagcuuuuaaaauccgacuuuucauugacacuucaagaagagaauggguaguauauacacauucaucucauaguggacaaauuucauauuuaaaaaaaccuucuggguacugaaaucagcaagucacuugcccuccauggccgaaucccugcuucccacgaagagaaccucacaaaaauuucccccaaguuaaagaguggaauuuucuugauuuuuuuuucuuuuuuuuuuaacggccguaguuuagaacccagacuuaaauuaugaucuucuuuucaaacaaaacuuaaaguccuuaaguuuucaucuccccuuuuauuucaaccuauucuucucauaccuaccacaaaaauaauggaggcuuucuguugagaaacuuuccguuucuguugagaguaucauucucuugagaaacuuucuccuaaaucagagaaaguauggaagcauggaaaguauuccugaguagaaccucuacagauauuacaauauuuuucaaauacaaaguuuccauugucagccuguuucccaagugcuuccacaaaccauuaaauaauuccacaaaccauuaaaauaauuaaugcuagggaauuuuaggaaaacauugguuuacaaucagaaggaccggggaagugggucuucagccuucacgaugacuacaagccauuuaagggacuagaauugcuacuguugucagagcaauuuaggagucuguauuugagcacccgcauaguguuccagaaugacauaucugacuguaaccuggacacgugugauauguugucuccccugcagaugagcauuugaaaucucaacccucguauuucuacgagugcaggccuauaauggacccugggcacauuuuuuuuuuuuuugagaugcagucucgcucuguuucccaggcuggagugcaguggcacgauauggcucacugcaaccuccaccuccuggguucaagagauucuccugccucagccuccugaguagcugggacuauaggcgcacgccaccaugccuggcuaguuuuugcauuuucaguagagacagaguuucaccauguuggccaggauggucucgauuuccugaccucuugauccacccgccucggccucccaaagugcugggauuacaggcgugaggcaccgcgcccgaccccuggacacauuuugacuuagaacauauuuucgguuugugugagacagugcauuagugcaggauuggaaaagagugaucaggaauugauuguuuucaaggauugguuccuucugcucaaggaagucccauuguaaacauaaaaaaaugaaugaaacugaagaaguucagugacuuagcuuuuuauuaucuucuguaguacuuaccuuuuuggagaggaguugguugggauauuuuuccauuuaaauuuuuuuuuuaaagggaucuucucucccguaagccgggauacuuaagcuauauauguaguggcuacaaauuaaggucuucacuguuuucauuuuuagcugcuagaauaagugaacauuaccuuagauagacucuucuaauuaugaagauaucuagaugucuagaaaauaucaaaaugcaugugguuuuugcauuucuaaaauacuuuuaaaaccaaauacuuuuucuuuuuuuuuuuuuucugagauggagucuugcucuuuugccuaggcuggagcgcaguagaaugaucuuggcucacugcaacuuccgccucucagguucaggugauucuccugccucaaccuccugaguagcugggauuacaggugcgugccaccacacccggcuaguuuuuguguuuuuaguagggacaggguuucaccauguuggccaggcuggucucaagcuccugaccucaagugaucugccagccucagccucccaaagugcugggauuacaggcaugagccaccacaccuggccucaaauacauuuuuuuaaguauccagauauuaaauaaauaauaccauuauaguaguuguuauggucauuuacucuagcaucaaauguuaaaagaucauucugaacacuuguuuuguuuaugcugagagaaggccuacuccaaaaaaugcaaccaucuucguaucugcauguggauacaaccaugaauggccaaaguuauugcaguguugaauagacacuuauauagcacuguguggcaaguacuguuugaaauguuuuucacguguuuauucauuguauuuauuuugagauagggucuugcucuguugcacaggguggagugcagcugcacagacaaggcucacugcaaccucagccuccugcgcucacgugauccucauacaucagccucuuaaggagcuggggccacaggcacgcaccacugcuccuggcuaaauuuuuacaauuuuuuguaaagacaaggucucacuaucuugcucagacuggucuugaacuccugggcucaagugauccucccacaucagccucccaaagugcugggauuacaggcauaagccacugugcaggucaucaaaugcuaauugaauuuucacaacaaaaccauuuauugucccuaguuuacaagauuaaguaaaugagaagcuaauuuuucucuggcuauauaccuugcaagaggcagagcuaagacuugaacccagccagaguucuuuaacuccagcacuaacauuucagcugcugcaaccagggagcuuuucaaggaugaucaccacauucucuacauucaucugcuauaauccuuaucagaaucuacagccuguaucauauuuuccuuguugcugugagugggucagccaaauucucuuuaacuugaaaccuugguugcguagggauugcaacauccuggaaagaauagaauaaaauuuacucaacucaauuuuuuacuugguucauaaugaaaacuauacuauugcuucagucagauguuugcgaauagcugugugaucucaaaauguuuuccuaugugaucuauagaaaauggaaugauagaguauuaggcuguaagggccuaagaaacaaaggaaaaagagaagugaacuguuaguuuaguuguaaaaccuaacuuuggugaauuguaaaaauuuguuauaauacaauaugauucuugcuuguccuguccuugaugaaguuguggaccuuuugaaauaagcuauuucucuguuacugcuguuacuguuuagaaaucaaauuuaguuuuuucuuaagauauacguauuuuuggaagauaaacacaguuucaaagucugccuuguuggcugggugcacuggcucauuguuguauucccagcacuuugggaggccaaagcaggaggaucacuugaggucaggaguucaagaccagccuggcaaauauggugaaaccccgucucuacuaacaauacaaaaauuagcugggcgugguggugggugcuuguaaucccagcuacugggauugggaggcugaaguagaagaauugcuugaaccugggaggcggagguugcacugagucgagaucgugccacuuuacuccaaccugggcgacagagugagacuccgucuugaaaaaaaaugucugccuuguaaaagugaaauaggaugagaaagugccuuucuuauuaauugguguaaugaauuagaaauaaacucuuugaagacaccucuugguaaaaauaguuacauuuacuguugauuuaugguauguuggauauguuuuuaaguuuuccguguaauaacucaguucauucucaugagugaaauaggugcuuuuauugucuuuauagaugggaaacugagguauaggcaggcuagguacauuauuauggaguucguaaguaguggagcugaagucgcaucccagacaguuuggcuuccgugaguuuaccaaucucaugguaaagacuuugucagacuaucaaaguuuugacaaaugaaauauuagcaaaaggccaaaagggauucucuauuuucauuugaguaucuucaccugaaaauaguugccugaauaaguagccugcauagaaagguacauuuuagaaauacuugaggccagagaaugaaaagcuuacauaaaauugauuuccgguggggccuucaguuacucuccauucuacgaagaccacaaauagcauucaggcaaagagcauuuauuccaacaauggaggagcacuggauuugguuccuaaaacaaaauaaaguuugaaauccugucuuucccauguugaaaacaaaguugguacaaaacccuuuagcuuuugcaaaccuccuuuaagacccgauuuaaaugcuucccuccucaugaagcucuucuggauccacuccuucccaucacuaaguugaaaguaagauccccuucucuuuacuuccauuagacuuggauuacagcacucuuuguaucauguauuuaauucuguuuuuuaauuacaguuaacauuuauuugucuuccucuugaguguaugcuucucuagaggaaggucuuugauucauucuccccuggccuuaauucaucccacuuaauauggaaaaaauuuaauaaaugcugacuugaauaaguccaacaaggagaaugggaagcucauguuugcuuccugucuucuaaaagacuacuuaagauaacaggguaaucacagaaaagcauuagaaauagaguuauaugagaaacaacuguaguuaaggcuagguuuauguuagacugagaaauuuuagugcauacuuaaguuauuuaggccagguuacuuuuuguagaacaaacauuucaguuucgcucaguuucauuuccguuucugaggcagcugugauuuaagaaaaugcucuagucuguggcauuccauauucaaguacuuugaguuguauauuaauuuauuuuuguuaauaagagugacaugacucacuaaguaauuuagagauuuaaacacuuuuuuaaaaaacaguaacuucauaugcauuggaucuauucuucuauaaagucuuuucuugggggguguuuguuuaaaauuccccgguguuuucucugccaaauccaacuuccaagaagcauuuggaagucaaaacauuuuaucugguuagucuuaaaguccagauauuuugugauagcugguauuuaguuuaugauauuucccaggaagaacuuuuuaguaguugaaccauuuaugaaagacuuccuugaagcuaccuuagagaguugauuuaguucuucuaaauaaguaaauagaauauuaguauuaggacaucuuggaguauagaugcaaauauuggugaaaaagaacauggauaucagagucaaauuaauguagauuggaauucugguuauuacuaauggauaucugacauuaggcaaguugcugaucacucuuugccucaguuucaucaucuguaaaauagguauuuguguuuguguauaaugugaaccguauaauauaaugcuuggccuauagugaaauuuauucauacgaguguuuucagugauuuuaaaagcuugcuuuaggccgggcgcgauggcuucugccuauaauuccagcacuuugggaggccaaggugggcggaucaugaggucaggaguucgagaccagccugaccagcauggugaaaccccgucucuacuaaaaauacaaaaauuagcugggcgugguggugcaagccuguaaucccagcuacucaggaggcuuaggcagaagaaucgcuugaacccaggaggcagagauugcagugagccgagauggugccacugcacagagcgagacuccaucucaaaaaaacaaaacaaaacaaaacaaaaaucuugcuuuauaguuuacuuccacaucaaauugucuuuaucccauguuacuugcauugauaucccagacaugaaaagaaaaaaagaugauaacaaugacaguuauuaaauuagguuccacucuuauucuagaucaccaauucauauuacuauucagacuuggaacauuaaauuuuaguuaaacuuuuuuucaaauaugcauauaauugucagugguuacuauauuuuggggaagagauuguugacuucuuugaagaaagauacggauuuucucuucagaaaaaauacacaugggcucauauaauccaaauuuuauguguaauuacaggguguucaugaaugcccacaaauccauuaagccaugugaccuuggacaagucauuuuacuuuucuguuuuuuagguuguuggucuguaaaaugauacuacuugacuuuuaaagagcccuucaagcucuuauguccucuaaccccaggucuguauucagaagaaggggugguccuuuaauuagagccaucuagagaucugaggaacaugcugggcauuaguguaacauaccauguggauuuugagagguaaagaaaaaauaaccagggaaugccucagagcauuccugaucagaucgaugacagaagaaaggaaugagagggaggagaggaagcuguugaaauuuccuauuuaccugcuuugagugaaugaagauuugaaucauagaaccagaagggguucucaucugaaaugcaaaggaaggaggaguugguuuaauucaauaaguuucaguugaguaaacaugauuuagugagauacuguucuugcuucugacucaccauuuggaaaaucucucuaaaauaaaauuggacucuccaucucggacaucauuuuggguguagguuuugcuuuuuuuuuugagauggagucucguuauguugcccaggcuggagugcaguggcgcaaucucggcucacugcaacuuccgccucccagauucaagcaguucuccugccucaaccuccugaguagcugggacuacaggcguaugccaccauguccggcuaauuuuuguauuuuuuuaauagagacgggguuuuacuaugguggcuaggcuggucuuuaacuccugaccuugugaucugcccaccuuggcuucccagagugcugggauuacagaugugagccacagugcccggccuaaguuuuacuucuuauaauggacuccuguuaagccaauaggugaugaaaggaaaccauaaccaacucuucaggcucauucauccuucaagaauagcaugcuaguacccauccuaggaggagaauuggacuauaccucaugaggauaguuugaaguaucucagaagacccucacuggggguaggucgguaagacacaaagcuuucuaaagcacuguaccaaauuuguuguuugagagaucauaacaaauuagaaguggaaagaagaaggaguaaaaggaagaagagguuucuggccaggagcagggagggggaaggagcugcuaggaagauguuugguugucauaucccuguucacccuugcuuugcaaaauucuuguaggaugccagguugggaguaauuguuuuucacaagagucaaaccacgcuuguuuucuugaagaagcaagucuuuggagggugguggcuugaaaucuguuggaucugguauuuaggugauacacuuugacauaaaggcaacacugaugcaagcagcagcuuuccuuggaaaggcagggagaaagugaaggcccagacugaugagcuuacacugaccugcagacccuucuccauucccaggcauguuugguggcagaguuuaccuuaguugggguuaggcuguugucugguacugugagagagaaggaagaagaagauaugauauuaacaacaacaauacauauuuauauuugaaaauuaaaugcacuaauacaccuauagugcuauuaaacaaauuuauuuguucagcaaauguuuguuaaacaccauguacuguggaaaguacuaggugcuggacagaggucaaaagacuuuuaagaaucugccaccauuaaugaucucuuucugcuuggcauucaaggcucuuugaaauaagacugugacccacuuugauaguuuuguccuggauuauaagacacaugcucgaaggaacuauagcugguuuucucaccagacugauuaacauauaguaugguuugguaccuguuaaaugagucucucucuacagguuuucaucuucuacuuuaagaaccccuuccuggcauuguuuggcuccucauuguucuggaaucucauguccaucucauguauuugccuugguucacacuugaucuucugcucauauuccucaccuacugaaauuuuacccaucaaccagaccgugggugauggaacacagcaugggcuaguucuucuuauauaugaucucauuuaauuuucacuggaacucugagauagguagcauuucagcccacucaaguugacucaaauuuuuguaaucaucaauauauuuuaaaauaacuuuauauuugaccuguaauuggaaaaccaauaugaguuaucauaaaugaaagguaauuuuaaaaauaauuaggaugaagacaaauuauuuuucucacagucuauguauaagauaaacuauugguucccaaaggccccagcugacaaugagacuucucuuacuuuguugaaaagggaauuagcaagcauuaaagaggugucaaaaagaagacuaaacaaaagcuuacuccuuuuuuuuuuugagacgagucuugcucuguugcccaggcuggagugcaguggcaccaccucggcucacugcaaccucuuccuccuggguucaagcgauucuccugccucagccucccuaguagcugggauuacaggugcaugccaccacacccggcuaauuuuuguauuuuuagcagagaugggguucgucauguuggccaggcuggucuccaacuccugaccucaggugauccacccaccucggccucccaaagugcuagaaucacaggugugagccgccgcacccggccgcuuacuccuuaauguacuaagaauguuauauauaggcugaagaagugcugaaaagaaccauauuuucucaugaugugguucaauguuuaauacugugcuuguucaucuccuaaaauccucugaauaucacuuaaauucauccuguguaacucucccacauuuggggaaauacugagcuugccuauuauuauauuagccccauauuucagaugaugcaccugagccgaggagaaguuaaauaacuuguucaugguuccauauuuggcuaauggcagagccagggauucaaacucuugucucucugacucccagguuugugcuuuucccacuuggcugaauuucucaugcuaccuccuccauaacaccuuuccuagaacuuuuaaggaaugcuuccccuguucucucauagcauuuuaauguaaguugccaaagugucccaguuugcaccccuaccagcaaugugggagaaaauagcaacauauuuuugauguuggggucuaguguuacgguuucuucugcucuuugggauguauauuccauggcuacugaauacccaagucccaaacaguuuucuuagacucagaaggucauccacuucagcuucuucaucaaaaagacauauuuucuggcugggcacgguggcucacaccuguaaucacagcacuuugggagguggaggcaggagaauugcuugaacccaggaggcugaaguugcagugagcccagaucgugccacugcccuccagccugggugacagagcgaaacucugugucaagaaacaaaaaaaaggacuuguuuucuguuccauuacccacagugguagaauggcgugcuaaauuuauucuccagcugccauuaacugcaaauuaaaaucuuagucucuugccucuuuaauccaggcuucuucauacuauaccagaauuuaggauaacuauuacagugcccuuuauaggagagaaagaagaaauugugucuguagaugucuguuccuuucagcuuaaaauggacacugaaauguuaaauauuggacuggccucauuuauuucuccugucuguugguccaauuugaaucuuaaggcgucuuucaacuggaauuuuuuguuucucucaacuaaaaauuguucuuuguaaguuugaaucagaacaaaauccugaauguugaggguuuccuaaaggcuguuucuuuaugcaaaagccugaaacccgauguugauguuggcugcuuaaaauuaacugugaaucaaggcaggguuuuuauuuuuauuuuuuuuuuacuuuaaugauuguguuaauuauagugaaaaccuugaguucacgagaaagaaagccuuuggucaaguauuguuuauuaaguugucagucuuguugcaggauuugcaaauuuaguggaauuagugccauuuuucaguuuacaauuccagucacauuucacaugaucagagcauggcuuucuucucuguggagcaaauagagggcugucugacacuugguuccaguggcuuccauuaagcagaguggauaugucccuggagucugcagagaagggcauggcacucugaccccagauggcacuccguuuugggacauuguccaauucuaguucauagcauaugugaccaacaccagcucucaccugauguaaacacuuagcgcguuguugcuugggggauuggauugugugaauuuuucaaaacuacaguugacagaaggaggcuaccaaaaaugaaacccaauaauuccauuuuugggaauuauucccacuuuuguuccauuuuucccacuuuguucuuuggcacacagaauguuugauuugugaaaaucuuaauaacaguaguuuuuucuauaaggaacacucagaaucuugauaauauuggaauaauacagauccuuuuguaggauccucucagaccucauauaauagaguucauguagucaauauuuaaagaaaaacacccuuaaguuuuuguuuuucagaaucacaaguaaguggauuuaaacuugugaucuuauuccccuuucuucucuuaauuuagugaggcagccagcgagaggguuuguuuugguuauucuaaagaaggaguuugcuuguaaguuuuggagggcaagacuuagacucugugucucugugcuugcccuggaacuuugauuaaauugucacuaaccgaguuagcuggcccucgccgggcugcagaaauagaagugucuugcacacaugacauaugacugucucaagagcuggcuggugaaaggacguucuggagaaggcugccgauacuguaugaacuagaacuggacaagagccuggagauuggauaacucaguuuggcgcaaguaaagggaauaaaaguguuaagguggcaaaauuguauccagguguuuauaggcucccugaguuccugacuugagccuaucuauggguuuagaguucaaggcucuuuaccagugcugacaaucuuauacucuagguugaaccuccggggaaggugcccuugcuugauggcauguuuaccagggguucuagagccucaaucacagauucucucuagcucacaugaaguuaaugaaaaugaaugugcuucccuacaaauuagagaggcuuugaggaaaaaucagauuaaaugcacuccugcuugaacuuauguuucuuagaacacagcuggaaauuuugucacacaaaccuuuacuuucagugacauuucuugacugguuuguuacuguagugaaucugcuuuaacuaucuuuucuuaucgcugagguuuuacuuccauucuacaugugauuguggagcgcugcgucauuguggguucaguguaguggagaguaggaagauggugagacacaguagcuuguugcacauugcuuaauuuaucagggaucacugaugaguuaguacacuagagaagauuguagguagagcugaaaagauggaggaauuauaaggcucagauuucucucuuuuuuuuuuuuuuuaagauggaguuucacucuuguuguccaggcuggaauucaauggcaugaucucggcucacugcaaccucugccucccggguucaagugagacuugauggucucacuugaugguuuccuggcucagccuccugaguagcugagauuacaggcacccacuaccaugcccagcuacuuuuuuguauuuuuaguggagaugggguuuuaucauguugaccaggcuggucucgaacuucugaccucaggugaucaccugccucagccucccaaagugcagggauuacaggcaugagccacugcgucuggccaaggcucagauuucuaauagagauuucuaauggacauagaggcuggaggaaaugggauggacaggaaaacugagucaggugccaaaaacuuguagggggccgggugcgguggcucacgccuguaaucccagcacuuugggaggcugaggcggguggaucacgaggucaggagaucgagaccauccuggcuaacacggcgaaaccccgucucuacuaaaaauacaaaaaauuagccgggcguguuggcaggcggcugucgguagucccagcuacucgggaggcugaggcaggagaauggcgugaagccgggaggcggagcuugcagugagccgagaucgcgccacugcacuccagccugggcgacagagccagacuccaucuaaauaaauaaauagauaaauaaauaaaauaaaauaaaaacuuguagggagguggcagugugcuauggaggauaggugcaaccucugugagaauguagagaaaauaguauaagugaguggugaggacccccaagaggggguuuuauaguaaaacaauggucagaaguggcaacaggauaccguauaaugcuuucaccucuaccaaugcacuggguacuggagagcgcuccaguuugcucuggaaaggcccuuucuguggacaaagaauacagaaaagagauuccuuuaauaaaccacccacucugugucccacccuugaugaauacuucacugugaaauugccagaauuaaucaugguaauagcuacuguacacuuacuuuguuccaggaacuggauaaauguuuuacauacauuaucaguucuauuuuuuggagaagauacaggggcucagagucccuaggguuccagagcuggugaguagcagagucaggauucaaacccagcuuucucugacucuaaaaccuccuuucuuccugcugaaacaauuaacucaagacaacaaaggaguuaaggauuuggggaguuuucugcaugguagaauagacccaaaggaaaagaaagaaagacagugacuaagauuuggguuugucugccccaccaaaugcuuugagcacuuucauaaauauaaauccuucagguugggagaagguugaacaucugaagacacugauucuucagagauguaauccaaacaaagugaucuuuggugauauggucacuaaaccauuuaucccaaaauucucuuggaaaaccguccuauaacagcagggaacauuauccagccaaguuuuucugcaaauaaaggguugcugauagaggcuugccugcuuguguuucuguagcucaggguguuuaugaauucacuaaucccuucccuucagaucccuuuuauucugguguuaugauugugacugaaaaaaauugauuuuuuuucuaugacauagaauguugaaagguugauuucuuuucuagaggaaagauucuuuuuuucuaugugcuacauaccccccgaccagggaaaaggcaaauagugguauuguuugcugaagucuuccuuugaagguugcuugguguuugcuuaguggaaaucagcaggggaagagaggcuaucucuaacauuuuguuagaguuucuucguaguucuauagugaugaaacaaggacuugggguacaggacagaucugcuuucagaaauccuggcucuugugagguuuagaagcccugagaccauuuagcugguggcaacgggaauguugagggugauaaauaggaucuuugguuguccaaguaucagugacaugauauagauggaguuaaaccuuuaggaucuccuuauuuauuuguuuguuuauuuuugagacagggucuugcacuguagcccagguuggaguaugguggcaugaucauaacucacugcagccucaaacuccugggcucaagcgauccugcugccucagccucccaagguguuaggauuacaggcaugagccgccacacccggucaggaucuccuguaaaauuauauuguugacaacaugaagaauuaugcuucucaaaagcuaguuauagauuuguacaauauucauagauuucuuguuucaguuuuuacaaauucauagcccuuauuuugaaaauuagcuauuagcaauaauuuugucuaggaaauuggauguguauucaagugaaagaaggaaguacaguuaccuauuaucuuauuguaacuaacaaucaaguaagugugaugcauuugguacuuuaaaaacugcacccaaguuacagauuauuggaauuaauaaaauucacuggaucuauauauuuuuaaacggacagugugauagcagaaccucuuauagaaugauagaauuccucuggaaugauuggauaacuucauuucauccuugacuuuuaccuuggaggauuucuuaccccuuuuggcuucucaaauuugacuauuaaaauguugccuuuaaaaauaggaacacaguuucaggggggaguaccagcccaugacccuucugcaaggcccccuaacucaagguaguuucccuggaacugugguuuauggaauguuucaggagugugaggagguauaauuuaaggcuguccuagcaaggauacccuuaaggauagagggcccaguagcaucuggaggccagaaaaguuaaacugaggcagucagauuagcuucaggcucaauuaagcugaugggucagccugggagaaauugcaggaugacucucaauauccccucccacccccacagcagccacgaucugucugucuuuaaucaugggugcagugaaccuguucuuuccaggugucuuggccuucaguaaccuuguuaggcuugucccugaacguggcuaccgauccaaagacacaugaucagagaggcaauuagagaacagaccuuuuccaaagcaagcauguucuguugggcuuagaaguuucauguccuaauauuauaggacccugugcaucucucuggagaugaggcacaugagucauaucugugauucuugcuuuugugucaacaucucaugaauaggcaaucagagcuuuggcaccaauguauuuucaguucauaucugauguaguuaaauccaccuccugcuuuguaguuuacuggcaagcuguuuuugauauaagacaucuagaacacuguaaauauauaacauuuuuauuugucuauuauaccucaauuacgaaaaagacaucuagaagcaaccucaucaagagagauacugaggccgggcaugguagcucacacuugcaaucccauuacuuugggaggcugaggcagguagaucacuugaggucaagaguuugaaaccagccuggccaacauguugaaacccugucucuauuaaaaauacaaaaaaguuagcugggcuugguggugggcaccuguaaucccagcuacuccggaggcugaggcaggagaaucacuugaaccugggaggcagagguugcagugagcugagaucacaccacugcacuccaaccugggcaccagagugagauuacaucuaaaaaauaaaauaaaguaauaaaaaagagagauauugauagcuguuguuggaaauuucaacuuccaucucacuucugguaacuuuuuggaaguuuguugaacaaaguggaauacacgcacauacacacacacacauacucucuuguuuguuuaagguuuaaugaaauagcugucauauaaucacuguuuuugaaagaggagaauuaguugcuaucuguacauuuuggguaugugaacuauuuggauagaacucugagaaaugcauucagaacaacaaacaaaaucauaggagaaauagcuaagugggaaggggcauauaagaguuguugaaaaaguuauuucuugagaaaccagcucuaaugcuaggcaagucacuugcuuugggggaggccucagcuucucugucuauaagauugcagcagggguguagugggaaugagucuucaacauuccaagagauuuuaucuacuaauacgacagucaaauggagcaugacuuuguggaagccucuccucuuccacccagaggggccaauuucucugucccagugagauguugacacuuguaugaucccugcuuggagacuucccucuucuggaaccugcccuggcucaggcaugagggcugacugucacccuucgauaggagcccagcacuaaagcucauguguuggcaguguucuugcgggaaggaaaaagaccagccagcccauuuguuacugcacaagcaaacagcuucugguagcuguacagauacaugcacuuucuuuccucacuguguuuccauagacagauuuagugcuguagaagaguagagggcagucacgggaaggaguuccuguuuuucuuuuggcuaugccaaauggggaaaaauccuccuaucuugucuuuuuagugucauccucucuccccuuuucuucuucuuuauaauucucaucucucaucucuccuggaaaugugcaugucaaguucaaaagggcacaauguuuuggugaggaagaggugggagaacacgugccaggugcuaacuagggucaucauuucccccuucacagccagcuuccugugaauguguguguguguguguguguguguguguguguguguguguguguguauuucuuuugccagcaucacugaaucugucugcugucugguauuccagguuuugguuuagggaaaaguaaaaguaauuuuauaaucccagcugucauuuaagccaccccuuuguggguagcauaugguccacucucucaguucauuguccuaaagaugcuucaucagaaaggaauaacuuccaccccguuacucucuguccccuuacucugcuuuauuuuucuucgucaauccuaccaccaccacccacuguuugaacaacccacuauuauuugucuguuucccaucccugguagaauaggagccccaugaaugaaggaacuuugcuucuguuguucaccacugaaucucuaagguauggaacacaccuggcaugugauaggcacucgauaaauauuuguuguggcucaugggcaccuugcagaguuaaggcugcaguuguuuguggaauuuauaagugguaaugaauauuuaucuacuauuccucuuccaaggcgaucacacaauaaucaggcuuuacacuauccaguucuuaggucuuccaaguuaugacuugugagguauguuaauuaugauaauagaaggcaguuuauuugguucagauuuauugauguguaauuuaccacaguaagacuuccccuuuacaaaaguaugaugaguuuugacaaauggauacacauguguaucuaccacugccaugcuccuuuucagucugucguccccuccacccaugaccacuggucaccacugcagugauuucuguccccuucauuucaccuuuuccagaaugucauauaaauggaaucaugcaguauguaguuuuuugugucuggcuuauuuuucuuagcauuaggcuuuugggauucauccagguugucgcauguaacaguagcuuauuccuuuuuauggcugaguaagugucccaguuuuauuuauauauuuauuuaugaggaggugucucacucugucacccaggcuggagugcgguagcgcgaucucagcucacugcaaccuccgccucccagguucaagcaauucuccugccuccugaguagcugggauuacaggcacccaccgccacgcccaacuaauuuuuauauuuuuaguagagaugggguuucaccauguuggccaggcugaucucaaacucuugaccucaggugauccgcccaccucuggcucccaaagugcuaggauuacaggcaugagccacugugcccagccccaguuuuauuuauucaccaguugauggucuuuucgacaacuaauuguuuccaguuuuuggcuauucuguauaaggcuucuauaaauauucacaaauaccuaggaugggaugacugggucauauaauaguacuguauaaccuuagcagaaacugucaaacuauuuuccaaaguggcucuuccauuuuacaauuccacaguguauugagucccagugucuccauacacaugcuagcacuuuuaauauuuaauuuaguggguauguaaugauaucucauugugguuuuaauuugcauuucucugcagcuaaugaugaguguuucugcuuauuugggaagguuuuaauuuagcagucuguuguauucuguagauauuaauaacuucaaaauaucaguggcauuugcaguuaaaauuuccuuaaaaaauuggccaaagguuuccagcagucacuucugccaugcccaaacuguaugaaacaaggcugagguguggagauugucacauuuuggcaaggagugauccacuugggugacugaugagacccagagagcguacgccucgggcuugagggugaggacgggcgggaagucgacugcauggcccugcuggccuugggaggcugcccaguccuuagcuaaagcuggcaguuaugggaaacagacuuagauucuauuacguuuuucaggaugucccaggagucaccugggaagcucagcaguccuuugugacuuucaagcauaugguagaagcugcugaacacagagcucccucuuuggggauaauuugcccaaaucauuuaaucaggcuugagaaaugaguuaccacagguccaggagugcugccacccuugaauucugacacccuauuucuccuauccgucucuuaauuaauuaagcagacauccccaagugcuuacgacaagccaggacccuuuugcauacuaaggaaaacagggaugaaggaaacagaaauggucucugcucugacucagaagguagaaauccucuuucccagccaagucuuccuagggagcacguaggaagggcucugaacccacgugucaguugcaggggaggauaucaggaaaggacauugaagaaguggagaccuaaguuugagaccuaggcauuagccaggcuagcagugcuugaaaaagugucuuaggacaagagaacucaccagugaagucccagugguaggagagcgugcagcauauucugagccuguauacacaucuccagggcauugcuuagcagguggggaguggcaagagaguaggcuggagucacagaagggaggccagguagaccuuggugagcacuggacucuauguucaggugcugaggagcuggcaaaagguuuuaagucggggagaggcauguucagauauuuggucuagcugaguaacuuugggugcucugugacaaaugguugggagaccagugagguggcaguugcggucaucuaggagcaggaucagaguggccuauugacugggaugacugugaagugggauccuuuccagccaguaacuggaaauguguaugagggcagaagugaguguacugcauuugaaacauugagaaaucuaguacauaguacugucucuuuuauaucuuuuuuuuuuuuuuuuuugauuuugguuuguuuguucacuaacuuggaaaacugauguggaaaugucccuuuggcuucaguuaccugagcagaaggggccgggcauugccaaacucuccucuuaggacagaauugcucccaguauugaucauuguguucugaguugggggagcaaauugugcaggaggccaggucagugccaaggugggugggaggaauuggagcaggaagcuugccuaagugugcccagcaaagccacgguagaacuuucuacuguggcucuaugcuacuucuuagcaaccuucuccaugugcuuccuggagaguccuuggagucagaaccuuuuucuugaaacccagacacuuuacuuccaagaaaaugcuguccaagaaaacucauccuucccuucuucucaugaacguuguguagaggugugucuucucuuccuuugagcuuuuccacucaggguuuaggggaggugauauucuauauuuggguuuggcucuggguacugcaacacuaggcuauuaagauuucauccuuacugcuuugccccuccuaucuuuccagaaacccacaauggauuugcuagaaauaauggaacguccuguuuggacaggauauaaccauuucucagcuagaggauauuguuggaaugaagaaagauaaauggggagaagggaacucacauugcuuuggcacuuaaauuaagccauguacuguguugggaaauuauuuauauuaucucguugaauccacaguagaacacaguugaacaccauacaagguaaguauugucauccuuauuuuaccaugaggaaauugaugcuuagagagcauaaagccuuggccaggggcacauaguugggaagccggggcuaauucaugccugggcucuuucugauaguuuuccuuuuuuaauuguccccuccucauuguuaccuuggggauuucaagagauucauguagcuucuaaaucaacgaacugauuccuggagagcagcuucuguaugagaaaaaucuagcuaauuauuuauuucagugucucuggaaugcaagcucuguccugagccacuuagaaaacaauuugggaugacaagcaugugucucacaaugcugcucugguugccagugcugugcugccaguugucaucuuugaacaaacugaugcagugcugguuuaacucuuccucuuuuuggaguaagaaacuuuggaggccuguguccuucuagaaguuugcugagcaaaugguaaggaaaagaaauagguccuaaggcuugacuauuucagagaauuucuugauuuauuggacugucaaugaaugaauuggaauacauagugguaggcugucuuuucuucucagacacugcaauuuccuccaaucucuugacuuuucuagaaguuuuaauccaaguccuuguugggugguagauaaaaggguauuguucuacuagagacugaccuuggcauggagaucucauuuggacucacagauuucuagucuagcgcuugguuuuguauccauaccucgcuacugcauucuuaguuccuucugcuccuuguuccucaugcccagugucccacccuacccuugccccuacuccucuagaggccacagugauucacugagccauuucauaagcacagcuaggagaguucauggcuaccaagugccagcagggccgaauuuucaccuguguguccucccuuccauuuuucaucuucugcccccuccccagcuuuaacuuuaauauaacuacuugggacuauuccagcauuaaauaaggguaacugcuggauggguggcugggauacacagaauguaguaucccuuguucacgagaagaccuucuugcccuagcauggcaaacaguccuccaaggaggcaccugugacacccaacggaguaggggggcgguguguucaggugcagguggaacaaggccagaagugugcauaugugcugaccaugggagcuuguuugucgguuucacaguugaugcccugagccugccauagcagacuuguuucuccaugggaugcuguuuucuuuccagagacacagcgcuaggguuguccucauuaccugagagccaggugucgguagcauuuucuugguguuuacucacacucaucuaaggcacguugugguuuuccagauuaggaaacugcuuuauugauggugcuuuuuuuuuuuuuuuuugagacagagucucgcucugucgccaugcuggaguguaguggcacaaucuuggcucacugcaccuccgccugccagguucagcgauucuccugccucagccucccaaguagcugggacuacaggugccugccaccaugcccagcuaauuuuuguauuuuuaguagagacgggguuucaccguauuggcuaggauggucucgauuucuugaccucgugauccgccugccucggccucccaaagugcugggauuauaggcuugagccaccacgccuggccgauggugcuuuuuaucauuugaaggacucaguuguauaacccacugaaaauuaguauguaaggaaguucagggaauaguauaagucacuccaggcuugaggcaaaauuuacaaaugcugcugacuuuguauguaaggggaggcauuuucuuagaaaagagagguaggucucugggauuccaguaugccauuuccauccucaguguuuuuggccaccugagagaggucuauuuucagaaaugcauucuucauucccagaugauaacaucuauagaacuaaaaugauuaggaccauaacacguagcuccuagccugcugucggaacaccucccgagucccucuuugugggugaacccagaggcugggagcuggugacucaugauccauugagaagcagucaugaugcagagcuguguguuggaggucucagcugagagggcuggauuagcaguccucauugguguauggcuuugcagcaauaacugauggcuguuuccccuccugcuuuaucuuucaguuaaugaccagccacggcgucccugcugugagcucuggccgcugccuuccagggcucccgagccacacgcugggggugcuggcugagggaacauggcuuguuggccucagcugagguugcugcuguggaagaaccucacuuucagaagaagacaaacaguaagcuuggguuuuucagcagcgggggguucucucauuuuuucuuugugguuuugaguuggggauuggaggagggagggagggaaggaagcuguguugguuuucacacagggauugauggaaucuggcucuuauggacacaggacugugugguccggauauggcauguggcuuaucauagagggcagauuugcagccagguagaaauaguagcuuugguuugugcuacugcccaggcaugaguucugaucccuaggaccuggcuccgaaucgccccugagcaccccacuuuuuccuuuugcugcagcccugggagccaccuggcucuccaaaagccccuaaugggccccuguauuucuggaagcugugggugaagugaguuaguggccccacucuuagagaucaauacuggguaucuuggugucaaucuggauucuuuccuucaggccuggaggaauauaauaacugagacuuguuuuauuucugcagaggguucuaagccauucacuucccagaugggccaauaaugcuuugaguaaucuggagaucaucuuuaaugcgcaggugaauggaacucuuccacagagggaugugagggcuguagagcagagugaacucccugaaacucagacgucagcucuuugucucucuaucucugaacacccuuccuuagagaucccaucucuaggaugcauuucucuguaguuaguuucuaagucucuuguuccuguucugccuuuauuuuuuuuuccuggauucuaagccaguauccccacuuggcugucuuaauguagcuuaacaugucuguaaucaaaaugaucaucuuucugagauucaaagggcuauaagggacuuuggagagaauuucauucaguuuuccucaaacuagaauaaugcuugcacugucuguaaaagaacaaaagugucaaagcauccuuuuguucacuaaauuuccuuuuuuauuauaguguuacuuaaauauuaggaaguaaaaguagguauaaacuucuuauaggcuguuauuauacaacuauaugacccauacauauuuacaaauuaagugcagccaaaauugcaaaaucaauaccauucaaauuaauaccuuaaauguggugaggcagcuguuguucaacugaaaccaaauuauaaguugcauggcaguaaaugcuaucaugcugaucauuuugaguuuggccagucuauauuaucaugugcuaaugauugaauucuccacccauuuuucuacuuguaugaccuuaauuugauggcaccuguuccauccucaugaguuugcuacaauuauacuggugccaacacaaucauaaacacaaauauaaacuugggcuuugaaaucuugugccagaacuuggcuuuaaaguaagcauuuaaaaaauccauauguguuuauuagacuuuguuuagaugacuguugaaaugaaaacaaaguguuuaaaauccucuuagagaacuuaaauauaaucccucagcaauauguauacagaucuuccuuugagaaaaacugauuguguucagccucucauguuacaaauggggaaccugaauucugaggucucuagugagagaacagggacuggaaucuguggauccuaucuguuuuaauaauaauuguaaaguauaauagauaauauuauauuaauaaaauaaaagcaaacacuuagaaugagcuuccaugugugaggcacuaacugauuaggcauuauuaacuagauuuauuccuuuuaaggccccgcgauguacuguuauuuccacauguuguagcuggggaacgugcuacucagagagguuaaguaacuugucugagguccacaccacuaacaaggagcacagguaggguucaaauccagauaaucugacuuuggagcuggcacucuaacucaaugugccuaaucgcuuuucaguggugucauuauuuugccuauucuccaucugagaauauugaaguuucugacuccuuccuugccuuucucccugccucccgugguuauccccaggucuugguguuccaguccucuauguccguccuuacucuuauuccuuugcuacagugugauccagggcuccugccccuucuuauccugguagagggggcccacuugcugggaaauugucuccgccaugguuuauccauguuguguguccauuagugaguagugggaagaaucauaucauguuggcaaugaaaggggggcuauggcucugggguagucuagucugaaccucuuauuuuacggaugagaaagcugagguacaaagcagggaagggauuucuugaggucacccagccagcaacugagcugcaaccagaagcugagauccccaggacuagggccgagccucauucugucccaucacagugacuuuucuucccuccuccaaacuauuuuuauuuuuuauuuuuuugcagcugcuuagcagcuugaaguuagaagaaagggcagggaaaagguuuuccgugcuuagccagggaaggaauccugcaacaggaugugggguugggucauucaaauugggccagacuccacuggucuuguugcuucuugcuugguauugcagauggguuuaaaaguguuaggauuagagagauaggcagguuuagccaaaggcaguuuguagccuuguggcagaguucuuuuuaaagaaggaagugggaugcaacacccugacacaaaggggcuuaaguuguuauaccacugccugcuaaccuguuuuccuuaacucucuuccugauuucuaaaggaaguauauuuugcugaaucagaaagaaaagugauuuauuucagguugcugaugcuuagauuguuagaguuggaaagaucuggcuugcaucuuguacagcugacagaacuggggcucaggggggcacaggugcccagaguuggucagucaggaaaguagcaccagaaccagucuccugguggcccuacaguugcagacccuuuuuugcuuugcucucuguguauacuaaagcuucuaugucucugaaucucaaguucugacugguagcuacuuuccaauccaccuggcuuagauuucuagauuauauuguuuagacgucagaaccucuuaaggguuuuggggccacuuguuagcucacauagugagaaccagcccugcccauuagguaggggaagaaguuagcaguccaugauagcuguugccugcagcguauggauguucauugcacaguuccugucuccugagauccuggaguguauacgcuuggccucagagcccagcacagagccuggcccuugggacaugcuuaguaaguauuuacugaaugagugggaaaugucuuaaggcccauuaguuugcaggucuugaggaggcucccuugcacuaggaagaauagaaagcauacauaaagccugugugcugccgccaggaagacuagaaacgcuauguucagccuggagcugaaugguauaccccagagcaacccuguugaaaggcagugcuugccuuuucauucuguguccugguuugcugguaacuccuggguccccugccucuccuguacccccauugugcagacugaggggggaccaucagccaggguuaguuuuccgcuguuucuguuaggcaaagaauaaauugaauugaguugugaaaguugggugcaaagcucaguuuggguccaaaguaacaguuaacuuguguggguggcagguauucaguacaaacagggcuggggacaggaaggggaagagaacuucagagcuuucacgauccucaucugguuuuaggcugauccagaggccaagguccccauggaacaaacuggacaaagugaggguggccacauggccucuuuucuuuugccuuuauuauuaauuuucucaaauagaucugacuagucauguggcugggaaaauaguuaauugugauuuuuuuuuuuuuaaacugagucucacucuauugcccaggcuggagugcagugguaugaucucagcucgccgcaaccucugccucccgggaucaagcaauugucaugccucagccucccggguagcugggauuaugggcacacagcaccacgccuggcuaauuuuuguauuuuuaguagagacaugguuuuagcauguuggccaggcuggucuugaacuccugaccucaagugauccacccaccucagccuuccaaucugcugggauuacaggcaugagccacugcacccagccagaguaccacuauuugggcauucuuuaaugaaaaagaaugaacuauccaaaaauuaaaacuccucauuuaugagcuuuuagagaauuuuacagaguagauggaaacucucugcauccuuuccccacuucuaguuucaccugacacauuucuucccuguccuuacuccugggccggcagcaguggucaugauuccaaucccagcuuggccaccaucugccucaguggccuaggaaaacuccuuucuccagagcuuuaguuuucucuucuacggaaugaagaaaguuaaaacaaauagacauuuauuguuucauuuggauaaauaucuauuaagcaucuauuacuugugguaugguuagcuggguauauaguggugaagcagcugggcaugaguacugcuuucguagagcuuacaguucagugaggccagcagaugugaaacauaucaucacacaaauaaaaauauaacuaucaacugugaugaggauuaugaaggaaaaaauccggcaaacuaugguacugguguuagauacuagcagguguggguagggauuucauuuagauugacagguugucacauuaaagcugagagcccugaaguucaagcaaugguuagccaggcaaagaucagaggcuuagagauagggaaauccauuccaggcagagagacugggggugccuguccccuaggucagggaacagaagaaagccaguggcacugguggagugaauaagacuggcgggggaugaguugguaguagacaugaccagaucauuuagggccaauucuccuggggaaggagaauuuaauuuaauauuuauuuauuuauuuauuuauuuauuuauuuauuuauuuauuuauuuuucaagacggagucuaguucugucgcccaggcuggagugcaguggagcaaucucggcucacugcaacuuuugccuccugguuucaagcgauucuccugccucagccuccuaguagcugggauuacagacgcccaccaccaugcccagcuaauuuuuguauuuuuauagagaugcgguuucaccauauuggccaggcuggucugaaacuccugaccuugugauccuccuaccucggcuucccaaagugcugggauuacaggcgugacccacagugcccccugagaauuuaauuuuauuuuaugugcaagaggauucccugagguagucaggccacauugucuggugacucuugggauagagggaacuugaaugacaaaggcccaagaaagcaauuguaaucauuacauauacauggaccauuuuaugcuguuuucuucuuucauuuaacauuauuuagugugcguguucacauauuucuaaaucaucuucugauuuagaauaaugauuucugauguguaggcuguguuuuauaguuuugaaaguaauacuuugauauccauuacuuucuugauucucacagcaauucugagguguaugcguugcaauuucuguuucacagaugaagagaguauuguuaauaaguuaauggccgggcaugguggcucacaccuauaauuccagcacuuugggagaccaaggugggcggaucacuugaggccaggaauuugagaccagccuggucaauguggugacacccaucucuacuaaaaauacaaaaauuagccaggcgugguagcacuugccuguaaucccagcuauuugggagggugaggcaggagaauuugcuugaaccuggcagguggaaguugcagugagccaagauugcaccacuguacuccugccugggugacagagcgagacucugucucaaaaaauaaaaaguugcuaagaggagggcugggaucuuuuggcuccaaaucuacugugggaugaugccuuugacauuccugauagcugugcaguaauccauuaacacaguuuuuauaaguucaaacccuguugccaacauuuagauuguuccaugugugcuguuacaaauaaauuacuauaaagauucuauacauuuaaucuuuuauuauuuuuguauuauuucuguaggccaaaaucugaggaacaggauuacuagguugaagggaaauggcccuugaagugucugaucagaugucuuuccagaggauccaaccaauuuaaauagccaccaucaaugcaugagacuuuguaguucagggaaggcaggccugguuuuaaaaaucauuuccccucucuagcauuuuucugaugugauccuuaagauuucacuuuaguuuucccaggucucauuggcauguaugcuguuagggaugggucuaaaauuaauuuuucuucacauucauaucaugucaucccagugauuauuuaauaaauaaucacuugauuaaauagugauuccuuuucuaguuauuuuugggacauuuauuaaaaccuggauaugguggcucaugccuguauucccagcacuuugggaggcugagguggggggauugcuugagacuaggaguucaacaccagccugggcagcauagcaagacuccaucucuauaaaaauaaggaaauuagucaggcauggugguacuugccuggagucccagcuacuuggaaggcugagguaggagaauugcuugaguccagguggucaaggcugcagugagcuaugaccauacuacuguacuccagccugggcaacagagugaaacucugucugaaaaaaaaaaaaaaaaaaaaaaaaaaaaaaaaaaaaagauguguagggagcaauuuuggaguuauucauuuggucauuugauauguaguuuuaguuuuggugcugauagagcccagaauguacccugaauuugaugaacauucugauauaugggggagcucauugucccccacuuaccuuuuugccucucagaauaucuuuugauauuuuuaucuguuuuuuccccauugaauguuauuaccuuaucaagcucaaaaaaguacccuaucgcuauuuuaaguucaguuguguuaaaucuauaaauuagcuugggaaauuuggauauuaaaugaacucaugaagaagcagaguuuagcucuccuuaauucucaucuuccuuuauuuauccuacuacaguucugugguuuucuuuuauguaagaagcacauguuuggcuaaguuaaugccuagguuuuuuuguuuauguguccauucucacuguggauaguauucucuuuuccccacauuauauuaauuuaacugguuuucagagacuaauagcaaugcuauuauuuaggagaauuuaccuugguucugauuaacuuacccauacuugcaaaucauuugcagcuuuuuaguuaacuuugugaguucucuuagauuuacgaccaugccagaaacagaaaggauauuuucaucucuuccuuucugauguuuauucuucuuguuuccuuuuuuuaucccccauuauauucucaagaaucucucaauacuaagaaauagcgacuucauuuuucagcgcggagugcauuauuuuggcuaccaugauucagaagccucuugccuaaggcccaauuuuauucugcuaguuuucucuguucuuuguacauggcccuugcgcugcccuaaccuugaauuaacguggcuaaaucucaagaauuuaagagcaccgugacuguguccucaggcuagggagggaaauggguucacagagugacuggauuguggucuaugaacuucggcagccagcagcaaaagucaggcaugaauaaucaaguggacagugaacaucuguagugugggagauguuggcauaacuaugaaugaugauucaagagugguuugaugcauauugaauaacaugaugauaaguacuagacucugugcuaagccuucuaugugaaauacauuuaauucucauaauaacucuagagcagugguucucgaccggggccgguuaucccccuaccccaccccacccucacccuuccaccagggacauaacaucuggagauauuuuugguugucacaauccugggaauguaugugcugauauuuagagguugaggucagggaugcugcugaacuucguagaauucauaggagagucucucacaacaccuaucuggccccaaaugucaguagggucacuaucaagaaaaucugcucuagcagugccugcucauauuauccccauguugaaauagcaagaugggaagugcaaaguggugcuucgguacucuuggagcagcuuugacuuuggugagaaacgccuuuuaaaaacaauguuucuucccaucuucccaccccauggggaggugugggguuggguggguaggcaccaaagcaagauuuagaagaguuuucuguaggaauuuauaaugguaaaggaucaacuucauuuccaagcuauuuaugaggguuuauguuuaggaaaagugcuaagcuuagagaaggaggagaaaucugauuuuauuaaugaguguagccauaauggcauauccuggcagaagucaacuuugguuucuagagggaggcuauuaugaaaagaaauaccuggaacauuccccuggguuuggaaggugaguucuagguucaaugaugggaagaauuuuagagguccaagauaaaagggcaaagauuaaauuuugucucucaugaguucucuggcucagguggugugaacuuugcagacagucucuuuaauucacucauacaugcuagucucccagcucagcaagggcuuugagagagcaggugucuguaugcucugguaagugaaggcaaagugcauaaggagguugggguccauaauggcgaagagaaggagcccuucagucagaguggcuuugaaucuuggcucugccauuugccaaucuuggaccauugggcaguguauuaacucuuugaaucucagcuuccucuucuguaaaauguguauaacaagaguacuaauuggauuguuugaugauuaaaugaguuaauguguauaaagcacucacaacccugguacauaguaagaccuuucauuauuauuaucaucaucaauuuuuuuuaaccucuuuuccugaucugcuuacacucaccagcuucagcugcuccaaauggcuuguaagauuuuuuguuugcccuuugcugucaguugccauggggaagauccauucauuuuuuucagucaaccaacauauuuugagcaucugcugcccuacaggauccuagauaugggggcugcagagauauccaggaacauaagccuugauuaauugggucagaucagugcucagcagggcuggcaagugcuagguuucuuuuaaguggcauaucuuaaaagguauauguccuaaacauagcuuugugauggcagcaugauggguacaaaagcacacacuuaagugucaguagaucuggguucaaacauuggugcaguuucuuauggcucguaacuuguucaaaccucaguuucuucacuucuaaaacgguaaugauacaaccuaccucacaggguuauuaugaauuaaauacuggagaugagauacacaaaacgucuugaguacacaguagcugcccaauauuggcuguaaguauuauaaaucuacaagcugugaauuaauuuuaccucucuggauccuguugauauuucuagaccauuccaccuaguggggccauuuccuaccugagucacccguggugucaaauagaaugucauguggccuccugaguuggguagaauuggcugcucaucucaaccccgcuacugacuaucucugugauuuacccuuccuccagccuuagccuugcuacauauaaaaucaagacaauaauguuuccuaucucacaggguuguccugaggauuaaauuaaguaauuaauauaaaaugugccuuguacauauugggcccuaaauaaacaguagcuacuauuuauccuuaaaguacaaaugguaguuucagagcuucaaggcugauggcuauuuaucuuacucauacucuuuguuuagcuucauuuuuuuccccuaauuucauuaguauuuucuuuucuuuuuuuuuuuuuuuuuuuuuuuuuuuuuuugaggugaagucucacucuguugcccaggcuggagugcaauggagcgaucuuggcucaccccaaccucugucuccuggguucaaacaguucuccugccucagccucccgaguagcugggauuacaggcucccgccaccaugcccagcuauuuuuuuguauuuucaguagagaugggguuucacccuuuugaccaggcuggucuugaacuccugaccucaugaucaacccaccucagccucccaaagugcugggauuacaggugugagccaccacgcccggccucauaaguauuuucuaaauuuauuuacagucaugccauuuaaaaggaaaguuguauuccugucuuuguuaauauuuauaagugauuuuauucagcuacaagcuuggaauggcauauaauuuuguauucugcuuuuuucacuuaauauuacauggcuaaugauuucuguguuucauaaacauuauucugaugauggcaugauauauuguugaguacauguaccauaauugaaucauuucccuauugcuaugcaauuaaguuguuuccaauauuuugcaauuauaauguuucaaugaaugaauaacuuuaugcauauagcuuuuugauaucuuaaguucaguuuccuaggaugaauuuccaggaauaguaauugggcaaaugggauaaacaugacucuugaauacguauuguuaacauugcuuucccaaagggcucaacugauuuauauuuccguguucauuaucuuuuaaaccagcucauuuacucaccaaacauuuuuaaagccauuaucaugugguaggcuuaguaagaagaaagugacccuaagggagaagcuuauauauaaauagggucccugguguaccaagugcugauacagacacaaaguaccuggggaaauugagaugagggaguccuggcucagcugggagaaaaguucauuuucauagagucaugguuuuguucuuuggcagaaagaaaauugcuuucuuccccacccccacccccagcuuuauugagguauaauugacaaauaaaaauuguauaucuuuaagauaugcaaugugauauauauguauaucucaacuuaaaaaauaagcuacagaauaaaaagguguuugcuauuaaaaaaaaagaaaaggcugaaugucauucccaagcuuggaaauuugaguauguugccucuuugggauuauuuacagaaauauuagcaagaccagccccaucuuuggucuugaguacuccacugucagcaugcuuucuuccagagagggauccauuugccuuuauuuuucauucuguugugccgucuaugcaaacuauucuugauaguuuuaugguaacaguguuuuuuuguuccaugagauaauuuauacaugcucauuguggaaaauuuagaaaagacaggaaaguauuaaaaacaucacuuuuuuuuuuuuuuuuuuuuuuuuuuuuuuaagagacagagucuugcucugucgcccaggccggagugcaguggcgugaucucagcucacagcaaccuccgcuucccagguuuaagugauucuccugccucagccucccaaguagcugggaguacaggcaugcaccaccacgcccggcuaauuuuguauuuuuaguagagaugggguuucaccauguuggccaggcuggucucaaacuccugaccucaggugauccgccugccuuggccucgcaaaguucugggauuauaggcaggagccacugcgccagccacaccuacguucuuaucauccuaguacauccacugucauuaucuugcuguauuuccuucugcccagucucacucugaucaugcaguggcgugaucaugcagugaucucggcucacugcaaccuaggccuucuggguucgagugauucuccugccuuagccuccuggguucaagugauucucuugccuuggccucccaaguagcugggauuacaggcauacacccccaugcccaucuaauuuuuguauuuuuaguagacacagcguuucacuaaaauuuuguauuuuuaguagagaugggguuucaccauguuggccaggcuggucuccaacuccugaccucaggugauccgccugccuuggccucacaaagugauuacaggcaugagccacugcauccaucgccaaaaagauuuuuuaaaagaguuuaauguagaaccauaucaaaggucuuuggaaauaaaaaacaguuuuuuaaaaauaucagaaauaaaacaacaaauaaauaaauaaauaaaaacacccaaaacaaucugaagcacgagcaccuagcagaaagguucaauuaugaucuauucauagaguggaauaucaaguagacauuacaggacauguuuuaagauuauauuuuaugucaugggaaaugcucucccaguaugauguuaaaugaaaaaacagaauacaaaaguauauaugcugcauagucucaauauuguagagaaaaaauauuauuuauguaugcaugaaaaaagacaaaagauguuaacagagauccauuguuacuucaguuuacuagggauugucucugggagguaggauuaaggugauuuauauuuaccuuuuuaaacuuuucuguauuuuuuuauuuucaaauuuuccauaaaaauauaaggacuugaagaucaagaaaaaauuucugcuuuggcucagugcaguggcucacgccuguaaucccagcaguuugggagcccuaggggagaggaucacuugaacccaagaguuugacguuccagugagcuaugaucuccggaucguaccgccuggacgauggagcaagacccugucucaaaaaaaaaaaucuuugcuuuuuuuuuuuguuuguuuuugagacggagucucucucuguugccccagcuggaguacaguggcacaaucucagcucaccgcaaccucugccuccuggguucaagcgauucucuugccucagccucccaaguaccugggauuccaugcacccaccacuaugcccagcuacuuuuuuguauuuucaguagagacaggguuucaccauguuggccaggcuggucucgaauuccugaccucagcugauccaccggccuuggccucccaaagugcugggauuacaggcaugagccacugugcccagcccaaucuuuugcuuuuuuuaaaaaaagaagacaaaaagggauuuuauaccaguauuaucuuggcugugugacucugaagccacaguuguaaguuauaauuacucugaaacacaaggcccugugacucuuuugggcucuuugguguuuaucuugauuacaacguuggaauauagaaaugaaaggaaugggagaggugauagacuucaggcaguguaacuaguugucugaacacuacuggcucaauuauauugugucuagugauuuccaucuuguccgucugcuaauuuaucgccugguaacucacugaggcaggguuuuccuuuggagaaaccucauuguuuuaaccaguguaucaugcuuguuuagaaguucaaugaucuuuuuaacucaucggagaagaugaugaccagaccuggacagauggggaaggacuuugcacucucucuuuacaguccugagugcacacaggucaauauggaacuaugugugaauuuucauugucuuugagagcccucuucucugccccauagggagcagcuuugugugcaauuagaggagcaaggguuguguguauuuagcacagcagguuggccugguccucuccucucaacauagucaccacauaccuggcacuaugcuaaggcugggaaugcagacagaugggugccugcuuucagagugcucaaugugcugaggaagccagcaacagaaacagaugauuucaggagcuccaggaaaaugcuacaggaggagugugccuggguuacuggaguagcacaggaggagggcuucuagcucaggcugagauuuuaguaaaggaaauuaugccacgaugaauccugaagaaugaauagaagugaaccagauaaagcacgauaggaagcaucuucccuuaccuaagggaagacacagagguauauggaaugguauguuaaaagguugggacuccaaacaguucuguuaaagcuuagagaguggugggagagacuggagaaguugauuaauuaguaaaugaaguugucuguggauuucccagaucccaguggcauuggauauccauauuauuuuuaaauuuacaguguucuaucuuauuucccacucagugucagcugcugcuggaaguggccuggccucuauuuaucuuccugauccugaucucuguucggcugagcuacccacccuaugaacaacaugaauguaaguaacuguggauguugccugagacucaccaauggcagggaaaauccaggcaauuaacgugggcuaaauuggacuuuuccaaagaugcugucuuugggaaacaucacacaugcuuuggaucagaaaaccuaggcuucuaauuuguugauaaggcaugaacucaggagacuguuuucaguccuagugaauggugauaauuguaauuauaacaguagacaacaucucuuuuacacauuuuaaaucaugaaaauagaauaaccuuacugauaauuuuagaaaguggugauuaaaagcacauuuaagauaaugccuuaacaccuagucuuuuccauaugcaugaugucuuaaucacacauugcaaaucauggaacacagaauuuuaagcagcauuuguguagaacuucucaguuuuacuaauauuauuuuauuuuauucucauaacaaccuugaauagaacucagaucaucugucaaucauguauuuugauaacagccuuuacagugagcauagaaaauacaguaguggcuaacaacacaggcuccagaugucagguuaucuggguaugaauucuggugucagcauucacuaagcauaugaccuuggacaagugauuuaaguuucuuuuaaacagagaauaguaauaccuaccucauauuauuauugucaguguaucaucuuacaaucacagucuuucucuuagggcugggcucaguggguggauugacacugcagaaauggccagaucuaaaggaucaacauuuacguagcugggaaauguagcugggacuucaguuucacugcccuagugauuuuuccuaccacuaagcagcucaguccauaccccuacgagacccacaagcuuaugagauacuguucuuccaggaaagcaguggggccagggccaccuuuuaauuguguuucuuggccuggucccaucuuucucacaauauauagcaacaguuauuuacuugcugauuuucuaaugcacaucacacauagucauauuaaacacacacacacacacacacacacacacacaccccucaagaaacauuuucugagacgugauuuccugauuucaucaaaaaagaaaagagcgggccaggcacagugggaagucaagguggguggaucacuugaggucaggaguuugaaaccagccuggccaacacgguggaaccucgucucuacuaaaaauacaaaaauuagccaggcgugguggcgcacaccuguaaucccagcuacuggggaggcugaggcaggagaauugcuucaaccugcgaggcugagguugcagugagccgagauugcgccauugcacuccagccugggcaacagagugagacucugucucaaaaaaaaaaaaaaaaaaaaaagcauaaacugaaauuuauaugcaauuuauaugccugugagauaauucuguuuucucuuuuggaaccccaaagagauuuuuuugauugaugagcaaauacauuuuagauuuuauuuaagcauuaugccaagcaccacugaaguauaaguuucaagggcaaacucaguuuuuucaucuacuagacgaaugauuuucuggaaugauuacaagcaggcaagaugguguaguggaaauagcaaaugucuucggcaucagacaaguugggguuuguuuguauccugccucugcccuucaccgagguugugaucuugggcagauuguugaguuuuaaccuagauuccucugacuccagaucauaaauuuucagaaaaguucugaaauucuuguauauacugaugguaaaugagacuuuuccuuacaucuaugcacuucuuuguuuguuuguuuugagauggucuugcucuguugcccagacuggagugcaguagugcaaucuccgcucacuacaaugucugccucccagguuccagugagccuccugccucagccucccaaauagcugagacuacaggcaugugccaccacguccggcuaauuuuuguauuuuuaguagagacaggguuuugccauguugaccacacuggucucgaacuccuggccucaggugauucgcccgccucagccucccaaagugcugggauuacaggcaugagccaccaugcccggccauauccaugcacuucuugcaaccuuaccuucuuuucucaucacccuccagggaccuaguuggaagagcagaguuaaaaguuaaggugaaacuuggagaggugucuugucccuaggaacaaaggacugguuugaaauucucuguaaaucuuccccaguucaaaccagaguuaucaaggucuuaaaaacuucccuggguccugagagcccauuauauuauuuacuugucuuccuguacacccacugccuaguccugauccuacuuuuguuugcaaauaggauggggcacaacguacaaggaagggccuuugccaccccugcuaagggauaaccugaaauaccuucaccaucacugcccugugcugcuuuucaccuaugccagucugucuacagugccagugucuccuggcauugaaaggggagaaucuuuugguccuuugaguauuugguuggguuacauaaaucucccugaaugaagagcagcugacuuaggcaaggggccuuguuugguuuuccuugaacuauuaacaggaagauagggagauuaacuguguaaauguucaauaggccagagucccugcagaggguggccacagugaucagaucuuaucacauccuugcuuuggguguugccucucugguuggaguauggauagaaaagaaagaaagacccuauauugaaaugcaaagugcagcaaguccugacuuuggauuaacuucucagcccauuugcaugaaaauaaaaagaugaauaaaacaagguucccacuuuggagggaggugguagcugugagauggaaggaguguuccugcugggcaacagcagaguaagugcugggguagauucacucccacagugccuggaaaauccucauaggcucauuuguugagucuuuguccuacaccaggcacucugcaaaaacgcuuugccugcaaggucucaugcgaugcucaccacagcucugugaaguuaauuguacuuuuaucaccauuuuacagaugagaaaacugaggguauggggucaaugacuuggcuaaagucacugcuuagcaagcugcagggacuggaugugaauuccaauugguuugacuccaaagccugugaagcuacuuguucuucaccaccuagagcugugguucuugauaacugugaacucuuuuggggucacaaauagcccugagaauaugauagaagcaggagcucuggccuuucuguccauaccugaacagguccuuggguuaagagccccucguccagggccuauuaaucuugauccucauaagcagcauccauguauuacggccgcaaaccaaacugugccagaccgaauccuaggaccaagcccaaauaugucccaucauccuuuugguaagaagcucauuguaagaaagaaagaggagagcaagaggaugaccuagugcauggggccucauuguuuuaauuagugacaaaacaacaauaauaacaacaaaacccccgaagcuucacagaugacaucagaccccaagccuguguguuuuucaggugcccuugaggagcuuuguagcuggcagaggaggugaaacugacaaauguuuggcagauggaggagaguaccagagggguuugagaugagcuaaauuccaaucuaaccgcaggugugaggaagaggcuuggauugggaccauggagauggggguucuacucccagucacgccagcugacuuugcgaguguucuuugucagucacuuuaucuuauuuuauuuauuuuuauuuuuuugaaauggaguuucgcucuugucgcccaggcuggagugaaauggcgcgaucuuggcucacugcaaccucccccuccugaguucaagcgauucuccugccucagccuccagaguaccugggauuacaggcgccugccaccaagcccaucgaauuuuuguaugcuuaguagagacaggguuucgccauguuggccaggguggucuugaacuccugaccucaggugauccgcccaccuuggccucccaaagugcugggauuacaggcgcgagccacugugcccagcccacuucaucuuaccguaguuaccuccuuagaguaugaaaaaauaggcuuagggcauccccaaguccccucuaugucugagagcugaggcuggcugucaaagaggaacuaaggaugccagggacuuucugcuuaggaccccucucaucacuucuccaacgcugguaucaugaaccccauucuacagaugauguccacuagauuaagaauggcaugugaggccaaguuuccaccugagagucaguuuuauucagaagagacaggucucugggauguggggaaugggacggacagacuuggcaugaagcauuguauaaauggagccucaaaaucgcuucagggaauuaauguuucucccuguguuuuucuacuccucgauuucaacaggccauuuuccaaauaaagccaugcccucugcaggaacacuuccuuggguucaggggauuaucuguaaugccaacaaccccuguuuccguuacccgacuccuggggaggcucccggaguuguuggaaacuuuaacaaauccauguaaguaucagaucagguuuucuuuccaaacuugucaguuaauccuuuuccuuccuuucuuguccucuggagaauuuugaauggcuggauuuaagugaaguuguuuuuguaaaugcuugugugauagagucugcagaaugagggaagggagaauuuuggagaauuugggguauuugggguauccaucaccucgaguauuuaucauuucuguauguugugaacauuucaaguccugucugcuagcuauuuuggaauauacuauauguuguuaaugauaucaugcagcagacgugcaucugaaugggcuggcucuaggagcuagaggguaggggcuggcacaaagaugcaugcuggaaggguccuugcccauaagaagcugacagccaaggcuaggggaguucugucuucucugcaucaggucaccucucucaccucugucacugccccaucagacuacaaugucugcaggucuuucuccccugagugugagcucccugagcaaagcaggaugcugccccuucccuuuguauuccuggcuccuggcuucagugccuggacauaaguaugggcauaauaagugucccccaaaugagacauugaggauucuucaaaugcacaggaccgugaugugaguuaggacggaguaaggacgaugggauguggcucaggacaauccugaggaagcugcagcugcggcacgcagggccacacugucauguucauggacccuagacuggcuuuguagccuccaugggccccuuccauacacaaauauuaaaaauuauauuucaugacugcauugguauaaagaugaauauaauccagaccagauucaugauuauucauacauuuuuaguguauuaacuuuuaauucugcuuuuaaaauaaauuaaaacauucuaauaugcccuuaagaguaucccaggcccaggccacugagccuacugugguucauggauaaguuggcccugggggcaugugugugcaugcaugugugugcacaugcaugaugagccgggccuugaagggugguaagauuuggguguguagaccaauggagaaaggcauuuggggcagugaugaugggugggggagggaacauggugaugaauggagcuggguguggggagccaugggaguggguuagggccagccuguggaggaccugggagccaggcugaguucuaugcacuuggcagucacuucuguaaagcagcagaggcaguuggccuagcuaaagccuuucgccuuuucuugcacccuuuacaguguggcucgccuguucucagaugcucggaggcuucuuuuauacagccagaaagacaccagcaugaaggacaugcgcaaaguucugagaacauuacagcagaucaagaaauccagcucaaguaaguaaaaaccuucucugcauccguuuauaauuggaaauugaccugcaccagggaaagagaguagcccaggugucuggggcuuguucccauuagaucuuccccaagggguuuuucuccuugguggcuggccuguggggccccucuccaggaggcauuggugaagaaacuaggggagcugguugccacagacagugauguacuaaucuucucugggaagacagaagaaaaguccccagggaagaauacuacagacuuggccuuagggacagcuaggggugcagauugcugccaacugcauuuuuucugaaguuggccauaugguugcagugaauggauuuauagacagaguauuucugugcauauaagagcaauuacaguuguaaguugauauggauaagugaaaguuaagcacuucuuucuaaaaagagaaugcaauucauuuuccccuaaucauuucaauuagucugaugggcauuugaacuuguugucuuuaaaaagugaaaucuuuaccucugaucugguaaguauccaggcaauuucuugugugccacccaggagguaucuggggagugggcauuuucugacugaggcauuggcugccauagcaucagagcagccuuccaggcaguggccuggcaaggggacagaggcuggugggagcagcuggcugagugcagccaguaauggcaugugcauggucuguagagaauguagaagcaauaaugaagccgauaaaagcuggucugcauuuuauuauuaucaugcgccggugguucuaaacaaugucagugauaaauuacuccuccccaucauggaccaauggcugccacugcuccagggaagugcuuuuuauuccguuugguguuuagggagggauggaguuggcuggccuuugcugaaaggccuaccaguuuguuuucuauuuggcaaaagaagaaaugauaaaguucuagaguuuaaaccagacucagauuugaguuuuuuuuuuuuuuuuuuuuuuuuuuuuuaaggcuacagaacugugcuuuccuugggcaguaaaagaggcaaugggcaaugugggaccugaugacaaagggaagcaaagcugucuuagggguggcauggaggaggugcugcuucacagcagagagagguauggcugugcuuggaguguccacuuagacaacuccuggcugugcagccaggccaucgagaugcuguuuccuugaccugcagguccuggucuugcacauggauguuucuucuggugcaggagacagaaagguagcaacaaccccugaucaaagccucaguccuuccuuauuuacuggagagccccugcugauugaccagaggcacagcuggggauauuuccuuuaccucuguagcaagagacagcguggugcagaggaaagugcuagcauacauuacccuguggcugcaugacuuugugaauagguuaguuagcacccuuucagccacuucuucuuaccuguuaaugagauaaaacauguaauugcuuaaaaacaguauuuggcacauaggaagcacuuagugaauaugaauuaugauuuuuuuuggaguggugacaucucaaccaagccauuuaaccccucagccuuacuuuccucaacuauaaaauagcagcuaacuugaaauguaaacuauaaaaccuaauguaguaucuggcacauaguagauucccaauaaaugagagccaguauucuuucuaagacagugaugcauuucugagcaccuggccuuguucuucugccuugcaauuuaugcagcaguugaaauagacuggcugauggggguaaguugucaagcagacuuucugaucuuaguggaggagacugccuuaaaacaacacuaauuuccuuuuucuuuucuuuucuuuucuuuuaagacagagccucgcucugucaccaggcuggagugcaguggcgcagucuuggcucacugcagccucugccuccuggguucaagcgauucuccugccucagccuccugaguagcugggacuauaggcaugcuccaccaugcccaacuaauuuuuguauuuuuaguagagaugagauuucaccauguuggccaggauggucucgaucuccuaaccucgugaucugcccgccuaggccuuccaaagugcugggauuacaggcaugagccaccaugccuggccuucuuugagaagcuggagacaugaguuaaguggugaagaagccaaaucuguaucuaaaaacccuacaguagugugcagagcucugaggagagaaggucccuuagauuuugaguguauuauuaugucagugcuuguuuuacaucucucuguucacgcaguauguccccuuuucugccuugcagcuguuucuuaaauucuuucuuucuuugcuugucuugcagcacaaaacaggcuucaguauagggggaaaugcacagaaacacugccuuuuccuacaggaaaucaguaacuuuuuacugauuuuguuuuuauuuacuuauuuuauuuguuuaaauuuauuuuuaguuuuuuuuuuuuuuagagacagggucucuuucuguuacccaggcuagagugcaguggugcccuuagagcucacugagcucacugcagccucgaauuccugggcucaagugauccuccugccuuagccucccgaagggcugggaugacaggcaugagccacugcaccuggccaacuuuuugcugauugcgaauagcacucuugucaauuucggagagaagcugagacuggcauaugucaguauggauccccacuuagagaccuguguuuaucugcacugacaccccaucacagcaugaugagcuuggcccuccugugcugucucucccagggcugggaggauccuugaagcugaucugguuuggagcuuuguccucauucaccuccuuuaccacacacccaccuucccagggcggggaucuaccacucacuaaguagcccauucuggguguugacagcucuaauuguuagaaaauauucaccacccuguuaugcuuucuagagaacaagucuaauucuguuuuccuugaaauagucgaagacagcucucauguuuuucuuucccuguuuucccaaaguccaugauuuuuuaggcaaaauggccuccuuuccucuuauggaauguuuuuccuccccauuucugccucuccucugguuguguuucaguaugucugugugcuucuugaaguuuacuggaaauuaugaaaguauucuggcacagaggaggaagggauuuuugccucccuuguucugagugcuacauuuccguuaaugcagucugagauuguauuaggcauuuuggcauucacgucaccuuguugacucauauuccaugugcacucaaacaaaauugugauuauuuuaaauaggcagaauugcaaguuacguguucuccauuucuuuguuguauuguuggcuuuuugaacuaaagggaaaaaugucuuuuuucuguuuuacauguuuagauucccuaugcuauccuauccucccaaaaccauuuuagauucugauuuugccauguauuauaucugauacuccuuucucgucaucuagagaugugauaaacaacucucuuuggccucauuccagucaucgauaacugugggacaaagacuugaagcuuggaucaguccaguggagacuaaccaccccuguagacccuuuuuuccucaacuauaaaauagcagcuaacuugaaauguaaacuauaaaaccuaauguaguaucuggcacauaguagauucccaauaaaugagagccaguauucuucuaagacagugaugcauuucugagcaccuggccuuguucuucugccuugcaauuuaugcagcaguugaaauagacuggcugauggggguaaguugucaagcagacuuucugaucuuaguggaggagacugccuuaaaacaccacuaauuuccuuuuucuuuucuuuucuuucuuuuuuuuuuuuaagacagagccucgcucugucaccaggcuggagugcaguggcgcaaucuuggcucacugcagccucugccuccuggguucaagugauucuugauucuguagacacuaccacucaggccuauauuguaaucagugcugggccacugggcuccugcuucugugauccaguugggaaguuuaucuuguucuucccuucagcuugcaucugcuaaauucgcuggacuauacacaggugauuuguagauauggggaucucuacucaaauacucucaugauuuccuuggcuagagcaucauuuuauuuccacuuauuggaagagaccuuagagaccaguuaguucauuuauagauaaauuaguugauucugucauucaacccuuauauauugagcgucuccuauaugcgaaucacuguucuaagugccgagacacagagguguccaaaacaaauauggccccucuccauauggaauuucuauucuagagaagaaucugacccagaagggggaagugacugucccaagucuacacaaccacagaagggauauucugggaauaaaucacggcuaaaccccccugcugcuccaggcaguucuccuucuacagugcucuauugugcuguuuuaauaaucuuucaacugggaagaacucccauuucaggaauuaagccguggacaaaucuuuuaauuauccuugaaaucauccuaauaagaaauccaaggaggaagucuuacagggugccucacccacuuuucucaucacuggaacuuuuuagacauuuuauuauuuucuuccuaaaccagaguacaggcacacaaguugaguggugugguggcuaaauuaauuaauguuugcaaggcagugugagaagcauucauucaucuuaaauaccuauggugacugcaacucagauguaaaaauuggauaaauccucagaaacccuagggaaagugacaugucuguauuuugucucugugagauacagacuggcagagauaaguguuucucugggugaguuuugugugguaucugggaugauuuuaggcaguacguggaugagaacuuuuaauuuuaacccacauccaauugcaauuucauggaaauuauugcuuaggaggauguucaacaggaaaaauauaauuaaaguuaauucaaaagaaacauuuucugugaauaugguaaaacuugugagaguaguuuguaaaugauugaagauuggaaaacauugguauaagagugagugugggguuuuguauuaagauucauuuugggaagaaauccaugcugcaucccucaugaagugugaacuuugggcauguguugauucuuucuggcccagaguuuaccugaagauuagcugcccugagggucacugagcauuaaauuagaugaugucuguggaugacugauagugaagcucauagcccacaguugacacauaauaaauucgaguugcuuugcuuccccuucuguuccuggcugacuguuuggccuuugccacuuguucggccucucugggccuuaaguuucuuugccuugaaauuggaacuuucuuuggugaaacaaccagaaaaugcuucagcccagaaacuuggucaguacuuggaugggggaucaccugggacuacccaaggaugugggcugucugcuagacuauagccccuugagggcaaggugggcgccuugcucaugguuccauccuaagccccagcacaguagugggugcauggugagccauuagugaaucuuuguggaaugaaggugggagaaaauaaaauaccuguacuucacaggguauugugagggucaaguaaaagugcuuuaaaaaauuguauuauauaguuuauucccuuguguuagcccaggucaacagagccuacgaauaauaaugaugacagaaguucuucaaaaagucuuggccuucuuucuuucacaaaauugccccccagagcuuucuggaagggcagccaugaacccagaggccuaaaguagauuuacugggaagcuaaaaauauuuacuuuauuuuucauagcuccuuucaagguccucucugggggucuuagcaauauguuuacacagugguauguuuuuguaagguuugcaaaaguaagauuuuuuaaaaauacuaucuuguuuuaaaaagagagcccccuaccaacuugugucagccucaggcccccaccugcaucugcuccugccagggcaugguggggcaagaagcacugcuccccuuccaaagcuuccuuccuugcccuggagucauccucacuccccacuccaagccaccugccaucgcugugcccccucucuggugaaucuggcauucuuaggugggcugagaagcagacuggcccaagcuaaggccuuucugaugggguuguugcugcugagaaucaugacugggugggagaaggaggugacccuuugcugucuuauuuuuacuguguauuuccuuuucagcuacuuaaaauguauugcuuagugauaccuaauggguucauuagccugcuuccuacugaacauuuccgcucaggcauccacuuggucccaaggccugcuccucucccauauucugaaaucuggacuacagacucucauucaacuccagguugcacuguggacacaguccccucuugagcagguaccuccuugcagugguugggacguccuacuuggcucauaguugggaagugcauaugcuggagcugaagccucuugccuucccgggauagggcguccucacauccccucugagaaguuccccagcuucccucuguuccccguuuccacacuuagcgaggcucuuguccacugcuacaucccccauagccagucccucagccuugccauugcuuaugcuggucuggaaacaauuccuagacuuguggggcaucuggggaaguucuccaucuuuuuuuagcuggcaugacccaaguggugugggcagggcuguggauucuaugguguggcuggaagccagguagccucucucuacuguacauggaacucagcaacuucugagucaagcaagaucuuagcucugcaggugucuugcccuguccaaaguuauggccacaccaguaccuuuuaacucuagaagcccaguaaguguuuugugggaccgcaaagaucauuuucuagaccugcugaauaugccuagaacggguagggauggcuuucacgcuguuccuagggcugacaagucacacguuucuggggguacauacacaccgcggucccugugaauggcacucuccaugagaacugugaugauuugaguugaauagugcacagccuacaugguucucugccauggccuggaguuccuuaucuugccuucuccagugaggacuagggcugcaacuggccuacuuuggcuccugacuugggggauucugaaauaccuuuuuuuuuuaagguuguggagcucucugaagcuuauaaggauuuugccaggaaaagauaagaaauaucuuugggcauuuugucacugugcuggagaugaacccuuuggaggacauaucaccuuguugaggucaaggggcggaaagggacaggacuggcagagagauccggggcagcagccugccaucccgacugaguauggaguuucucucucccuucagcugcacuuuuguguggagucaguggcucagcugccacuucccuuauguucauggcaugaaucuggcuuguuaggccuuucuuuuuuuuuuuuuuuuuugagauggagucucacucuguugcccaggauggagugcauggaguguaguggugugaucucggcucacugcgaccaccgccuccuggauucaagcgauucuccugccucagccuccugagaagcugggauuacaggcgcaugccacaacacccugcuaauuuuuuaauuuuuauuuauuuauuuuuuuucaaggcagaagaauuuuucuuaguacagaacaaaauggaaucuccuaugucuacuucuuucuacacagacacagcaacaaucugauuucucuaucuuuuccccacauuucccccuuuucuauucgacaaaacugccauugucaucauggcccauucucaaugagcugcuggguacaccucccagauggggcggcggccggguagaggggcuccucacuucccagaaggggcggccgggcagaggcgccccccaccucccggacggggcggcuggccgggcgggggcugccccccaccucccucccggacgggguggcuggccgggcgggggcuggcccccaccucccucccggacggggcggcuggccgggcgggggcugccccccaccucccucccggacggggcggcuggcugcccugcuaauuuuuguauuuucaguagagaugggguuuuaccauguuggucaggcuggucucgaacuccugaccuguugauccaccugccucagccucccaaaguguugagauuacaggcaugagccacugcgcccggcucuguuuuuuuguuuguuuguuuguuuuuguuuuuguuuugagacggagucuuacucuguugcccaggcuggagugaguggagcggcacgaucuugguucacugcaaccucugccucccggguucaaacaauucuuccugccucagccucccgaauagcugggauuacaggcacuuaccaccaggccuggcuaauuuuuguauuuuuuaguagagacgggguuuugccauguuggccauuugaacuccugaccaucuuugaacuccugaccauguuugccauguugaacucuugacuucaggugcguuggccucccaaagugcugggauuacaggugugagccaccaugcccagccuguuuggccuuucugauauggcucugacuaaucuuuuuggaaauuaguccccaggguuauacuggauuuuacuuagggaaaagggucaugccucucuggcugucagauuuacugauaguacuaaggacucagugggguggaccuuugauucugguuugauuuuugaaaaucaaaaagacgugagcuccagggagcaggguggcuuuggugacauggcaagauaguuggcuguggcagggaguugagggaaguggguagaaaauuaacaucuuguaaauauucccugggaaauauaccuucguguuaagagaacagacuuggcagccagauggccuagguucaaaucuuggcuugaugcuuaucagcuguguaaccuuggauaauuccauacaucucugugccucaguuuccucaaauggaauaacaauaguaccucccucaggacuauuguggcaaauuaauggacgaauaaggggaagcacuuaguacagugccuggcccagcauagguaccaggcuuguucuuaagcucacugcauuuuuacaaucaucauaaaaugcaggggauacacacaugaaggagccgaaguucagagaggccaaguaacuugccuaagaaagcacagcuggcaaggggcaguaauaggaccagaauuccaguuucucgugcucuguuguuguuauauccuaaagagagcagcucugaguagccagaagcuucccuaaagucacaggacauggggcaugggcuggcugggaugagaaaggagacaagagggcuucugaaagaaaugccagauucacuccacuuccuggcuucaggcaccgauggaauguuucccaaggcccaucuagaaagaacauccugugacucacagccacuucucauuuucugucugaacccccucacccauucaggcagcugcuaaaguugagguuacagccucagacuauauuuucuguccuuguggaaccccagugugucaucuuguugggagaucuggugauacaugugucaacauuaugucaucaaaauggaaauucuuugaaaucuuuaggugauugcaauucacguucuguauguaugcacuugucaaaaguuuugauuugaggccuuagaauuuuauauuuggaaaccuuuccacuaccaugaguuuucccagaccugucaaagccaggcugcaucucagaaaccaggucuuugauuuccauccagggcaagggccugggcccagcugggcuguaagcagguggggguggggagcaacgcugcacugcaauguugaaauauuacuugaacuaaaucaaaucaaagaucagcuuuacucagacaagaauagaaaacacaauugcauucgauuacagaauaguguguauccccacaaauaucagacugccuuuaaaaaguuuugaauuguuaacaucaagaacaguguugcgugucuccugcuuuuccagcauaagguuuauuuauucuguggguggcaaagagcaauuugggaguccaguuuguuucucauugaaagcuuucccauuucugguccucuugucacuguugcauugaggcaccaaaaggcaaucucagugcgacacuauucaacagacuaaguugcaccggauaaugauaccauuuuacauuuuucauauauuauuacauugaaggcuucaaacagcacuagcaggggcaaauugguauuauuaucuccauuucauugaugaggaaaccgaggcucgaaaggguaaugucuguuguccaagauuaaagaguaaaguuguacguugaaucggggucugacuccuaggcuuagcauuuucuccccacacuaugcugccauguugcuuauuccaacauuaggaagcauaggugccauccccagcuuuugaggccaauaucacgaugaagcauuuuuaaaacaucucauuaaauugcugauauaguggaaagaaccaaagcuuugcagucaaagcuguuuggguucaaauuuaccacuuguuuguucuaugacccugagcaagauauucuccagaucuguuuccucauuugaaaaaugggaauaauaauacguuucuuuauaggcuguucuuaaagauucuggaaaauaaugcuaauagugugccuaaugcuugguaaauaugagucacuuuucugugcccacaaagcacuacuaugucccuuaauaaauuuuguuaauuuuaaaaguuagaaaaaaauuaaacuauuuauacauuguguauguuaauucuucccuagaccagccuuaggaagaaucucauccccaacuuguaaacucaucuuuuuccguucuuuuugugccuggacuucucagggcccugcaggcugauucuagucccauguugugugguguuugaagugucuggucccuuuuuucagugagagaccagcucauccuugggaacugaaugccucaaacucucuuuucuuuuucucucuuccccuucuguuugauguagucuuuccuguuucuggacucuguuucuucauacuuccuaucucuuaccuucuuuucacuccuuuugucuuccagcuguccucucucauuuuucugccucucuggucuucagguagaguuuucaucucagcuaucuucuugcuuuuucugauguugguucuuuguuucuucuucucauucuguucagguccaaaauucauuugggucaauguuaugucuuaguguuaucuuccauuuccuucugagcuucaaagccaggcugacugugcccuuccacgcccuggccagugugaccaggacauccuuucccucuggggcugcacuggcucuuugggggaauuguuaccauucagggucuucaacccucauucuagggacuuccaguaacuucucccaccuucccucuucucaguaagacauggguauugucuuauucuguuucugcugcuagaagaaaauucucgagacugaguaauuuauacacaauagaaauuuacuucucacaguucuggaggcugggaaauccaaaaucaagguguuggcagguuuggugucuggugagggcugcucucugcuucuaagauggugccuuguugcugcauccuuaggaggggacaaacgccauuuccucaacuggcagaagggacugaagccucucccucaagcccuuuuauagggguccucauugucaggccucuaagcccaagccaagccaucgcauccccugugacuugcacauauacgcccagauggccugaaguaacugaagaaucacaaaagaagugaaaaggcccugccucgccuuaacugaugacguuccaccauugugauuuguuccugccccaccuuaacugagugauuaacccugugaauuuccuucuccuggcucagaagcucccccacugagcaccuugugacccccugccccugcccaccagagaacaacccccuuugacuguaauuuuccauuaccuucccaaauccuauaaaacggccccaccccuaucucccuuugcugacucucuuuucggacucagcccaccugcagccaggugaaaaaaacagcuuuauugcucacacaaagccuguuugguggucucuucacacagacgcacaugaaacucaugguaucugugaggggcccuaaugcuauuggugagggcacugcucacauaacuuaaucaccccuuaaaggcccugccucuuaauacugucacauuggugaugaaguuucaauguaugaacuuugaggggggacacguucaaaucauagcaggugugcuauugccuuacuagcaaaguaaucugggggaagaugaguaaugucucguuccaccccugauuccagugcugacugauucuggaguggcagagaggguuggaggcucaccgcucugcucacccgacccucuggccaucuccucuuagaaugcaagggcagggauuuuguuacacagcgccucuuuuguuauaggcuagcuccugccuucaaggagcacugagaaaaauauuaucccuuugaaccacaacacuaguauuuuggguacuguagccauucagaaguuuguugaacuaauacaaguuuauauuauuuguaaaauacuagaaggaaugugugguuccuaaaguuaugguauucccauugguugaaagagaagacucuggcuuccuaaugccuuggaagguucagggagcauaagccuaaauauccugguuucucuugggaauucuucacagcuugucaucuaugacuuuauccacauuuauuuugaacauguuuaauuuucagcuuguauuuucucaaggaguaugugugagucagcauucagaguacuuaacacacuuagugucauuagugauaacuuaacccacacguauaggaagcuagaccuccauuuacagaaaaauggaggcucagagagccuaacugacuuucccaaggccacauaacuggaaaauucuggaacugaguuuuuucagguaugucuugguaucccucggugagccuucucuguagagaaggaagugucuccuggguuggaaagcccaggccgggaugaacagcauggguguccuuaggcuguguguaccacacaccccuggccuacucuccccugcucuaaggagucaccugaaggagcagcugcaucaccccgccucaccccuucuccucagcacccaacaaccaggucuucccagagagugcucagcuauuggugaagcaggcaucgucuauucuucaagaagacagcagagcaucaggaaaacaaaacaccaaaaaaauaccauaaagacacuggaguguauuuguuaccagcccuuguauaacagagaaguauuucaaggucuuauuuguaaggcuggacaagcucaggcugauuaaaaccacgaguuagaauuugucucccgcucccaggcccugcucaguugacagcuccuagcaggcugggaggccccaccccacccccaccccagggguccauugaagaagaccaucugggccugggaugcugaugugauuuucccuacuucuccuuuuuuuucauuugccuccuccacccacuucuaaagcagcugauugcucugguuccuuuucauguugagcaaaagagaagacagaucuugaaaccugagcuggggacuggagggcacugaccgagaguaaccccgucuggcucagcucagcucagcaaagggcuuuccuccuccgccuuccugagcugcucucccuccucuccuuuccuccuucuuucccagccucccccaagcuccuucaccccucucuucccucuccucccuccucccaccuuccuuguccucuaugcucagagaacugaaggaacacugaauggccuggaaagcaggaccucgcccccaccccgcgucauaccccuccgccugcacgugcaaauguguuccucagcuuggucccagaggccuggaccugggucccagaggucccagcugguuccccggcuuggucccagaggccuggauguguggcaagaagcugaggguucugcuucguuucuuccagcccacaaacacacaugucaccuguuuuuuguucuuuuuccuuuccuuugccccacuuuacagaagcucuuggcuaauugguaggucacuguuugcuccuccaggcaaaaccaaggaggcugagcucagcaggucaaguauuuuggucuguauugaagagacuguggugggagagcccucuugaccuucugcuggauagugacuuucucuucugcuggcagcaguagcccagcuccgcauccugugacagaggucauaccuuccaguuacccgagcgaacacuuggagcaagucagcuuuuuccccugaaacagcacguucacguucuugaucuuugguuugcacaacaaccugugaauguuauuagccccguuuuuuuuguuuguuuguuuuuugagacagagugucgcucuuguugcccaggcuggauugcaauggcgugaucucggcucacugcaaccucugccuccaagcaauucuccugccucagcuuccugaguagcugggauuacaggcaugcgccaccacacccggcuaauuuuguauuuuuaguagagacgggguuucuucauguuggucaggcuggucucgaacuuccgaccucaguugauccacccgucuuggccucccaaagugcuguauuagccccauuuuauauccaaggaaacugaggcuuagggagauuuaaauaggggggaaaguauagcuucaugauuacacagucaggaaauggcagagcugacucuugaauucagacccugugaugcuguauccagugcugauuuuguuuugcccuguguuccuuucagugucagguaagaagaccucagagaucaucuucuccaacccacacauuuuacugauuauaaaauccagguccgcauuaacucauuggccaaaguuaaguggcuaaaugacucuccuguucaggaaguauucccugucuuguguggaaugauuggucuuucguccaggucaucuuccaccuauauccauccuugcagugacugguggauaugaucauuccuggugauucccuguaaaauacuagauuuauuuauucuuucauaaaguuaugaguagacaaaucagucagcuucaaccuuuccuuuaccuuauagauaguaucagcagaaagaacucaauaauucugucuuaggaacucagccaggcuaauauguauuauaauacacacauacauaugcacacacauacacacaugugcauaccuuagaucacaaauucaacaucucaacuuagccgccaaagccacuucugugucuugucuauucugaauaugcuuuaagguuaaauuagccaugaaucuguucagaucagucauuccugaaaaugaugaugauauuagccauccuuuaccgggcaccuuacucagugcccggcauuauacuaggucugcagguacauuugcucauuuaacaccuagcucaguccaaugagguggaugccauugucaucuccauuuuaucauuuaaucaacucagccuuccucucuccuguuccccacucugcuucuagcugccacucaccugacucuccucuugaucugggcugacguggcugaguggguuuagcagaacucuuguguccucuuuacuugguuuguuucaaguucauguccugcuucaucuuuucccuaacucacugcaaggugaauuuucuucucugcaaucggcaauuccccaaaucacaucaggucauuaauuuauucacucauuuguauucauucauucauuaguucauccauccaucuauucauucauucauccaauuuacugagugccuccucugugccaggcacugcuggcuuuggaauuaaaaacccuggcccucaaggaauuucuauucuucugggagcaggauauuuacaugggugacugcagcuugaucugugugguacuaguggaaaacauaggauguugggcacaaaagagucacaaaacgccgggcgcgguggcucaugccucuaauccuagcacuuugggaggccaaggcgaguggaucaccugaggucaggaguucaagaccagccuggccaacaugaugaaaccccaacucuacuaaaaauacaaaaaggaauaauagcugggcgugauggcgggugccuguaaucccaacaacucgggaggcugaggcaggagaauugcuugaaccuggggcuuuggagguugcaaugagccaagagcgggccacuucacuccagccugggugaaagggugaaacucuguauuaaaaaaaaaaaaagucacaaaaaagggcuggccaccuaacccagcuugaggaugggaaggccagggcaggcuuccuggaggaggugacucaugggccaugucaugaggaugggguaagaggagaagguauguuucagacaucuggcuuucuuaauauucuuggcuuuccacccauuuuccugccagcaacauaggggagaagacugagaccagcagauacaaagccacuguacucuguccucacccccuccuuuuuucuccccuuccuacuacccagaucugagguuuugagaaaucucuucucuaauuaucugcuuguucauucauuuguugagaaucuacuaugugcauagcauuaugaccacaaaauguccuggucguugucaucaugagaggucuuaccccuuccucuccagccacuucuagggauuuuugacucuguccuuuuccagaacuuggcuccagucugguugcucgccaugaagcacuuacagauaaaccucaucuugggccagugcuuccauuuacugucuccuuuuggcuugcuuauccuuccuucugccuucuugaauugauuugccucuuuaucuccccuuucagccuugaaaguuccucgaaggcagggacuguguccccaucuuuucuauaaauggcauuguuguacauugguaaaguugagugaaaaaaucuuuuugauaaucacaaauuauuaccauauauugagcaccuaccaugaugaguaucucugaucuucauaucuuugaaauguggauacuauuaccuucacuuaauugguaagaaaauuugugcucagggagguaaagucacuuucucacagucacacagcuauuucacaggagagugcaguaucaaauuuagguuuuucuggucccaaacccugauguuucccccacaucauuguuucucagacuuggcugcaaucaccugaaaaauuuuauuaaauucuuuuuuuuuuuuuuuuugagacagagucucgcucugucacccaggcuggagugcaauggugccaucucugcucagugcaaccacugccucccacguucaagugauccuccugcuucagccucccaaguagcugggauuacaggcacccaccaccacacucagcuaauuuugauauguuuaguagagacuggguuucaccaggcugaucucaaacuccugaccucaagugaucugcccaccucacccagccagguuuuauuaaauucugaugccugggucuuacccuagcaguucucauuaguugcuccaugguguggccugggcuuugggauuuuugugaagcccccagcugagucuaacgggcagucauguuugagaaccaguauacuacaccauguugccuuccuguuuucacacagguuggugcuagugugugagucuaagccuacauggguggauauccacgugaucaggcugcaaguucuuuguaguggaggaucuuuggcccucccugcugcuucccaacccagcgaaccuaccacaccaugcacgugcacagccaaggguuguugacuguuuaaucagucucuggguucuuaugucucauccgggggauucacugauaggaggcuggagcuugaucacauccagauguucucaucuucagagccuguuaacauaacagaagucuuauaaacaugcugagcacacucacuggucuggagaguguugcaggaugaccuaggcccauugcagggguggccugggucgcccucccacacuucugccacccugcuugggaaggagggagcuguuuugaaguucccuggugcaauaugauguauugcucuggcucugcucaggaggaagcuauggcccaccuagucagugaggguuagcuaauacguguauucuguuucuguugagguuucacagaggccuuuuuugacccuucauuuuauagauaaggcaguggaggcacaacuacaugaaaugacucgacaaauaaauggauuuagaacccagguuucugacucccaggguggugcuuuuuccaugguuguacagugauuaaugucuaccuuuucacaccaguccucaacugaagacaccagcuuacaccuuccuuccuguuucucccaagaacagaaagugaccccggaugucgcuuucuguuccugggaaggcaguuccagugguuagaaguccuguucacuccugggguguggccuggggaugguccugacaucccugggcucuuccuggaccuggccagcuaaaaggaaaucuccuaugaugguacucagauacuuuuggaaccuugucagcccuaaucccaucuccuaguguuuaguauucagcuacccuucacugggcaguaauucugugccaggccugaucugggcauuggugguacuaagaacgcauauucccuauccuauaggcauagucugguagagacaacaugcaaguaaaacaauguuccuuaaacugugguuccacaccucccucccccaacauuaaaaguguaagggaugcuuauucaaauguagauuuguaggcucugcacucuagacccacuauuucagaaucucuggggacugggcccaagaaacugcauuuucgcaugcucccuaaaugaagcuuaggugcucugagguuugacaacugcaguagagagccuaaugcuaacaguguagagucacaugugaugggaagcaucagguagguagcaguuugcaggagcacugauucugagggacacuaacugggccuaagaacagcuacuggcugucaugaggaauaacuaggagcuagccauagagggguagcagugaaucauuucucuagcgauguaaaucuugcucaauuuauucugucuauauaacucaauauuacugaaguuugccuaaagcagaauacaccuggaucauacagcauuuaugagagacuggcugggcugucaggcccuccuguuacuuuaucucugcaugugacccucuuagcuccgcggauuaacuccuguccucauuaagccucacacuguagccccauuuucagaucaaaccuguuucucuucugguaaaugauuucaguuugcaaaguuugcccucuagagguugcuuagugccuggccaugugggcucaguucaugugguccugaugagcugguuuuaucuuuauuacaaagaaguuaggcuguuaggagaguggguuggaaggagaagagguagacagccaaaugagaugagucagggaaaacuauacuguuucggagucauagggcuccuaccaagcaucuggucagaaaccucucauuuuggagaucaagaaauugagguucagaaagaugacaugagguacgcagggacgccaccagacacagccuccaacucuagaaacuaaaauucuggauucuuagugcugcuuuuucuguuuuguugcacuggauugaagccuuuucuaacuguacucagagggccuauuauuuagggagauuccguaugaaauccuuuagcaaucaaaucauuuaauagggcugaugguuuaaauauauguuaauguguuuuccuaaagccuggcagaccuggguuuuggagcuuuguaucacauguuuuauguuuggaaugaaaaugagaccaugucugugaaggcacuuugauaugcguaaugcacucugccaguguuugucaaaacaugguccccaggucagcagcaucagcaucaccuguaagugauucuccagucgcaucccagggccgcuguaucagaaacucugggggugggggugggggugggggugggggugggggugggggugggggugggggccggcccggcccggcccggcccggcccggcccggcccggcccggcccggcccggcccggcccggcccggcagucugcauuuuaacaagcucuccaggugauucugaugcauacuuaaguuugagaaccauugcuuguuuugcauuaaacaggagauuagucucugcagcuugugggaauaaagcuuuaaaucucuccaauuuuagcucugugaaaaggcaguggggagacaggaaugaacggacuagugccacaaagcucagguggggugggugagaucauuuagaagagaaagaccgggcaugguggcucacgccuguacugucagcacuuugggaggccaaggcagguuggaucacaaggucaggaguuugagaccagccugccuaucauggugaaacccugucuguacuaaagauaaaaaaaaaaaaauuugccagucauggugaugcauaccuguaaucccagcuacucgggaggcugaggcaggagaaucucuugaacccgggaggcggggguugcagugagcugagauuccaccauugcacuccaaccuaggugacagggugagacuccgucucaaaauaaaaaaaaaaaaagaaaaggaaaggcuguguguguguguauguguguguguguguguguguguguguaacagcaccaucacacuguuugaguugaggagcacaugcugaguguggcucaacauguuaccagaaagcaauauuuucaugccucuccugauauggcgaugcuccccuaucucauuccuguguguguuuagccaggcaacuguugaucaucaauauuaugauaacguuucuccacugucccauugugcccacuuuuuuuuuuuuuuugaguuacuuacuaaauaaaaauaaaacacuauuucucaauagacuugaagcuucaagauuuccugguggacaaugaaaccuucucuggguuccuguaucacaaccucucucucccaaagucuacuguggacaagaugcugagggcugaugucauucuccacaagguaagcugaugccuccagcuuccucaguagggcugauggcaauuacguugugcagcuacuggaaagaaaugaauaaacccuuguccuuguaaugguggugaaggggagggagguaguuugaauacaacuucacuuaauuuuacuucccuauucaggcaggaauugccaaaccauccaggaguggaauaugcaaccuggcgucaugggccagcugguuaaaauaaaauugauuucuggcuuaucacuuggcauuugugaugauuuccuccuacaagggauacauuuuaaguugaguuaaacuuaaaaaauauucacaguucugaggcaauaaccgugguuaaggguuauugaucuggaggagcucugucuaaaaaauugaggacaggagacuuuagacaaggguguauuuggagacuuuuaagaauuuuauaaaauaagggcuggacgcaguggcacugaguugagaacuguugcuugcuuugcauuaaauaggagaucagucccugcagcuugugggaauaaggcuuuaaaucucuccaauuuuagcucugugagauggcacuggggaaacagaaaugaacggacuagugucacaaagcucaggugggauggacgagaucacuucaaaggucuguaaucccacgucuauaaucccagcacuuugggaggccaaggcgggaaaaucacuugaggucaggaguucgagaccauccuggccaacauggcaaagccugucucuacuaaaaauaugaaaauuagcucagcgugguggcaugcuccuguagucccagcuacucgugaggcugagacaggagaaucguuugaaccugggaggcggagguugcagugagccaauaucacgccauugcacuccagccuggcugacagagugagacuccaucucaaaaaaaaaaaaaaaaaaagaauuuuauaaaaucaggaaauaauauuaguguuuauguugaauuuuaacuuuagaaucauagaaaacuuccucuggcaucauuauuagacagcucuugugcaguggguagcaccagacccagcuugcaugguuauugauuuuucagagacacuuuuugagcuuauucucuggcagaaaggggaacugcuuccuccccuaucucgugucugcauacuagcuugucuuuacaagaagcagaaguaguggaaauguuuauucuugaaaauaagcuuuuugcuucacaugaucuagaauuuuuaaaauuagaaaaaugugcuuacugcgugcccuucugaaacuaggaaaauaugccuuguguuuaccaauugugugguuaggagaugggccaaaggcaucaggcuuuugaaaguaguugcauuuagcauaauuuccauugcccccugccaauuucauaucugucacaucuaaucaguuuaaaauaaggggcauccuaagcauggagaugguccuuggaugguccuuggaguuucuguauuuucaguauucuuuuuuuugagcauacaagacauuuauugaaaaauucuugggaucaauacuuguguaaggaaaggaaagggaacaaagcaugauugggcagaggcagaagaugacaucaacaaaggcccuccguugucaguauucuuuuuuuuuuuuuuuuuuugaguuggagucucgcucugucacccaggcuggagugcaguggcgugaucucagcucacuacaaccucugccucccagguucaagugauucucugcuucagccuccugaguagcugggauuacaggcaugcaccaccacaccuggcuaauuguuguauuuuuaguagagacgggguuucaccauguugguuggccagacuggucuugaacuccugaccucaggugauccgucugccuuggccucccaaaguguuggaauuacagacaugacccacugcacccggccuguugucaguauucuuaaacauagacacuaacuguaggcugacagccuagcagcaaggaccaguuaaagaaaugaguagaacugaagugugcuugaguaucucuggcagucagcaaaaacuuaaugggaaucaugguaggccaaauguucugcaguauuucaaaagcugcauggguuuugagaggcuuuugguccaucacucaccuuagguuguucuacaagcacaucagccugccccaauuuaaacagggcaguuaguaaugguguaauaaagagucugcauuguucauuccuucaacaaauacuggcuauaauguuucagcacuguggaugcaaagugagcaggauaaacaggcucuucuuucaaagcuugugguccacuggaccacguaugaaguagaauaguuuagguccagaaaggcaauuaaguaaaauaugaccaagaagaggcucucuaguggguuugguauaaagaaaagauaagaaugauuuagaauuggccuaucaaugagauaagaggccuggcuuucuggcacucugcucuagggcaaguaaaauggagaauuccaaauucugaaauuguuagaacauaguucugugucuuaguuaaauaucuacacuuacagauaaauagcauaaaugcuuucuccccauauuucagcccaguccuacuuaaagacaacauaaauugcaaaauagugaggauguuguucaucuaauaaaagugguuccaggaauucagacucuggauuccuguuugccaaaucaugugucccacucuuaagaaaacgaguuggacucuggauuuuucuuugcaagagggacaagagugugggagauacugaguuaaugcaacuugcagguuuuaaguguccugucauugugccuugugcuuugauacauucugaguuucaguaaagagaccugaugcauuggacuguugcaauggaaccuguuuuaagaucuucaaagcuguauugauaugaaguucuccaaaagacuucaaggacccagcuuccaaucuucauaauccucuugugcuugucucucuuugcaugaaaugcuuccagguauuuuugcaaggcuaccaguuacauuugacaagucugugcaauggaucaaaaucagaagagaugauucaacuuggugaccaagaaguuucugagcuuuguggccuaccaagggagaaacuggcugcagcagagcgaguacuucguuccaacauggacauccugaagccaauccuggugaguagacuugcucacuggagaaacuucaagcacuaaugcuuucggaaugugaggcuuuuccuuggacagcaugacuuuguuuuguagaaaaguacggcuggcugggaguuugugauauaauuuaguucagugguauucuaaguguucuuaguguucuuucagacuuuugggccaucucccaaagggugaaugggaagaauaagcuggguguggcugaguuuaagccaaaaguuuuuugugcuuguuucaaucagagaagaccugcuuuuucauguuuuuacuauuauaauacuaagcaagagcucauuugaaaacagaguucuucauauuuaaaaaaaaaaagucuugaaaccauugaugggaagauggauaucuauuuauguuuaaaaacccaucauaaagaugacauugugggcugucacaguuggaaggcccuggaauuagaugagaccacacuauuuagcuuacuuaguaauaacauugcaaagaaaaauuccgacgaaguuuuuucagccuaggaaucaauaguucagagaagcacucuaugagaauacccauucauucuuaaccaaaaaauacuggugagccugagcaguuuggucaucagaguguuuuauauaguuccagaacaaauaugucucuagguguucugagagcucuggugaaauuccucucgcuaccccaaacaucaucauuuaauauccaggauucugguuuucuacucaccagauagauucucuuaaaaccagggaaagauuccuggaggaaggauguaucuggaaagagauguuccuuauuauaauaaaaugaaauuguaauacucuuggauuuugugcagcacgaauucuuuauagagaguugguccucccagagaauuaagaauacucaguuucuggacccuguucccagaucauacccuagaaugugaccuuagaaacacacuucaggauucauaccuuugauugaccaucaaaaaguuuuuguaucggccaggugugguggcucacgccuguaaucccaccacuuucggaugccacggcgggcagaucacgugaggucagcaguuugagaccagccuggccaacauggugaaacccugucucuacaaaaauacaaaaaauagccgggcgugauggugggcaccuguaauuccagcuacucgggaggcugaggcaggaggaucgcuugagccuaggagguggaggcugcagugagcugagaucugucucacucuguugcccaggcuggagugcaguggcgcgaucucgacucacugcaaccuccgccucucaggcuuaagugauucucaugccucagccuccgaguaccugggacuacaggcaccugccaccacgcccagcuauuuuuuguauuuuuaguagacauaggguuucacuauguugcccagcuggucucgaacuccugagcucaagugaucugcccaccucggccucccaaaguguugggauuaaaggcaugagucaccgugccuggucccauguuauaauuuuaaaguaagguauauuucucuacagggaucuuugcaacccuaaguaacuggccuaaaaaguuagagaagcugacuugugcagacauuugcagccuguuggucuuuuuugugcugugaaucauagagggugaaagguuauuaugaaugguacaaaacuuuguuacaaaaccauuuucuuggacuguuuugggcugcuucacugcaugacaaaugcucacccuuucagcuggaaugauugaaauuuuggaaaagauggguguuuuuagaagacauuguaauuuguuccggugcugugcccauucauuccauuucacuucuguuuacucauuaaacaccuauuguguacacaacccgguaaaaucccuccacucacacaaugccugaauuauacucauaguagaaugacuguuuagcccucaucaucugauaauuaacagcucagguuucaaccugacaguaucucucugggaggauuagcagcgugacagagugcagggaaaugcaccuucagaaccgucagcuacacugugucccauccugcuguguugugguugugccuuguggaugcguugguuuaugaccagguauugauuaagguggcuacuaccaggugcuuucugcauaucucggguuuguggagcacucagguucugcuucugccccucugcuguuaccaagagaccucucuucaaaauggggcucuugaguuagaguagaaugagugaucaggauuguuuuguguaaagaugauuucugaggaaggcuuuaggaugaaaugacuuccaaacauuuugaaaugugacucuuacuuauugaauuaagcagggccuuaauuggaaugcugggacugauacuugauuugcauuaagcagccuuuuucuauugcugcuugguugaaauuucaacauuugugaugguagauggaugugacaugugaugacauugcacaugggcaguuaacugugccaagaagugcagcaguagcagcaaccggagaugcaaagcccaacaugauggggagagaaacucuucuuucaauaugugcuucuguaccaaaaguggaauuucacgagagacauauuuugaaacauuucuccuuuugugugugcgugaguguuucccuguuuccagccaaggguauugugaguuucuccugggccuccuucagaaucugggugcucuggaaagcaguguuuuggcaacauggggaaaguauggcagugugggagggucagcugggucuggguuugaauauugcauuugaauauuuuaccagcauugaugucggauaaauuauuuagucccuguaagccucaguuuucucuucuucuacauacacauaauauauuugacucuuuguugugauuauugguuacacauaugaagagccugguguggggccuggcacacaauaggugcucaauaaauagaaguugauaauuuaauugacaugaguaguagaaauuauguccuugaaaacaauugcgucaagauagaaguuuucagccaggcacaguggcucacaucuguuguaaucccagcauauugugggggccgaggcggaugaaucacuugaggccaggaguucaagaccagccuggccaacguggugaaauccccucucuacuaaaaauacacauauuugccaggcaggcgugguggcgcacaccuguaaucccagcuacugaagaggcugaggcacaagaaucgcuugaacccaggagguggaaguugcagugagcugagaucacuccacugcauuccagccagcgugacagagugagacucugucucagaaaaagaaaaaaaagauagaaguuuucuucuguagaucaguguuagaacucauaccaagcgaagugguccuggugaguauuucagugaaaaacugcauucuugcucagauauugucaagacuuuucacccaaagauucuuauuuaugucucaguccguaccuugugugaaaauuaauacuggaugucagaacgcuguuguguuuuuaaaguucccugggguuaagagcaguuuccauuagguguucucugcuuuuuacuuaaaaaucuuacucaugcauugagcaauauuuauucaguucuuauuaugugucagguauuuucuaggagcuggacucaacucaaaagauauccuuuugaugagaacaaagguggguggauauaugaaauauuaucugugggauaaaugcacuuagucaugagggagacuuguuauggagugcgcucauuguauuuguacuguugaguuaacaacuucuaggaggagcucagggccaccuggcaggggcuucuuuugucuugcugcucagcaagguguauuuugcuguagagugugcugggcaggugaacuuuucuuaacuuucucuuggguccuuccuaaagcagcauguaccuuucccagagcgaggagagggccaccuuccugucucacagaaaccuccaaucuguuuuggacugcaggaaggagccauaguaguggaccagcaaauuuuggcccgagagauugauuugcuuccgauuguacuuuuuuuuuuuauugcuacuauaacaagucaccaaauacuuagcaguuuauaaccacauacauuuauuauuucauaaggccagaagccaggauacaguagagcucaccuaggucuacuucuuagaggcucacagggcugauaucaagguguuuguggggcuguguuuuuuugggggggcucugaagaugaaucugcuuuggagcucauccaggauaucagaugaauucagucccgugcaguuguaggacugaaguccauuuccuugcuggcugucagcaggggcugguuuuugcuccuaaagguugccaucauuccuucuuaugcuuuucaugugacuccucucccacaaguggguugaguaucucucacacuuuaaaccucugacgccuccugucacaucugucuccagucagagaaaguucuuuacuuuuaagggcucagguguuuaguuugggcccauucacauaauccaggauaaucuccuuauuuugagguucauaacuuuaauuacaucuacacagugcauuugcuaugaaaugugcauauucacagacuccaggaauaggguguggacaucuuugcaggggauauucagucugcuguagcuuucuugauuggaaggaauaguuuaucauauauuugaaguguucccucagugccuuuggcuuuuguugaccccucugcagcucucugcuuuuucuugcccauauuuggaaagugacucuaaagcauaauaagcaucaccuauuaggguuuuuaauguacaaaccaaacagaggugacuuugggaggagaacaucucugaacuagguaugagacauucaucgaaaaaaauccaucaaguguuuauuguaugucugcuuuauaccagcacuguucuaggcacugaaguucgaccaccaacaaggcaguugugaugcacuuggagcuuucauucugaugggcauugagauccaggcugaaggcugagucugggaauuugaggaauucuuuguagguccugggucuacagagugagagcuguccucguuccaguuucacugaugaccucucgaccagcucccucacagcagucuuugccaacacagacacugugggcuguagugggaggaaugugggguugaaugagcuagguuugggcucuguccuugacucaccauugccucagugaugugaaaauggugucugauccuuaagguuggaaguccaggcaugcagauuuaucuccaucucaauaacguggggaaaaaaaagaagugguuuuuguggaaccagugguuccacuguccacgugucuuccagugugccuagcacauucccaccaaguggaucuugguucaugagggaaagaagggaaagugagggugccccgaggcucccagaagacaaguaaugucacagcugagcuguguacagaucgaagaagcagauggauaaggagugaacaaagucauccuugucuugaggggucuuuauuuagcuucuucuugacucuuagacaaggacccagaauacagauggggcuuguuguuaccuucagccucauggcuuuuuagggcuagauacuucagcuuguuacaugcaguccuuaaagcgucuguguggguuuuugcaggagagaacacuugcucguguucuccugucuggaacccggacauuguuggaaaguaucagauuuuguuuggcuuugugugauuugacugcccaccuguuuacuugcuuucucccagcaagcagccgcaauccccauggguugguaauggguggaaugacacacuguguagauuuacucuucagacucuauguucaccucauucuuaugggaaaagaagagcacuagcugguagauauagcaguguguuaauaugacugcucaacuccauuuacacagacauuuucaccuuaguuauacuauuucuucauuaaauauuguugccagaucuaagauacagguuuaauuuuuuccucugaauuaugugguaguagauguauuuaacuauguuuagaaacagcaaaaaaugaagcguuugaaugcguuaaacacaucuaauuugaaaguuaauauuuagguuguugauuuauuuuuuaaaagauuagaauauuccuuagaaauguagucuuauaauuucguauuucaauaaaaaauauuaaaauguuucccagaggaaaucuuuacugucauagaaaucaccagaaagagauagcaauuacuccuggguggugauagucuuugauuugugguuuacuuguuuucaguuugaacuaaaacauacuaaucccagccugaguuggauuuugcauauggucaaagugaaguagagauuuuugucuacuuuaugaagauauuuaaaggacauuugaaauguuucaaugaacacauuguaacaugcauucccaggaggaaaacaaaauuguguauuguguugaaaauacuauuccaauauauguauacccacgucucauuuugucauagaauuccugaaaaauuuagauguagaugagauuuuuauaaguugaaaauauuuucaguugcauuuuaauugcacagauguguuuucuacuucuauuuggcugugacuccuaaugcauuguaauauuaucuuccaguguucauuucguguagugauaauggauuaacaaaugcauucauucauuuaguaaacauuuacugagcccuaaucagugccaugcucuggcccagggagguagucaugugcaagguccagcccucucuguuucauuccugguuggggaaugggugggacagaccaggaaaggagcagcugccguauagagcaggagacgcucugcugggugugauacagucccugauggggccuccuacugcagucuuuccagucaggaaggaaacauccucuaaguggggaccuaaagaauggaugucagccagguaaagaacagggaguagaauguuccagguagaggacauaguauaugcauugguccagagaggagagggaagagaagguggcauuuaggggaacuguaccugauugagauaguucagcauggagcagauauagcuguggggaguuugaugggagaaggaacgaugagacgugaugccugcagaggugggcaaaggucggcugaggcaggucuuucuucacgagccaugugaggauauagggccuuauccucagaguaaagggagccauuaaaggcuccacaggcugagugacuugaugaggugaauacgaaacagagcauuucugugaaugugaauggccuuuggagcagaacuaaguucaugaggauggaaagaauauaaugaagccaucucuuagacccagaaagaauggggcacaacagccuuuaucuuucuggggccaaugucacagaaugccaugcuuuuaggaaacaugguauguugugauuaacacauuuugcagaagugggugggagcuuuugaauaauaacaguaagcauuugugcauucuuccuguaaugacauuacaguuaugaucugaaaauauugagucauacaugaauuccuguuaucuuaacucagaaaauauagucccucacuaaagguuuuauuuuccuucuuuuucccauuuccuuuacuucguauaagaaagucacuugucuccugggugcaauggagaccuaugugaguucauagccaagagaauguuuuugguuagaaaaauaauaguaggaauuccaagcugugaauuuuuuacugaagcucuuuggaaauaggauuuggcaaguuuugucugccuucgucaaguaagcaugagcaggagagcacaguuaauagcaggugcagacacaugauucucagaccguauuuuguguucuaguuucaaggcaugaauucuuuccugggguuaauuuuauucaaggaaguuaucugucuguuagaucugauaugugcucaggccaacauagauucuuuacccuuccuuucuuccugcucaccuguccuuccucuuuuaucuuuucauugaauuaaaaagaaaauuaugaaauaguuucaacaugaaaaaagguacagagaauaacauaaagaacacuccuggcugggugugguggcucacgccugcaaucccagcacuuugggagucugaggcagccagaucacuggaggucaggaguuggagaccagcuuggccaacauggugaaacacugccucuacugaaaauacaagaauuagccaggcaugguggcgugcacuuguaaucccagcuacgugagagacugaggcaggagaauugcuugaacccaggagggggagguugcagugagcugagaucacaccacugcacucuagccugggugacagagugagacuccgucuucaaacaaacaaacaaacaaaaagaacacuccuguaccaucauccaucauuuugccgugcugacuccagguucuauuuaagaaauaaaacauuacagguacagcugaugccaccucuguuucccuagcucauucuucagagauaacucuugucuugcaguuggauguuuuaauccucuauaucauguauacuuacauucuauguauaacaauauuugguacuggccuaaauguguucacauuguauaagugugcauauuggccugccacuucauuuggaauuauguucuugagauuuaucaauguugauacauguggaaucugguuaauuuuugccauaguauucuauuuuuauacuaaacuuuuaaaaauccaugcuucuagucuuuggcuuauuuuuucagguuaugguauguuuuggaugcacagaaaaguaaaauuaagucaugagcaaaauaucuggauaauccaagcuuuaaacuugauguagaauuugaaucauguguguuuuguuaacccugugaugucaauccaugccugauuguguaacuccaaccaauauuccuuugaaaauggaaauuuguuuauauugacuacagauugccaauauuauuaguaaaugcugagcacuuaaucucgaauaaagaacuaguuuaaaaaugauucuaacaauggcauugacuguucuaccuuauuacucauggguggguucagccaauguuucuguuggagaccaaaaccaaaaacagucaaauuaaacaagcagucaaacccaacauacagacuacugauaagaaggucauaucauaagauauggcauugaauuugugucugcuaauguaaaaaucugaugcccacagcaaacuuaauaaggaccuauguuuacauccaugcucaauuacauuccuggguuaaacagucaugcuuuaggcccugcugugugccuggaguuuugcugaaguguggggcuuuuaagagaaggagaauaagcuugcuccagaguuaagaaauuuaaacuaaaaguccuaaagauguuggaaaaacuauugcccuugaagauguaaauucauuaaguuggagaagaccuuuuauacaaacaacagacccauucacugauuuguacccuucaggagacagaugaccgguaauggugacaaugggugaauguuggguuugggguuuuuagaaacaucugcacuuggugacuacuguaucuaauuggugugacaaaccuggcaccccauguguuuggcaccaucuuggguccuacucagggccaggugaaccgaguggccucuucacugcuucagagucugaagcagauuguaguaugcggaccagacacagaauauaccaccaagcacguuggcgcaaagcauacugggaagggaggcuuugugaacauggugcugguucucaaaccucagugcucaaaagagucuccugaggauuccuggaucacacucuuaaacuucucauucaguagguguuagcugguugagaaucugcauuuuuuuuuuuuuuucugagaccgagucucacucugaugcccaggcuggaguguauuggcgccaucuuggcucacugcaaccucugccucccagguucaagcaauuuuccugccucagccucucuaguagcugggauuacaagcacaugccaccaugccuggcuaauuuuuguacuuuuaguagagaggggguuucgccguguuggccaggcucgucuugaacuccugaccucaggugauccacccacuuuggcuucccaaaguguugagauuacaggugugagccaccaugcccagccugaaucugcauauuuaacaagcaccacaggugauucugauacaguagcuccccaaaccucacaguguuagugaaucccagucauuuacaauucugccaugauuuuggucauauucaagugcagcugguagcauuuuuaguuaauauauuuuuuaaauuaagucacuucuuuuggauaauuaaauuuaauuacaagggaagcuauaccacugcuguaaaaacaucaccugcuuuaaagagaagguacauaaugaauauacauuaagauaaagauguauaugugugugugugugcacauauaaguauacacauaccuaccauagggauugaguuuuccuucagguuuuucaacugaaaugucaacuuugaggccaguuaauauguguaagauauauguguguauguaugucuauacauauagacauauacguaaaaacauacauggaugcauauaguauaucuauacacaaccuauuaugcauaucauguauauuucauccacuuaguauuaucuuuuauuuugccguuuggcaaaugcucaguaaaagaaaaggguuagaaggggagaaaggcauuuuaucccaagccuucaggaaucaggaugaggaugucuucaccuugugguggggaguaauuauacaauuagagacagcacauuggaguguggcugauaugcugugugaugauagcucuagcucucugccuagcagaggaaggacauuucaauagaagaaaaaguuuaagaccuugccgagaaacagagaaaggauguuugucuuuuuaagaaguugaaaacccuguuugcagacaaaagcccuccaguuuuggcaguaaacuuucaugcaagggaagaaaaaggcaggggaugacauuguugacaauugugaggaauuaccaugugccaggcacugugcgaggggcuuuguacauauccucuaguuuuagugcuuauaaaaacucugugauaugugcacagcauuuuaaacuuugcugcauagucgagaaaauggaaggauggggaauuugagucauuugcccaggguucuauagcuaccccagguucccaugacuggagaauuggggcacaggguggcgggggagagugagugacaagaauccuaacaaucuuauuuccauugaguccuuauaaaagaaguggauuaacuaccacguuuuuaaguuuuucuuaaauuuagguuauguggaucuggcguuucuuguuuuguccuggguuuguuuuguuuuugcuaugcugucuugaacaucugucaucuuguaggccuaacgguaaacacaaaaacacuuuaccuccuauagcuuucaauuaagaucucucaguuuguguuuguaauaguuuuccaggcaaguucucccuagguucggcuucuaguguguuaaccuuuaguuauaaagugaacccaaagagagaaaguagaaacaaaacaccucaccuguuuuugcucaugaauuacucucuauggaaggaacaaucaugaacaccucugcguaucacagaggccuaucugagucugacguuuaagggagaccgcguaggucccuuugaggacugugaaugugggaguccugggacucuggugaagaacccguuccagaagagaugaaugagcuggacaaguucuuucauagaaccuuuaggcagguuuucuuagaaaugcacauugaggauuaugcuuggauauugugaugaucagaaugauacucaaucccuucugcauuuggaauucucuuugaaagaaaacaucccaggcagcuauuucucagagauagugagucccagccacuucuagacauuuucuuguguagucuacauuauaauuucacagcagucucugauaugacaaaugucaaaauagcccaaccuucucuaaacuucagagaugucugauaugauauugaauaaaacaaugcucauagaaacaucaagaaagguggauuuucccuggauacuuuuuuccugcuugacaaauaacagugaagaaacugaucucacgucuuuuucucuuuggaagccugaacacucagaacccaacuugaggcuccucagcuauagcaauucugacuucacagucuguaaauuauuguucuuuuuuuucuuuagcuuaugcuuucugcccuaauuuaucuuuucccuguucuaaugaauuauuguccuauaucugcugugcaguuaggugacauauaacagcaauuaaauauaugaauugguacauauaaagauuugacuaaaacucgauguaaaaauaaguguucuacauucaauuuccaguguuagaaacagugcugacuugaacagagugacagaauuccaucuuucccuauuuuugacagcuuuaaacuuuauauuuucuuccuuucuugugagccgucauuaacuuguuucucaaagccauucccguauuacccaucuugcagacgcagacagauuugggaauuugcggucagaguuguauuggacacauccccccagcccacaugagauccuuuuaaucuauugcauauuaacuaguuuuaaguacaauauuccuacuucauuuaaaaccauuaaucaaagaaugaguuugaaaaugaacaaaaugcaaacuuacaguuagaaauaauuguagugucuuuaguuuugguuaggagucgguuucuuguuuguuaaacucaagauugugaacaguuuuaauucacuuguuuauuuccaauagagauuucagguuuacauuugaauucagaaacaaaguuuucuuucucauuacagagaacacuaaacucuacaucucccuucccgagcaaggagcuggcugaagccacaaaaacauugcugcauagucuugggacucuggcccaggagguaaguugugucuuuccaguaccaggaagcggaucauccacuguaucaguauuuucauuccugagucuggcaagagguccuuuugaguugaauaucacaugggauguaauaucaauuuucaaaguauaagugauguaaacaauaauguuuugauuuccuuauuuuagaaaugaagaaaccuaaaacucauagaugucucagagcuaauugguuaguggcuaacagcuggauaucuaguuuagaaccuucuccauuuuuucuuuuugccccuagguaaucauacauuuguaaagaggagaauuaucucugccacugcccaugcacugcuuuugucugaccagcaauuucuccauauugcuucuucaguagcaaggccaaucauuuuaccaacacacaugcuugcuaacuaacaggaauaacgugguaccccuaauucagcccuuucccuugaaagcaucuggcuucugagguucaacuaugggaauauggucucuuaaugaacauuaaguugaguuugccuuuuagguccacauguugacaaauguaucagaguaaucucuguccuaggaucagagggccuguaggcacuugcaaaagcaguuagcucugacucccagccagugcacacuccaccuuucugacucccagccuugucucaaauuaggcuuggaagcgaggaacugucuggugucccccagcauaggaagcugagccagggggcagugcucacaaacaauacagacuuuaacguguaggauauuggaaaauaauaauuuguggggaaauugucucagacuugguccacccuuauuuuuagcugcuucucuaauccguuuuucuuuuuuuggugcuuguaucuaaccuacccauuuuuuggugcuugcaucauuuuuucaaauaucaaaaacgaacuuuauguuuucuaacaaugaaaguauugcauguucauuguggaaaaugcugaagacuuggaaaauacaaaaaugcugagaucaaacacuauugauacguuaguguauuucuuccuguccuguucuacuuucuuucuuugaauucugcucacguguuucugacugaugaggucugacuuuuggguuccuuuuccagaggagaagccuucuuucagcuugccauuuguuacccugguuaugaaggcugguaaccuuuuuuacuagguagagaagcuggaccaacugggguucuuccagggggagaaugagaaagagaaacuguuuugcaaguccguagcuauuucucuagggcccuguuagcugacauugacaugccuugcauugcucugcagauccccucgcagcccucugucccuuguucauuucuggccuuagagaaagcaaagcagggucuguaacaggggaggcugccucuaaacucaggguuugguuacagcuguuuucacuuacaucacuggcccugguuuuuuuuuuuuuucuggcauuaaaaaaaaaaauuggaagcaggugauguucccauugcugaugugguggaaacucuccaagugaacaauauacguuuuucuuggcagcuguuucuugugcccugcuugcuccugguccaggacaagcaaggaccaucugccucuuucaauagaacaccuccagaucccuuugaucaaaaguuacucauugucugacuugcuauuucugugagauaaaugggagaagaucaauaaaugcacuuguuuguccagucagcguguggaaaguugauaauuuugaccaaagcacaacccuugaaaggaaaagaaaaagggagugaaugucuucugagaagcugccuagguucagacagugucacccauuucccuguaugcuccacaugacaaaccugagugggucucaucauguccauuuugcagauggcaccaaggcucagaaagguuaggcaacuuuuccagucacccaaugaguuaauugacaaaacugggauucaaacccagaacuguuggauuccaaagccuguguuguugccugcuucgugaaaaacuccaguagcgacuggaauagaaaggagaaccuuccaagaaagaaaauacgcacuagcagaaccuggaaauugggaggaaaugaggacuugaggaauaagaugaaugaaagcugaccugaguuucacaucugggugaugggaagggaggacagggaggcagcaucucagauguccacccagcaccgaccagcugccuggcauugcuagguguugaggacucagcagugaacacgcuaacuucucugcuuucuuggggcacguauagggugagagacagaaacaaacaggucaguguacaaugccacaggagggauauaugcagugaagaaaaagcaggguaaggggcauagagcaugagaaggugcuuuuuuuaaagggggugauuaggaaagcucucucuaaggugacaguuggaccugaaggagaugauagcaugucuguggugagggaaggaaacuccgaacaggaagaauggcagauacaaagacauugaugcuagagcaugccuaaggaauguguuuaaggaccagggaaagugagcaagugguggggggaggagaggagcucagagcaggaggaggugagugccauacaggccuggcaagacuuuggauuccugcugggugagaugagaauccagcggagggcuugagggaggggacaugaugugaucuagaguuuagacuguuuacacucugguuguuggguugagaagagacugggaugggggaaagggaggacaaaggacauugugcuggauugagaaagcaguaagucaguuucauucauucacucaaccgaugauguucaaauaccaccaucauccgugggcuaaaggaugaagagccaucccucccugagagucaggaagcacuucccagauaaaguuuggagugugagcugagguguaggagaaagaguaagaguuuaccccugaaacgggugcugggaagagucaauaguuuggaauaacucaauaauuuauggugcuucuuuagaaagauuugcuggcuuuaugugggaagaaauuuuuuuuuuugauuggggagugguggguugguggugaggcugccuguggaaagagaagugaguguuuugacucacuguuauuuaaaaaucucuagggcuguuccaauaagcaacaaaaggcaaaauggccugguucucuguccccuuucugucuguaugccucguacagguuaugaaaagaaaaaguugggaaaagcuguccaccucaccuaauuguguucuuguggagugugcuagaugcccccucucuggagaaaaaaaauccuuguggccucugacccaccucuggagagccuaguucccuucuggaggcagaaggcaaagcuuaggaccuagagagugcuggaccacgccacucacaggaaccagcaggcugugagguugaaagcuaggcauauggagcuuuccaggcugggugcagggccucguggcccuuccccuccccucugugcucuauagcucagucuucccaggcggugugaacacgcagugacauuuccaggaauacagggauuuauuaaugauuucuugugaaauguuuggaaauacaaaguacucuauaaauauuucauaauagcauuggggcugagaacuccacaaagugccggaauacauuugcauguaagacagaacgcugccugggucauugaugccuguugaguggcagucacagacacugccuaggguuucugacucacgcuguugggacuguucuaugcagggcacccucuuguguggcauaggauuugugccucaccacacacuguuguagcuuugcugucuugaugaugaguagagggcaguguccaggccaugguauaagcaucuacugccccccaggguuaccaaaaccaagccaaguugugucucagcgagcuccgugaagcauggagaaguugaguacucagagacaugacgugacuuuucaaaggcuguaagcugacgagggacauagcuaggguucagacuugaguuuuucuuuuucuuuuucuuuuucuuuuuuuuuuaagacugagucuugcuuuugucgcccaggcuggauugcaguggugcuuggcucacugcaaccucugccucccggguucaagcaauucuccugccucagccuccccaguagcugggauuacaggcaccugccaccaugccuggccaacauuuuuguauuuuuuuaguagagaugggguuucaccauguuggccaggcuggucuugaacuccugaccucaggugauccacccgccucgaccucccaaaguacugggauuacaggugugagccacugcacccggcccagacucgaguuuuucaucuuaaugcuuuuucauugccugacacuuuacugagaccaagauagggaacuucacauacaguaccuuuucucccaaggcggaagagggcuguucaauuucuacacuagaguucggggaguuuuagaaaugagucaguuaucgaggaugagagcaguuccugauaggcucaaccacaaugagauguagcuguucagagaaagcauucuuuuaucuauaaacuggaagauaaucccggugaaacgaagcccagccccaggggcuucacuaacuccaggcugugcuucucaaacuuuagugagcauaggaaucaccugggcaucuugugaagcuguagauuugaauucugcaggucggcagaggggucucagaauccgcauuuccaacaaugucuccaguaaugcugaugcugcucgucccuggaccacagauuggguagccagguucuggcaagcucaucccaaggcuuugagaugacaucagacaaaauauguucugggacauggcuuuugagaggucaagaaaauaagauguuucuuucucuucucauccccaacccuugcacugcccuuuucucccuuccccuacccuccuuucuguccccaucccugacgccagcuguucagcaugagaagcuggagugacaugcgacaggaggugauguuucugaccaaugugaacagcuccagcuccuccacccaaaucuaccaggcugugucucguauugucugcgggcaucccgagggaggggggcugaagaucaagucucucaacugguaugaggacaacaacuacaaagcccucuuuggaggcaauggcacugaggaagaugcugaaaccuucuaugacaacucuacaagugaguguccaugcagaccccagcccuguccccaaccccaucccucccuuaguucuggccuuggccugugucaucuccucccucuguagcagcguuagaugucuacaugcccauuugcccaccagacugagcucuuccuagaggagagaggcuucucuugaauagcuaccuguccccaguucucugaaugcagccuggcacaucucaggugcacaguaguguuuaucaauggaaugaaugauugacagccaaccuucugguuuucugggggauguggaaggguggcuuccagggugaucaagaaugagauaauggcagaaggacaaauccugcaagaucucacuuauauauggaauauauguaagguagaaagugucaguuucacaugaugaauaaguuccugggaucuugauguacaucgugaugacuauaguuaguaacacuguauaguauacuugaaauuugcuaagagaguagauccgaaguguucacacuacacaaaaaaggcaacuaugaggugauggauuuauuaacagcuugauuguggugauccuuuuacaaaguauacauauauuaaaacaucacauuguauaccuuaaauauauacaauuuuuauuugucaguuguaacucaaaaaagcuagaaaagcauuuuuaaaaaggaugauguacuggucuuaauauuaccauugagauaagcuuuauaauaacauaaaaagaaauaacaguaaugauaauagcaacaacaacaacaacaaagaacuaacauuuaaguagaauuucuugugcacugugcauucuguuuaaguuaucucauuuuacccucaugauaacccugcagggaagauucuuuaaccccacauuucauaggcucagagagguuaagugccuugguuagagccacaucagaguuaauccacaagagccaggauucaagcccaaaucugccuggaucugugcucucuaagauaacuguuagugguggcguguguguucucacacucagacauuugaucugcccuuuguuucccauucuuagcugcaaggcaguguuaaagaacccugugucuccauauccacuccccacacuuaagcacuuuugugggcccgugugccguaugccucguggcagcagggauccaaugucacaguuuuaggcaguggcauccuuuuccuugaaaacuugaugcaggggaaccuuucuccauuuccaaccacaggugugucuuucagacacugagugaggcagguuuuguacuuuauuguaacacaagaaccuuuucuucucuggaguaaagcacuccagacauucgcaaguugcuuuacaagccuuaaaaggaugguauuguaggcaacuuuaauuaaaucccaucuccuccucucccccagcuugcaaguugacccaaggaagccuucauuuccaugacagacuuaauugugagggcauccucauuaaaaaaaaaaaaauucuauuaucuuuccagcauauagaagauacuugguaucuaaaaaucccugaaaaacuuagaaugaauuuuuaaaaaucagggauccugcuggauaaccaaacccauuugucuguuacaacuuuuguauuuggguuuuuguuaaguguacauauacuaguuuguguuaauuaaagagaauuuuuuuuuuuuuuuuugagagggagucucgcuccguugcccaggcuggagugcaguggcgccaucucggcucacugcaagcuccgccucccggguucacgccauucuccugccucagccuccugaguagcuggaacugcaggugcccgccaccaugcccagcuaauuuuuuuuuuuuuuguauuuugaguagagacgggguuucacuguguuagccaggauggucucgaucuccugaccucgugauccgccugucucggccucccaaagugcugggauuacaggcgugaaccacugcgcccuguugagaauuuuuuuuuuuuuuuuugggagacagaguuucgcucuuguugcccgggcuagagugcagugacacaaucucggcucacugcaaccucugccuccuggguucaagcgauucuccugccucagccucaugcgucaccacgcccagcuaauuuuguauuuuuaguagagacaggguuucuccauguuggucaggcuggucucgaacucccaaccucaggugguucgcccgccuuggccucccaaagugcugggauugcaggcaugagccacugcgcccagccccaaauuuugguuuuugcuugaaaacugaggucugaauucagccuucugguugccccucaagagucaguuuaaauguuggucauguuaguugucagugaaaacaauggugaggcuggcaugagagugugaaucuggaugggagggcuugugcuucaugaaaacauuuuuccagaucagcucagucgugaguuauccgucauugacguuauaauaagcucugauuauuuaucaagcaucauucuuuauagauaucucaguuuaaucugagauaaucuucuccacaucucuccacauagauguuaugaauuuuacuuuuacagaggagccaacugaggcucagauaaguuacuuauuauaugacuaguagugguagagcugggguuucaacuaagaacucucuggcuccaaagcccuuguaaguuucuaucaguauaugaccaugcauaugagcauuugucucuccucuucuucauagcuccuuacugcaaugauuugaugaagaauuuggagucuaguccucuuucccgcauuaucuggaaagcucugaagccgcugcucguugggaagauccuguauacaccugacacuccagccacaaggcaggucauggcugagguaagcugcccccagcccaagacucccuccccagaaucuccccagaacugggggcaaaaaacucaagguagcuucagaggugugcgcuaaguauacucacggcucuucuggaauucccagagugaaaaccucaagucugaugcagaccagagcugggccagcuccccagucguggguauagaaucauaguuacaagcaggcauuucuuggggauggggaggacuggcacagggcugcugugaugggguaucuuuucagggaggagccaaacgcucauugucugugcuucuccuccuuuuucugcggucccuggcuccccaccugacuccaggugaacaagaccuuccaggaacuggcuguguuccaugaucuggaaggcaugugggaggaacucagccccaagaucuggaccuucauggagaacagccaagaaauggaccuuguccgggugagugucccucccauuauuaccaugugccugcuugauacuggagaggugaguuucuggucacuuucccaggugugagugaggugagaauucuuucaguuuaucuagcugggggaauguagugagcauagcuaaagucacagggcaccaccucuccagaaguacaggccauggugcagagauaacgcugugcauaucagcauccaugccacucacggucaaauagcaguuuucugcaaaacuuagugagggcugguguuuggaaguggaguugaguaauugcaguacccuauuuuccuuuuuggcugcagccucucagccagccacagcaucucccugugucuugguagguuuuggaaagaagugugggagcaaaagcaugauguuacauguagacuggccugagauacucauucucagggcacugugugaaugaugagcugcuguuacuguguggaggggaaaugcacuuagugcuucagagccacuugaaagggauaagugcucuagagacaauuggguucaaauguggagcaggcugagcaagaacagaaugucuccuuugccugagccugagugcuguuaaucacaucuuccugccuugggcugaguuagagaaucauuagacuauuuccuguuuccauggugagggaggccucuuccuuuugucucugcuccccuuaagaagcaggugaggauuuugccagguuucuuguuuugaaccuuauugacuuuaagggcggcuggguuuuagagacuguaccuaccuagggggaacacuuccgaaguuuaggacuauucccugauccgcugggaggcagguuacugaggaagucccuuuaaaaacaaaggaguuuauacugagaaaagcauaaacagugauuuguauggauucacacugacuaauauagcucaugccauuaaaguggggucucuucucuaaaggaggguuauaugaucuagccccguagaccuaagugugguuucagaccuguucuuccugguccucuccuuggaauccauauuucuacuaguuggacuuuuucuguuugucuggcucucagaggauuauaggaggcccugugaagugacucagugaauuuugauuugugggcaaguagaugguucccuagucugaaauugacuuugccuuaggugcuucaauucuucauaagcucccaguucuuaaaggacaagauccuuguaaacauggcaauggcauucauuaggaaucuagcugggaaaauccaguguguaugcuuggaaaugagggaucuggggcuggagagaaaggcaugggcaugccuuggagggacuugugugucaagcugaggaccuuuacuuuaagcucuaggggaccaggcaaggggagauguagauacguuacucugaugggguggaugaauugaagaaggaugaggcaagaaugaaggcagagaccagggaggaggcucuccaaguggccaaggcauaaagcaagaaaugaggccuggugacugcuuaguggcagagcagugaaagagagggaggcaucaaagugagucucgauuucuagcugggugggugguagcgauguccaguaggccaguggcuacugaggucugcaguggaggagggugguugggcuggagacagaugaugagggagucaucagccuguggguggaagaaaagggaaccucuuccaacuguuuucuuugcuucuucccucucuuucucuuuuuuuuuuuuuuuggacagagucuugcucugucacccaggcugaaaugcaguggcaugaucuuggcucaccacagccuccgccuccuggguucaagcaauucuccugucucagccuccagaguagcugggauuacaggcacauaucacugugcccggcuaauuuuuguauuuucaguggagaugggauuucaccauguuggucgggcuggaaugaacuccugaccucaagugauccaccugccucagccucccaaaguguugggauuacaggcaugagccaccgcgcccggccuuucuucccucucuuaaagaguguuuauuuaauuccacaaacaugagcuugucacccccuguagccuggcaucuccuacacgaggugauggcugaggcuucugcuucugcugggguagcucugaucuuucugcuuucucuggcacugucuacccauguugccucaccccacaggucccagggcaccucucucgggcaagucuuggaacccucugacacugauuugcucucuuuucugagcugcuuuuagccacccauccucgggaccuguuuucucucugccuccaccccugcgggcagucuuaggucuccugccccucacgagcaccccagagaggccacgugcucagugaucucagugggcgcaucuuucuagucuugcuauucuuuuuggccauguuguucagaaaccauacugggcagggccgacuucacccuaaaggcugcgucucuucacucugcuuuuguuuguuccaaauaaaguggcuucagaauugcuaacccuagccucugugaacuugugagguacaauuuugugucuguuauguuaacaaaaauacauacauaccuuccuggugaugguauaaauugcuauucucuauuggaaagcaauuuggaaugaaaauuuaaagaaccauuuuaaaauaugcuauccugcguaccuccauuccacccacccccagggauguagccuacugaaauaauuuuaaagaagucaccauaugagagaaaauguuauugcuauauuguuauugugagaaauuggaaauagacuaaauguucagcacuauaggaauaauuaaugaaauuacauauacucuauacaaucauuaugcugccauugaaauaauaaauacaaaggcgcaaggggggaaaagcuuauaauguuagugaaacuaagacugauuuuuuuauaaagcagcaguuuucagacccuuggagacuccaauucgguagaaccagagcuucaucuucucugucgaagcugugacaggaguugcaaaugccucuccuuuuugcugaguuugcagcugcuguuuuuccggcagcacaucugugcaggccucugccucggccccucuggaucugcugauugagcagcggauugaucuguccuucucuuucguguugacccaugugaggaaccaacuggcaagggaacaagaaauggaaauaggccuccuuugcaucaugaccuguacauccugcaauuggaaaagauuguacuuuaguugguuuaaccagcagcauuauuuuucuaaacuaagcaguaagaaggaauuagguuuuaugugggaucaacagacugggucucaaaagaggaaggugauagaacacaguggggagggggaggugcacuagaaacagagggccuaugcuuucauucuggcuuugcuacuuaauagcugugugacccaaucuuagagacuuaaccucucugaacuuccauuuucucauguauaaaaugggaaauauuaaaggauacucacugggcugguggcuugugccuguaaucccagcacuuggggagguugaggugggaggaucacuugagcccagguguucaagaccagcccaggcaacauggcaagacucugucucuaugaaaaaauuaaaaauuagccaggugugguggugugcaccuguagucuuagcuacuugguaggcugagaugggaggaucacuugggcuugggaggucaaggcugcggugagcugugauuccaucacugcacuccagcccgggcggcagagcgagacacugaauccaaacgacaacaacaacaaaaggcaaaaaaauaaaagugcccucuuuauggaguuguguaaggugaagcauauacacuauucaacauaguaacuauauaaaggaaguauuguuguuguuacuguaguuaauaccauuaagugagauguuucguauaguggaaagcacauggacucugaauucagacuggucugacuuugagucucagcuccacaucuaguaauacuaugaccaagcccugguuaaaaucauguuuuuuuuucuucagccucagucuucucacauauaaaauagggacacugucauuuaccucaguuuucugugaggauaaaacaacgacaguguauaugcaaguauuuuguaaauuuuguagugcuccucaagauuuaguugguguuuacuacuuguacuuucucacuggaauggcagaugcuguuggacagcagggacaaugaccacuuuugggaacagcaguuggauggcuuagauuggacagcccaagacaucguggcguuuuuggccaagcacccagaggauguccaguccaguaaugguucuguguacaccuggagagaagcuuucaacgagacuaaccaggcaauccggaccauaucucgcuucauggaggugaaucuguugcugggaucauuuagaaaagacuuaacggcuucuuucucugagacguuacaauaagguucaggcaggaggcaaguuuagaaauaauguauagucucauuuacaaaacuaucccucaagccuaacacaggauuugauaacaaaaggcacuuaauaaauguuaguugagugguugaaugaguaaauaaacucuagcuuuaguaaauuaacucuagcuuauucuauauaggcucaagagaauauuucuacccauuuucuucuagguuuuccuaucucagugacuaaugguagcaaagcauucccuuaaaaaggcauuauuugugaaacuuaucuaaaaucgaauucggguccaauuaaauuuuugaaauuuuauauuaaaaauuauauuaguagggauggguaagagguguuuuggucugguugguugguuaguugcuaugacucagaauugcuaagaaaacagaaaaguaagauaagaucauuguuuuaaccucuuuuccuccacaaaaucaauaaauaacauaucccuaaauuacucuuagaauuucucuuaaauugcagugaaaaaccaaaauccuucauucuugguugaagguuggaaaacuacguuagagaggauuagagagagaggaugagcaaucguguagucagcccuugccuccuaguguaggauuugucucagccacugcuuguuguccuggcugccaacguucucaugaaggcuguucuucuaucagugugucaaccugaacaagcuagaacccauagcaacagaagucuggcucaucaacaaguccauggagcugcuggaugagaggaaguucugggcugguauuguguucacuggaauuacuccaggcagcauugagcugccccaucaugucaaguacaagauccgaauggacauugacaauguggagaggacaaauaaaaucaaggauggguaaguggaaucccaucacaccagccuggucuuggggagguccagagcaccuauuauauuaggacaagagguacuuuauuuuaacuaaaaauuugguagaaauuucaacaacaacaaaaaaacucaacuuggugucaugauuuuggugaaauugguacaugacuugcuggaagguuuuucauaggucauaaaauaacaguaucuuuugauuuagcauuucuacucaagggaauuaauuccaggaauuuugguggcaggcaccuguaaucccagcuacucgggaggcugaggcaggagaauugcuugaacccaggaggcagagguugcagugagcuaagaucgcaucauugcacucccgccugggcaauaagagugaaacuccaucucaaaaaaaaaaaaagauacaaaaauagaaaaaggggcuugguaaggguaguaggguuuugggcaauuuuuuuuuuuuuuuuuuuuuauuguaugguucuaaaggaaugguugauuaccugugguuugguuuuagguacugggacccugguccucgagcugaccccuuugaggacaugcgguacgucugggggggcuucgccuacuugcaggaugugguggagcaggcaaucaucagggugcugacgggcaccgagaagaaaacuggugucuauaugcaacagaugcccuaucccuguuacguugaugacauguaaguuaccugcaagccacuguuuuuaaccaguuuauacugugccagauggggguguauauaugugugugcaugugcaugcaugugugaaugaucuggaaauaagaugccagauguaaguugucaacaguugcagccacaugacagacauagauauaugugcacacacuaguaaaccucuuuccuucucauccaugguugccacuuuuaucuuuuuauuuuuauuuuuuuuuuugagauggagucucgcucugacgcccaggcuggagugcaguggcucgaucucggcucacugcaaccuuugccucccggguucaagcuauucuccugccucagccuccacaguagcugggacuacaggcucaugcugccacgcccggcugacuuuuuguauuuuaguagagacgagguuucaccauguuacccaggcuagacuucaacuccugagcucaggcaauccacccuccuuggccucccaaagugcugggauuacaggugugagccacugcacccagcccaccacuuuaauuuuuuacacucuacccuuuuggucaaaauuugcucaaucugcaagcuuaaaaugugucaugacaaacacaugcaagcacauacucacacauagaugcagaaacagcgucuaaacuuauaaaagcacaguuuauguaaaugugugcacuucuucucccuaggugguaaaccacauuucaaaacaacccaaauaaaacugaacaaagcuucuuccucuuagacuuuuuagaaaaucuuucagugcugagucacuaagcugccaaguucucauugugggaacuaugccuuuggauguaaugauuucuucuaagacaaugggcggagguguaguuauugcagacaucugaaauauguaauguuucuuccagauucuggaaauucucuuauucucugugguugguggugguggugggauguguguguguguguguguguguguguguguguguguguagggaucaggaugcgggaggagcuggguucugcuuguauugguucucuguuuugcauugaauaguguguuuccuuguauggcuaucuauagcuuuucaaggucaccagaaauuauccuguuuuucaccuucuaaacaauuagcuggaauuuuucaaaggaagacuuuuacaaagaccccuaagcuaagguuuacucuagaaaggaugucuuaagacagggcacaggaguucagaggcauuaagagcuggugccuguugucauguagugaguaugugccuacaugguaaagcuuugacgugaaccucaaguucaggguccaaaaucugugugccuuuuuacuuugcacaucugcauuuucuauucuagcuuggaaucugaaacauugacaagagcugccugaaauguaugucuguggugugauuagaguuacgauaagcaagucaauagugagaugaccuuggagauguugaacuuuugugagagaaugaguuguuuuuuuguuuugguuuuuaguacuuuaacauaaucuaccuuuaguuuaaguaucgcucacaguuaccuaguuacugaagcaagcccccaaagaaauuugguuuggcaacacuuuguuagccucguuuuucucucuacauugcauugcucgugaagcauuggaucauacguacauuucagagucuagagggccuguccuucuguggcccagauguggugcucccucuagcaugcaggcucagaggccuuggcccaucacccuggcucacgugugucuuucuuucuccccuuguccuuccuuggggccuccagcuuucugcgggugaugagccggucaaugccccucuucaugacgcuggccuggauuuacucaguggcugugaucaucaagggcaucguguaugagaaggaggcacggcugaaagagaccaugcggaucaugggccuggacaacagcauccucugguuuagcugguucauuaguagccucauuccucuucuugugagcgcuggccugcuaguggucauccugaagguaaggcagccucacucgcucuucccugccaggaaacuccgaaauagcucaacacgggcuaagggaggagaagaagaaaaaaaauccaagccucugguagagaaggggucauaccugucauuuccugcaauuucauccauuuauaguuggggaaagugaggcccagagaggggcagugacuugcccaaggucaacccagccggguagcagcuaaguaggaugagagugcaggguucaugcuuuccagauaaccacaugcucaacugugccaugcugucucauugguagugguucauggcagcaucugaaagcuauuuauuuucuuagauauauuggguggcgauucuuccuaaguuucuaagaacaauaaucagaaggauauauauuguugcagguuagacugucuggaagcagaggcugaaauagaguuugauguauggguauuuaugagggcucaauaccuauggaagagauauggaagaugcaggauugggcagagggaggaguugaacugugauauagggccaaccccguggggcacucuagagaauaugcagcuuguuggaguuguucuucaucgagcugaaacauccagcccuuugugcucccccaaggccucccuccugacaccaccuaccucagcccucucaaucaaucacuggaugugggcugcccugggaaggucgugccccagggccuacauggcucucugcugcugugacaaacccagaguugcugaugccugaggccgucuacugacagcugggcaacaaggcuucccugaauggggacucugggcagugcaguuuugugucugaaccauacauuaauauauuuauauccgaauuuucuuucucugcaagcauuucauauaaagacacaucagguaaaaauaaauguuuuugaagcaaaaggaguacaaagagauaagaacuaacuaauuuaauacuaguuaccaucuguuacaaauaguuccuacugauugccaaggacuguuuaaacacaucacaugggcuucuucuucuauccucacuaacccuuuuaacagacaaggaaaugaggcucaggaaggucaaggacuuuauugagguuccacaguaggauacaguucuugcuaaaagcaaccccucccucaugcucuguuaucuaacugcaaggggaaggucaguggcagagguaguggucccaugguuggugcauaagagcugcucugagacaacugcaugcugguggguccugcagacauguacccaucagccggagauaggcucaaaauauccacaagaguuuggaugauugugggaaugcagaauccauggugaucaagagggaaagucaaguugccuggccauuuuccuuggcuuuuagacagaaaaguuacgugggauauuaucucccacagcucuucuguggugccaccagucauaguccuuauauaaggagaaaccaguugaaauuaccuauugaagaaacaaagagcaaacucgcccacugaaaugcguagaaagcccuggacucuguuguauucauaacucugccauuauuuuucugcguaguuuuggguaagucacuuaucuucuuuaggaugguaaugaucaguugccucaucagaaagaugaacagcauuacgccucugcauugucucuaacaugaguaggaauaaacccugucuuuuuucuguagaucauacaagugagugcuugggauuguugaggcagcacauuugaugugucucuuccuucccaguuaggaaaccugcugcccuacagugaucccagcgugguguuugucuuccuguccguguuugcuguggugacaauccugcagugcuuccugauuagcacacucuucuccagagccaaccuggcagcagccugugggggcaucaucuacuucacgcuguaccugcccuacguccuguguguggcauggcaggacuacgugggcuucacacucaagaucuucgcugugaguaccucuggccuuucuucaguggcuguaggcauuugaccuuccuuuggagucccugaauaaaagcagcaaguugagaacagaagaugauugucuuuuccaaugggacaugaaccuuagcucuagauucuaagcucuuuaaggguaagggcaagcauuguguuuuauuaaauuguuuaccuuuagucuucucagugaauccugguugaauugaauugaauggaauuuuuccgagagccagacugcaucuugaacugggcuggggauaaauggcauugaggaauggcuucaggcaacagaugccaucucugcccuuuaucucccagcucuguuggcuauguuaagcucaugacaaagccaaggccacaaauagaacugaaaacucuugaugucagagaugaccucucuugucuuccuuguguccaguaugguguuuugcuugaguaauguuuucugaacuaagcacaacugaggagcaggugccucaucccacaaauuccugacuuggacacuuccuucccucguacagagcagggggauaucuuggagagugugugagccccuacaagugcaaguugucagauguccccaggucacuuaucaggaaagcuaagagugacucauaggaugcuccuguugccucagucugggcuucauaggcaucagcagccccaaacaggcaccucugauccugagccauccuuggcugagcagggagccucagaagacuguggguaugcgcaugugugugggggaacaggauugcugagccuuggggcaucuuuggaaacauaaaguuuuaaaaguuuuaugcuucacuguauaugcauuucugaaauguuuguauauaaugagugguuacaaauggaaucauuuuauauguuacuugguagcccaccacuccccuaaagggacucuauagguaaauacuacuucugcaccuuaugauugauccauuuugcaaauucaaauuucuccagguauaauuuacacuagaagagauagaaaaaugagacugaccaggaaauggauaggugacuuugccuguuucucacagagccugcugucuccuguggcuuuuggguuuggcugugaguacuuugcccuuuuugaggagcagggcauuggagugcagugggacaaccuguuugagaguccuguggaggaagauggcuucaaucucaccacuucggucuccaugaugcuguuugacaccuuccucuauggggugaugaccugguacauugaggcugucuuuccagguacacugcuuugggcaucuguuuggaaaauaugacuucuagcugauguccuuucuuugugcuagaaucucugcagugcaugggcuucccugggaagugguuugggcuauagaucuauaguaaacagauaguccaaggacaggcagcugaugcugaaaguacaauugucacuacuuguacagcacuuguuucuugaaaacugugugccaggcagcaugcaaaauguuuuauacacauugcuucauuuaauucucacaaggcuacucugaaguaguuacuauaauaaccagcaauuuucaaaugagagaacugugacucaaagacguuaaguaaccagcuuuggucacacaacuguuaaauguugguacguggaggugaauccacuucgguuacacugggucaauaagcccaggcgaauccucccaaugcucacccaauucuguauuucuguguccucagaggggguacaacuaggagagguucuguuuccugaguacagguuguuaauaauuaaauauacuagcucuaaggccugccugugauuuaauuagcauucaauaaaaauucauguugaauuuuucuuuaguacuucuuucuuaauauaauacaucuucuugaccaaguccaagaggaaccugcguuggacaguuuucauaugagaucaaauucugagagagcaagauuuaacccuuuuugguucaccuucugauccuccccuaaggagguauacaugaaauauuuauuacuccugccugaacuucuuucauugaauaugcaauuuugcagcaugcagauucuggauuuaaauucugagucuuaacuuacuggcugagggaccuuggauaggcuccuuaucccucaguuuccucaucucuaaaauggggauggcaccugccccguggguuguuggaaggacuuacagaggugcagaauguacguuguacauagcagguuucagcaaauguuagcucccucuuuccccacauccauucaaaucuguuccuucuccaaaggaugugucaaggaggaaauggaccuggcugggaaacccucagaauacugggaugaugcugagcuuggcucauaccugugcuuugcuuucaggccaguacggaauucccaggcccugguauuuuccuugcaccaaguccuacugguuuggcgaggaaagugaugagaagagccacccugguuccaaccagaagagaauaucagaaaguaagugcuguugaccuccugcucuuucuuuaaccuagugcugcugccucugcuaacuguugggggcaagcgaugucuccugccuuucuaaaagacugugaaaccacuccaggggcagagaaaucacaugcagugucccuuuccaaauccucccaugccauuuauguccaaugcuguugaccuauugggaguucacggucucgaucccugagggacauuuucuuuguugucuuggcuucuagaagaguaucuuuuacuugcccccucccaaacacacauuucauggucuccuaacaagcuagaagaaagagguaaagacaagcgugauuguggaaccauagccucgcugccugccugugacauggugaccuguguaucagccugugugggcugagaccaaguggcuaccacagagcucagccuaugcuucauaauguaaucauuacccagaucccuaauccucucuuggcucuuaacugcagacagagauguccacagcucaucaaaggcucugccuucuggguucuuugugcuuagaguggcuuccuaaauauuuaauaggucccuuuucugccagucucuucugugcccauccccugauugcccuugguaaaaguaugaugccccuuaguguagcacgcuugccugcuguuccuaaucaucuucuccuaccuccucuuuacaccuagcuccuguuucagucaccuagaaaugcucacagucgcuggaauaugucauguucuuccacaccuccaugccuuuguagguacuguuugcucucacaggagaacuuucucucuaacuugccuaucuucucaacuccuccuuucucuccaagaucuaguuccggauccccuccccugagcaucccuccuugguucucagguagucagucacucucugcccugaacuuccauggcacgugaaagaaaaucuuuuuauuuuaaaacaauuacagacucacaagaaguaauacaaauuacaugaggggguucccuuaaaccuuucauccaguuuccccaaugguagcagcauguguaacuguagaauaguaucaaaaccaugaaauugacauagguacaauucacaaaccuucuucagauuucacuagcuuuaugugcgcucauuugugugugugugugcguauuuaguucuaugcaauuuuaucaugugugaauucauguaauuacuagcucagucaagcugcagaaauaucucauugucacaaagcuccuucaugcuaccccuuaauggccacagccaccucccuucuuccucaguuccugacaccugucaaccacuaaugcguuccucguuuuuacaguuuuauuauuucuagaauguuacauaaauggaaccauacaguagguauccuuuugauacuggcuuuuuuuuuuuuucacucagcaguauucccuuagaucuauccaaguugugugugucaacaguucauuccucuucacugcugaguaguguucccugggagggguguaucacaguuccauggcauuuuuagauguauuuuuuaaacagcuuucagcauccucuauuuuaauuguucaucaaguccuuuuucccaauagacucugaaugcuccuuuaucaucguauucccaucaccaacaucaguacccaaauaggcccuaaauaaacauuuauagccuccugccugccugagaaaccaggguggacauggagagaaggcacuucugaaaguucaagcgcagugcccuguguccuuacacuccacuccucagugcuuucuguggguucauuucugucuucucuccugucacagucugcauggaggaggaacccacccacuugaagcugggcguguccauucagaaccugguaaaagucuaccgagaugggaugaagguggcugucgauggccuggcacugaauuuuuaugagggccagaucaccuccuuccugggccacaauggagcggggaagacgaccaccauguaagaagagggugugguucccgcagaaucagccacaggaggguucugcaguagaguuagaaauuuauaccuuaggaaaccaugcugaucccugggccaagggaaggagcacaugaggaguugccgaaugugaacauguuaucuaaucaugagugucuuuccacgugcuaguuugcuagauguuauuucuucagccuaaaacaagcuggggccucagaugaccuuucccauguaguucacagaauucugcaguggucuuggaaccugcagccacgaaaagauagauuacauauguuggagggaguugguaauucccaggaacucugucucuaagcagaugugagaagcaccugugagacgcaaucaagcugggcagcuggcuugauugccuucccugcgaccucaaggaccuuacaguggguaguaucaggaggggucaggggcuguaaagcaccagcguuagccucaguggcuuccagcacgauuccucaaccauucuaaccauuccaaaggguauaucuuuggggggugacauucuuuuccuguuuucuuuuuaaucuuuuuuuaaaacauagaauuaauauauuaugagcuuuucagaagauuuuuaaaaggcagucagaaauccuacuaccuaacacaaaaauuguuuuuaucuuugaauaauauguucuuguuuguccauuuuccaugcaugcgauguuaggcauacaaaauacauuuuuuaaagaauacuuucauugcagauuggaaacuucguuuaaaaaaugcucauacuaaaauuggcauuucuaacccauaggcccacuuguaguuauuuaccgaagcaaaaggacagcuuugcuuugugugggucugguaggguucauuagaaaggaaugggggcggugggaggguugguguucuguucucucugcagacugaauggagcaucuagaguuaaggguaggucaacccugacuucuguacuucuaaauuuuuguccucaggucaauccugaccggguuguuccccccgaccucgggcaccgccuacauccugggaaaagacauucgcucugagaugagcaccauccggcagaaccugggggucuguccccagcauaacgugcuguuugacaugugaguaccagcagcacguuaagaauaggccuuuucuggaugugugugugucaugccaucaugggaggagugggacuuaagcauuuuacuuugcuguguuuuuguuuuuucuuuuuuucuuuuuuauuuuuuugagauggagucucgcucuguagccaggcuggacuguaguggcgcgaucucggcucacugcaaccuuggccucccagguucaagcgauucuccugccucagccucccgaguagcugggacucuaggcacacaccaccaugcccagcuaauuuuuguguuuuuaguagagacgggguuucaccauguuggccaggauggucucaaugucuugaccucgugauccgcccaccucggucucccaaagugcugggaacacaggcaugagccacugugucuggccacauuuuacuuucuuugaauauggcaggcucaccuccgugaacaccuugagaccuaguuguucuuugauuuuaggagaagugggaggugaaugguugagcuguagaggugacaucagcccagccaguggaugggggcuugggaaacauugcuucccauuauugucaugcuggagggcccuuuagcccauccucucccccgccacccuccuuauugaggccuggagcagacuucccagaccugguagugcuucagggcccugguaugauggaccuauauuugcugcuuaagacauuugcucccacucagguugucccaucagccauaaggcccccagggagcccgugugauggagcagagagagaccugagcucugcaaucuugggcaaggcuuuucccuuauguuucuucuuaucuaaagugaacagcuggggcucaugugcucccuccucaucuaaagugaacacauggggcucaugugcaggguccuccccgcuuucagagccugagguccccugaggcucaggaaggcugcuccaggugagugccgagcugacuucuugguggacgugcuguggggacagcccauuaaagaccacaucuuggggcccugaaauugaaaguuguaacugccuggugcaugguggccaggccugcuggaaacagguuggaagcgaucugucaccuuucacuuugauuuccugagcagcucaugugguugcucacuguuguucuaccuugaaucuugaagauuauuuuucagaaauugauaaaguuauuuuaaaaagcacggggagagaaaaauaugcccauucucaucuguucugggccaggggacacuguauucugggguauccaguagggcccagagcugaccugccucccuguccccaggcugacugucgaagaacacaucugguucuaugcccgcuugaaagggcucucugagaagcacgugaaggcggagauggagcagauggcccuggauguugguuugccaucaagcaagcugaaaagcaaaacaagccagcugucaggugcggcccagagcuaccuucccuaucccucuccccuccuccuccggcuacacacaugcggaggaaaaucagcacugccccagggucccaggcugggugcgguugguaacagaaacuugucccuggcugugccccuagguccucugccuucacucacugucuggggcugguccuggaguuugucuugcucuguuuuuuuguagguggaaugcagagaaagcuaucuguggccuuggccuuugucgggggaucuaagguugucauucuggaugaacccacagcugguguggacccuuacucccgcaggggaauaugggagcugcugcugaaauaccgacaaggugccugauguguauuuauucugaguaaauggacugagagagagcggggggcuuuugagaaguguggcuguaucucauggcuaggcuucugugaagccaugggauacucuucuguuaucacagaagagauaaagggcauugagacugagauuccugagaggagaugcugugucuuuauucaucuuuuuguccccaacauggugcacuaaauuuaugguuaguugaaaggguggaugcuuaaaugaauggaagcggagaggggcaggaagacgauugggcucucugguuagagaucugaugugguacaguaugaggagcacaggcaggcuuggagccaacucuggcuggcccugagacauugggaaagucacaacuugccucaccuucuuugccgauaauaauaguggugcuuaccucauagaggauuaaauuaaaugagaaugcacacaaaccaccuagcacaaugccuggcauauagcaaguucccaaauaaaaugcuacuguucuuaccucugugaggaugugguaccuauauauacaaagcuuugccauucuaggggucauagccauacagggugaaagguggcuuccaggucucuuccagugcuuaccccugcuaauaucucucuagucccugucacugugacaaaucagaacugagaggccucaccugucccacauccuuguguuugugccuggcaggccgcaccauuauucucucuacacaccacauggaugaagcggacguccugggggacaggauugccaucaucucccaugggaagcugugcugugugggcuccucccuguuucugaagaaccagcugggaacaggcuacuaccugaccuuggucaagaaagauguggaauccucccucaguuccugcagaaacaguaguagcacugugucauaccugaaaaaggugagcugcagucuuggugcugggcugguguugggucugggcagccaggacuugcuggcugugaaugauuucuccaucuccaccccuuuugccauguugaaaccaccaucucccugcucuguugccccuuugaaaucauaucauacuuaaggcauggaaagcuaaggggcccucugcucccauugugcuaguucuguugaaucccguuuuccuuuuccuaugaggcacagagagugauggagaagguccuuagaggacauuauuaugucaaagaaaagagacuugucaagagguaagagccuuggcuacaaaugaccugguguuccugcucauuacuuuucaaucucauugaccuuaacuuuuaaacuauaaaacagccaauauuuauuaggcacugauuucaugccagagacacucugggcaugaaagaaaguaaugauaauaguuaauuuuauauagcguuguuaccauuuacaaccuuuuuuuuuuuuuuaaccucuaucaucucaauuaaagugcagagagacccugggaagaagguaacuauauuuauuaucccagaugagggaagugaggcuuguagggaauugguagcugauucaaggucacccagcagguaaauaacaguggugggaccagacccaauuaccagguauguuuuccucuguaccgcaguacaugccugagauuuauuuguguguugaagccagugguaccuaauguauuuacaucccaaccugaaacuccuauccacuuauuuaccuuuuaaugagccucuuaacucaagugcagucugaggaccagcagcaucaggaucacuugggaacuuguuagaaauucagcaaccugggcccagcucagaccuaccgaaucagaaucugugcauuuuaacaagguucuugagugguugaacacacauuaaagcaugagaagcauugaacuagacauguagccagguaaaggccuugccugagaugguuggcaaaggccucauugcagcauucauuggcaggccacaguucuuuuggcagcucugcuuccugaccuuucacccucaggaagcgaggcuguucacacggcacacacaugccagacaggguccucugaagccacggcugccagugcaugugucccagggaaagcuuuuuccuuuaguucucacacaacagagcuucuuggaagcccuccccggcgaaggugcugguggcucugccuugcuccgucccugacccguucucaccuccuucuuugccaucaggaggacaguguuucucagagcaguucugaugcuggccugggcagcgaccaugagagugacacgcugaccaucgguaaggacucugggguuucuuauucagguggugccugagcuucccccagcugggcagaguggaggcagaggaggagaggugcagaggcugguggcgcugacucaagguuugcugcugggcuggggcuggguggcugcgggugugggagcagcuugguggcggguuggccuaaugcuugcuggggugccuggggcucgguuugggagcuagcagggcagugucccagagagcugagaugauugggguuuggggaaucccuuaggggaguggacacugaauaccagggaugaggagcugagggccaagccaggagggugggauuugagcuuaguacauaagaagagugagagcccaggagaugaggaacagccuuccagauuuuucuuggguagcguguguaggaggccagugucaccaguagcauauguggaacagaagucuugacccuugcuaucucugccuaguccuaauggcuggcuuuucccaggaaggcuucugcuuccauggacuguuagauuaacccuuuauuuagguaaaugagggaaccuacuuuauaagcauaggaaagggugaagaaucuuuuaagauuccuuuacucaaguuuucuuuugaagaaucccagagcuuaggcaauagacaccagacuuugagccucaguuauccauucacccauccacccacccacccacccauccuuccauccucccauccucccauucacccauccacccauccagcuguccacccauucuacacugaguaccuauaaugugccuggcuuuggugauacaaaggugaauaagacauaguccuuuccuuugcccccaacccucagaccagagaugaacauguggaaugaccuaaacaccuggaacaggugugguguaugagcggcaggccucugaugagagggugggggauggccagcccucacuccgaagccccucugaguugauugagccaucuuugcauucuggucccugcagaugucucugcuaucuccaaccucaucaggaagcaugugucugaagcccggcugguggaagacauagggcaugagcugaccuaugugcugccauaugaagcugcuaaggagggagccuuuguggaacucuuucaugagauugaugaccggcucucagaccugggcauuucuaguuauggcaucucagagacgacccuggaagaaguaaguuaaguggcugacugucggaauauauagcaaggccaaauguccuaaggccagaccaguagccugcauugggagcaggauuaucauggaguuagucauugaguuuuuaggucaucgacaucugauuaauguuggccccagugagccauuuaagaugguagugggagauagcaggaaagaaguguuuuccucuguaccacaguacaugccugagauuuguguguugaaaccagugguaccuaacacauuuacaucccaaccuuaaacuccuaugcacuuauuuacccuuuaaugagccucuuuacuuaaguacagugugaggaacagcggcaucaggaucacuugggaacuuguuagaaauucagcaacuugggcccagcucagaccuacugaaucagaaucaggagcaauucucuggugugacugugucacagccagguaucaacuggauucucauacauaggaaaugacaaacguuuauggauggauagucuacuugugccaggugcugagauuuguuuuuuguuuuuugauuuuuuuuuaaucacugugaccucauuuaauucucaaaaaaagaugaaaaaaugaacacucaggaaugcugacaugagauucagaaucagggguuuggggcuucaaaguccauccucucuuuauccauguaaugccuccccuuagagauacaacaucacagaccuugaaggcugaaggggauauaaaagcugucuggccaaguggucuccaagcuugacagugcagcagaaucaccuggggauauuauuaaaaauaaacauacuaagguuuggcuucagggccugugaaucagaauuucuggaggugaggccuugaagucuguauuucuauugcauacuuuggacacaguggucuauagacuagaguuuggaaaugauugcgcucauucagauucucuucugauguuugaauugcugccaucauauuucuagugcucuauuuccuccugcucauucugucuuggauaacuuaucauaguacuagccuacucaaagauuuagagccacaguccugaaagaagccacuugacucauucccuguagguucagaauaaauuucuucugcgcagugucugucauagcuuuuuuuaaauuuuuuuuuauuuuugaugagacuggaguuuugcucuuauugcccaagcuggagugcaguggugcgauuuuggcucacugcaaccuccaccucccagguucaagcgauucuccugccucagccucccaaguagcugagauuacaagcaugugcuaccacgcccagcuaauuuuguauuuuuaguagagauggguuuuauccauguuggucaggcuggucucgagcuccagaccucaggugaucugcccgccucggccucccaaagugcugggauuauaggccugagccacagcgcucagccauaacuuuaauuugaaaaugauugucuagcuugauagcucucaccacugaggaaauguucucuggcaaaaacggcuucucucccagguaacucugagaaaguguuauuaagaaauguggcuucuacuuucucugucuuacggggcuaacaugccacucaguaauauaauaaucguggcaguggugacuacucucguaauguuggugcuuauaauguucucaucucucucauuuuccagauauuccucaagguggccgaagagagugggguggaugcugagaccucagguaacugccuugagggagaauggcacacuuaagauagugccuucugcuggcuuucucagugcacgaguauuguuccuuucccuuugaauuguucuauugcauucucauuuguagaguguagguuuguugcagauggggaagguuuguuuuguuguaaauaaaauaaaguaugggauucuuuccuugugccuucagaugguaccuugccagcaagacgaaacaggcgggccuucggggacaagcagagcugucuucgcccguucacugaagaugaugcugcugauccaaaugauucugacauagacccaggucuguuagggcaagaucaaacaguguccuacuguuugaaugugaaauucucucucaugcucucaccuguuuucuuuggauggccuuuagccaaggugauagaucccuacagaguccaaagagaagugaggaaaugguaaaagccacuuguucuuugcagcaucgugcaugugaucaaaccugaaagagccuauccauaucacuuccuuuaaagacauaaagauggugccucaauccucugaacccauguauuuauuaucuuuucugcgggguccuaguuucuuguauacauuagguguuuaauuguugaacaaauauucauucgaguagaugagugauuuugaaagagucagaaaggggaauuugcuguuagaguuaauuguacccuaagacuuagauauuugaggcugggcaugguggcucaugccaguaaucccagcgcuuugagaggcugagguggguagaucaccugaggucaggaguuugagaccagucugaccaacaaggugaaaccccgucucuacuaaauacaaaaaauuagccgagugugguggcacaugccugucaucccagcuacuugggaggcugaggcaggagaaucgcuugaacccaggaggcagagguugcagucagccacgguugcgccauugcacuccagacugggcaacaagagugaaaacuccaucucaaaaaagaaaaaaaaagaauuagauauuuuggaugagugugucuuuguguguuuaacugagauggagaggagagcuaagacaucaaacaaauauuguuaagauguaaaagcacaucaguuagguaucauuaguuuaggacaaggauuucuagaaaauuuuuaggaacagaaaacuuuccaguucucucaccccugcucaaagaguguauggcucuuacauuauauauaacugccugacuucauacaguaucaguacuuagaucauuugaaauguguccacguuuuaccaaaauauaauagggugagaagcugagaugcuaauugccauuguguauucucaaauaugucaagcuacguacauggccuguuucauagaguagucuauaagaaauugaugacuugauucauccgaauggcuggcuguaacaccugguuacgcaugaacaccucuuuucaguugucucaagacaccuuucuuuucuguacuuaucagacaaggacugaaaggcagagacugcuacuguuagacauuuugagucaagcuuuuccuuggacauagcuuugucaugaaagcccuuuacuucugagaaacuucuagcuucagacacaugccuucaagauaguuguugaagacaccagaagaaggagcauggcaaugccgaaaacaccuaagauaauaggugaccuucaguguuggcuucuugcagaauccagagagacagacuugcucagugggauggauggcaaaggguccuaccaggugaaaggcuggaaacuuacacagcaacaguuuguggcccuuuuguggaagagacugcuaauugccagacggagucggaaaggauuuuuugcucaggugagacgugcuguuuucgccagagacucuggcuucaugggugggcugcaggcucugugaccagugaaggcaggauagcauccuggucaagauauggaugccggagccagauuuaucuguauuucaaucccaguucuauuccuugccaguuguguauccgcuggcaaguuacuucucuaugccucaaucuccucaucuguaaaauggggauaauaauauuaccugcaauacaggguuguuacgaaaauaaaaaugaauaggugcuuagaauggggccugacauuaguaagugcuuaguuuuguguguguauauguuauuuuuauuuuggaggagaacauaaaaaggacaaaguguagaaaaacugguuggguguauucagcugucauaacaugagaguuguuaugcccagaugcacuugacaugugaauuuauuagaaacaugauuuuucucugaguugauguuuaacucaaacugauagaaaagauaggucagaauauaguuggccaacagagaagacuuguuagacuauugucugcaugucaguguuugcaugcuaacuugcuuaguuagaaagguuaaauuuuuucacucuauaaaaucaagaaauauagagaaaaggucugcagagagucuuucauuugaugauguggauauuguuaagagcgggaguuuggagcauacagagcucaaguugaauccugacuuugcuacuuauuggcuauaugaccuugggcaagcugcuuagucucucugauccucaguuaccuuuguuuguugaugaugaccauugauaacacaaccauaaauaaugacaacauagagauaguucucauuauaguaguuguuauacagaauuauucacucaauguuaauuuucugcauugaaaucccagaacauuagaauugggggcauuauuugaaucuuuaagguuauaaggaauacauuucucagcaauaaauggaaggaguuuuggguuaacuuauaaaguauacccaagucauuuuuuuuucagagaagauaugguagaaagucuuaggagguugaagaaggaauuggauauuuauucuuucugagacuaucaugggagauaaugacuaugguuguccaugauuggagccguugcuguagaguugguuuuauuauaguguaggauuugaaugggccauguguucucagaccucagauuaaaaugagaaaacugaggccaguggggagcgugacuucacauggguacacuugugcuagagacagaaccaggauucaggacuucuggcuccugguccuggguucauggcccaauguagucuuucucagucuucaggaggaggaagggcaggacccaguguucugagucacccugaaugugagcacuauuuacuucgugaacuucuuggcuuagugccucugccagguggccauaaccucuggccuuguguugccagagaaaagguuuaguuuucaggcuccauugcuucccagcugccaagaaugccuuggugcagcacagucauaggcccugcauuccucauugccgugcugguuggucggggaggugggcuggacucguagggauuugccccuuggccuuguuucuaacacuugccguuuccugcugucccccugcccccuccacugccuggguaaagauugucuugccagcuguguuugucugcauugcccuuguguucagccugaucgugccacccuuuggcaaguaccccagccuggaacuucagcccuggauguacaacgaacaguacacauuugucagguauguuugucuucuacaucccaggaggggguaagauucgagcagaccaaagauguuuacgagggccaagggaauggacuucagaauuacacgguggaaugaauuuuacugcugcggcucaggucccuguauaagcuaauacugcaugcauagaacagcagcgaacuaacccugaauaauaggccagucuucuguugagccuuucagccucucuccucuucauccuacuguugucaggaacagccacauguguuuuaggugaaauaauccacccuugcaaaaauccaugauuaaguuauaaaauauuuggauuuguggagcuguguuuuaauucuguaacugagucacagggcacacugucaaagcauagaaccuccagagacuuguuuucugcaaaguauaauucauguaauuauuaucuauucuguuauauuugggauguuagguaguguuuguucuuuagauaaaaauaucccccacucuguaacaauacauuaaaucaaagaaaaggacaaaggauuuuucugggucuuguuagcaggagcuuucuucaguccugaaagauuuguagaccuguagaugggggaacugugucagugauacaaaagggaagcauuuaaaaaaaaaaaaguauauauauauauauauauauauauauguaaugugaauuggccucuuuuucucuaagcccacauuuucuucuuacauaguucagguuuacuuuauuuuuuccuuuccggcugcugacccuguauugcccguaguuguggaacauagcauguguuugugaccugugccuguuauuuuugugcuuucuaguugugcaugcaaagaguacaaaguuuucuugcccuuucuuggaaaauccugcuugucugugccaaagggauaauugugaaagcacuuuugaaauacuuaaugaguugauuuucuucaaauuaaaaaaaauauauaaauguauauguguauguacauguguguacacauacacaccuuuauacauacagcccauuuaaaacaagcuccacuuuggagugcucuacgucacccugaugccgaauacagggccagagucugagauccuucugggugguuucuguguuuuguucauuucuguuuuaagagccugucacagagaaaugcuuccuaaaauguuuaauuuauaaaaacauuuuuaucucucgauuacugguuuuaaugaauuacuaagcuggcugccucucauguacccacagcaaugaugcuccugaggacacgggaacccuggaacucuuaaacgcccucaccaaagacccuggcuucgggacccgcuguauggaaggaaacccaaucccgugagugccacuuuagccauaagcaggcuucuugugcuuguugccugguuugauuucuaauaugcugcauuuaucaacugcaugccacauugugaccgccagcauuugcccuuugaauuauuauuauguuuuauuuacaaaaagcgaagguaguaaccgaacuaaauuaucuaggaacaaacguuuggagagucuucuaacaccgugcaaagcacgucauuacagacauuuguuuacugauuuagaaccuuaauauuuaauuuaaauagcacuuuacacuuacugaugaaaugcuuuuccuuucuuucucucccagccccuguacuuaagugcuucaauaggcucucauuauauaugauuuuuagguuuugcuuaucagcuucuucgcuuuuauaaucugaaaagauggcauaugaauuuuuauaaaaagggacacuuucuucuucucaaauuguauauuuuuauuguacuuuccuucaaaacccccuuuuaaaaaguaagcaguggauaaauaaauucagugaagcauccauaugacccuuaagugaguguaggggaagggaggucaccagaucacugugagugaagaugguggagaggugaggaucuuaugaggccgugcucaaggcugguagagguggguuaguguuuccagguuuaggcagaaucucagcugaggucaugaaacaacagugaucucugaaaaauuauggcaaggugggaaggugcuggagaauuggagagggggcaaacuugacuuucaaguuucaaugggaagauaggugacucugcacaccacagaacagugagcaugauaaccuguuuauacaagguucuagagcagauuucuaaauggauagcuacugugugcuuguuuguucuuaauuaguauuggauaguuacuaaauacuuguuaguacuuaguacauaaugggugguaaauccuagcagcuaauauugguucccaaauaaccagaugacaaggauagagaaggacacagacacggccuaucuggauuucauggugccuuugauuuuccacaugaagguuguguagggaagauagaagcaugagaugagaugauaauauaguuaucuggauucaucacuggccagcugaaccauaugaacucauggauugaugcuagcuuaggaaggcucuguaggagccagaacugggcugagagccagcccauagagacaaaagaggcccggcccugacaucagaggguucaaacaugaugucugagccccaccuacagucugccggaggugguuggaaggaagagccuuuauccuuacaauucuuacugaaauucaaauuuuuagguuuugcaaaaaaaugguggaccugaaggaaauuugacaggagcaugucucagcuguauuuaaauuugucucagccaauccccuuuugaauguucagaguguaagcuucaggagggcagcgcgucuuagugugacuuuucuggucaguucaggugcuuuaaggagacaauuagagaucaaucuggaaaacuucauuugaauuuuuaauacauaagaaaacaauaagaaauaguuaaaaauauauauuuauaauauauauauguguguguguguguguguguguguguguguauauauauauauuuuauuuauuuauuuuuuuuugagauggagucucgcucuguugcccaggcuggagugcaguggcucaaucuuggcucacugccaccucugccucccagguucaagugauucuccuaccucagccuccugaguagcugggauuacaagcaugugccaccacacuggcuaauuuuucuaauuuuaguagagauggaguuucaccauguuggacaggauggucuugaacuccugacuuagugauccacccgccuucgccucccaaaguucugggauuacaggcaugagccaucgugccuggcaauuauauuuaauauuuaauaauaaggaaauaauugcuguaacuuuacuuuaaauuguggaauucugaaacuggaagggaacuggaaaugacuuguugaaucaaaucauuuuaaacuuuuauuuugccaguggaaaaaauaagcccccaaaagagcaggggaccugcugaugucccacaguaauucagagcuggagaugagguugaaggcuuugugucuuaucuccagggaaaauuuguagacagcguagcucuuuaugugacgagcauucucaccccagucaucccccaauucucuacucauuugagaacauaaauuggaucuugccagucucuacucauuuuucagcacaucgagcauaagauccagacucuuucccaggccucucucaucuggcuccucuccuccuccuuuaucauuacucuucuucguagcuuauccuacuccagccaugcugucuuccuauuauuccuaaaaaauagaaaugcauuucuuccuagggccuuuguaccugcacuugccaucgcuuuugcucagaauguucuuuuugccaagcuuuugcccagcuuguucuccaucauuguuauguuuuggcugaaaugucuucucuuaguagguucauucuccccagucacugucuuuuuauuuugcuuuauuuugggccaucuaagguuaucuuauuaguguauuuguuguucgucuccuccaugggcauacaccuccaugaaggcagguauuuucaccuuaggcccucgaauauacuggacagcaucuggcacguaguagaugcucaacgaauguuuguugugugagcaaaugguugguugauuggauugaacugaguucaguauguaaauauuuagggccucuuugcauucuauuuuacuuauguauaaaaugauacauaaugaugauauaaaugaugucacaguguacaaggcuguugugggaucaagcaaucaaaugagaucaugcuugucuuuuccaaauggugagggaauagaugcauguuugugguuguuacggaaugauccugugcuccugaggcaacagaaaggccaggccaucucugguaauccuacucuugcugucuucccuuugcagagacacgcccugccaggcaggggaggaagaguggaccacugccccaguuccccagaccaucauggaccucuuccagaaugggaacuggacaaugcagaacccuucaccugcaugccaguguagcagcgacaaaaucaagaagaugcugccugugugucccccaggggcaggggggcugccuccuccacaagugagucacuuucagggggugauugggcagaaggggugcaggaugggcugguagcuuccgcuuggaagcaggaaugagugagauaucauguugggagggucuguuucagucuuuuuuguuuuuuguuuuuuuuucugaggcggagucuugcucugucgcccaggcuggagugcuguggcaugaucuugccucacugcaaccuccaccucccagguucaagcgauucuccugccucagccuccugaguagcugggauuacaggcacgcaccaccaugucuggcuaauuuuuguguuuuuaguagagauaggguuucgccguguuggcuaggcuggucuggaauuccugaccucaggugauccacccgccucggccucccaaagugcugggauuacaggcgugagccacuacgcccagcccuguuucagucuuuaacucgcuucuugucauaagaaaaagcaugugaguuuugaggggagaagguuuggaccacacugugcccaugccugucccacagcaguaaagucacaggacagacuguggcaggccuggcuuccaaucuuggcucugcaacaaaugagcugguagccuuugacaggccugggccuguuucuucaccucugaauuagggaggcuggaccagaaaacuccuguggaucuugucaacucugguauucuuagagacucuguuugggaaggaguccugagccauuuuuuuuuucuugagaauuucaggaagaggagugcuuaugauagcucucugcugcuuuuaucagcaaccaaauugcaggaugaggacaagcaauucuaaaugaguacaggaacuaaaagaaggcuugguuaccacucuugaaaauaauagcuaguccaggugcgggguggcucacaccuguaaucucaguauuuugggaugccgagguggacugaucaccuaaggucaggaguucgaaaccagcuuggccaauguggcgaaacccugucucuacuaaaaauucaaaaauuagccaggcaugguggcacaugccuguaaucccaguuacuugggaggcugaagcaggagaauugcuugaaccugggagguggaggucgcagggagccaaaauugcgccacuguacuccagccugagcaacacagcaaaacuccauaucaaaaaauaaaaugaauaaaauaacagcuaaucuagucaucaguauaacuccagugaacagaagauuuauuaggcauagugaaugauggugcuuccuaaaaaucucuugacuacaaagaaucucauuucaauguuuauuguuuagauguucagaauaaauucuugggaaagaccuuggcuugguguaagugaauuaccagugccgagggcagggugaaccaagucucagugcugguugacugagggcagugucugggaccuguagucagguuuccggucacacuguggacauggucacuguuguccuugauuuguuuucuguuucaauucuugucuauaaagacccguaugcuugguuuucaugugaugacagagaaaacaaaacacugcagauauccuucaggaccugacaggaagaaacauuucggauuaucuggugaagacguaugugcagaucauagccaaaaggugacuuuuuacuaaacuuggccccugccguauuauuacuaauuagaggaauuaaagaccuacaaauaacagacugaaacagugggggaaaugccagauuauggccugauucugucuauuggaaguuuaggauauuaucccaaacuagaaaagaugacgagagggacugugaacauucaguugucagcuucaaggcugaggcagccuggucuagaaugaaaauagaaauggauucaacgucaaauuuugccacuuaguagcaacuugaccagguaacugguuauccuuuuaaagccuuaguuuaucuaaauugugauauuaauguugcucuuauaaguuugucaugaggacuaaauuaaaugguguacauagagugccuuggguacucucugaugggggacuccaugauaauuuguggucucauggagggagcucugggaagguuuaggagccugccuuggcucugcagccuugggagagccuucuagcuucccaggacauggcagccuaguguugaaugcuuggcucagcaaauguuuguucucguuuccuucccaucaacuuggucaguuggggucuuucaguuaggaguaucucagugacuuuaaauggcaugggcaugcuggagugauagugaccaugaguuucuaagaaagaagcauaauuucuccauaugucauccacaauugaaauauuauuguuaauugaaaaagcuucuaggccaggcacgguggcucaugccuguaaucccagcacuuuaggaggccaaggcggguggaucacuugaggucaggaguuugagaccagccuggccaacauggggaaacccugucucuacuaaaaauacaaaauaagcugggcgugguggugcgugccuguaaucccagcuacuugggaggcugaggcaggagaauugcuugaaucugggaggcggagguugcagugagcugaguucaugccauugcauuccagccugggcaacaagagcgaaaccaucucccaaaagaaaaaaaaaagaaagaaaaagcuucuaguuugguuacaucuuggucuauaaggugguuuguaaauugguuuaacccaaggccugguucucauauaaguaauaggguauuuaugauggagagaaggcuggaagaggccugaacacaggcuucuuuucucuagcacaacccuacaaggccagcugauucuaggguuauuucuguccguuccuuauauccucagguggauauuuacuccuuuugcaucauuaggaauaggcucagugcuuucuuugaacugauuuuuuguuucuuugucucugcagcuuaaagaacaagaucugggugaaugaguuuagguaaguugcugucuuucuggcacguuuagcucagggggaggaugguguuguaggugucuuggauugaagaaagccuuggggauuguuugucacucacacacuugugggugccaucucacugugaggaggacagaagcccugugaacauguggagcacacaggggcacagacagauuuagauuaggccugcuuuauagaguuucugccuagagcaucauggcucagugcccagcagccccuccagaggccucugaaauauuugauauacugauuuccuugaggagaaucagaaaucuccugcaggugucuagggauuucaaguaaguaguguugugaggggaauaccuacuuguacuuuccccccaaaccagauucccgaggcuucuuaaggacucaaggacaauuucuaggcauuuagcacgggacuaaaaaggucuuagaggaaauaagaagcgccaaaaccaucucuuugcacuguauuucaacccauuuguccuucuggguuuugaaggaacaggugggacuggggacagaagaguucuugaagccaguuuguccaucauggaaaaugagauaggugauguggcuacgucagggggcccgaaggcuccuuguuacugauuuccgucuuuucucucugccuuuuccccaagggccaggaccccuggaucucugggcagagcagacgcaggccccuauaauagcccucaugcuagaaaggagccggagccuguguauaaggccagcgcagccuacucuggacagugcaggguucccacucucccaacuccccaucugcuugccuccagacccacauucacacacgagccacuggguuggaggagcaucugugagaugaaacaccauucuuuccucaaugucucagcuaucuaacuguguguguaaucaggccagguccucccugcugggcagaaaccaugggaguuaagagauugccaacauuuauuagaggaagcugacguguaacuucucugaggcaaaauuuagcccuccuuugaacaggaauuugacucagugaaccuuguacacacucgcacugagucugcugcugaugauacugugcaccccacugucuggguuuuaaugucaggcuguucuuuuagguauggcggcuuuucccugggugucaguaauacucaagcacuuccuccgagucaagaaguuaaugaugccaucaaacaaaugaagaaacaccuaaagcuggccaagguaaaauaucuaucguaagauguaucagaaaaaugggcauguagcugcugggauauaggaguaguuggcagguuaaacggaucaccuggcagcucauuguucugaauauguuggcauacagagccgucuuuggcauuuagcgauuugagccagacaaaacugaauuacuuaguuguacguuuaaaaguguaggucaaaaacaaauccagaggccaggagcuguggcucaugccuguaauccuagcacuuugggaggccgaagcggguggaucacuugaggucaggaguucgagaccagccuggccuacaugacaaaaccccguaucuacuaaaaauacaaaaaaauuagcugggcuugguggcacacaccuguaaucccagcuacuugggaggcugaggcaggagaauugcuugaacccuguaggaagagguuguagugagccaagaucgcaccguugcacuccagccugggcaacaagagcaaaacuccaucucaaaaaacaaauuaaauccagagauuuaaaagcucucagaggcugggcgcgguggcuuacaccuguuaucccagcauuuugggaugccgaggcgggcaaagcacaaggucaggaguuugagaccagccuggccaacauagugaaacccugucucugcuaaaaacauagaaaaauuagccgggcaugguggcgugcgccuguaaucccagcuacucgggaggcugaggugagagaauuacuugaacccgggaggcggagguugcagugagcccagauugcaccacugcacuccagccugggcgacagagcaagacuccaucucaaaaaaagcucucagaacaaccagguuuacaaauuuggucaguugguaaauaaacuggguuucaaacauacuuugcugaaacaaucacugacuaaauaggaaaugaaucuuuuuuuuuuuuaagcuggcaagcuggucuguaggaccugauaaguacucacuucauuucucugugucucagguuucccauuuuuaggugagaauuaaggggcucugauaaaacagacccuaggauuguggacagcagugauaguccuagaguccacaagucugcuuuugagugaugggcccauguaucuggcacaucugcaggcagagcgugguucuggcucuucagaugaugccgguggagcacuuugaggaguccucaccccaccgugauaaccagacauuaaaaucuuggggcuuugcaucccaggauuucucugugauuccuucuagacuuguggcaucauggcagcaucacugcuguagauuucuagucacuugguucucaggagccguuuauuuaauggcuucacauuuaauuucagugaacaagguaguggcauugcucuucacagggccguccuguuguccacagguuccagauugacuguugccccuuaucuaugugaacagucacaacugaggcagguuucuguuguuuacaggacaguucugcagaucgauuucucaacagcuugggaagauuuaugacaggacuggacaccaaaaauaaugucaagguaaaccgcugucuuuguucuaguagcuuuuugaugaacaauaauccuuauguuuccuggaguacuuucaacucaugguaaaguuggcaggggcauucacaacagaaaagagcaaacuauuaacuuuaccagugaggcaguacgguguaguguagugauucagagaauuugcuuugccaccagacauaccagguaaccuugacuaaguuacuuaaccuaucuaaaccucaguucccucaucugugaaauggagacaguaaucauagcuauuuccaaacuguugugagaauucaaugaguuaaagguauaagguccucaccacagcgccugcccacauagucagugaucacuauguccugaacacuguaauuacuucgccauauucucugaucauaguguuuugccuugguaugugacuagaauuucuuucugagguuuaugggcaugguugguggguaugcaccugccugcaggagcccgguuugggggcauuaccuuguaccugguauguuuucuuucaggugugguucaauaacaagggcuggcaugcaaucagcucuuuccugaaugucaucaacaaugccauucuccgggccaaccugcaaaagggagagaacccuagccauuauggaauuacugcuuucaaucauccccugaaucucaccaagcagcagcucucagagguggcucuguaaguguggcugugucuguauagauggaguggggcaagggagaggguuauggagaaggggagaaaaaugugaaucucauuguaggggaacagcugcagagaccguuauauuaugauaaaucuggauugauccaggcucugggcagaagugauaaguuuacgaauuggcugguugggcuucuugaacugcagaagagaaaaugacacugauauguaaaaaucguaacauuuagugaauucauauaaagugaguucaaaaauuguuaauuaaauuauaauuuaauuauaaguguuuaaucaguuugauuuguuuaaaaaccacuguuuuaaauuugguggaauauguuuuuauuagcuuguaucuuuaauuccuaaauuaagcugugugugugugugugugugugugugugugugugugugugugaaguuuaaagccaggaugagcuaguuuaaaguaugcagccuuuggagucauacagaucuggguuugaaucuggucucuaaacuuuauagauguaugauauuaaaugaggcaguucauguaaauugccaagcccagcacucagcacagaguugauauuucacacacauuagauaccuuuccuguauguggagcauggcaguuccuguuucugcuuuacuccuacaggauacuaauauaggacacuaggaucuuuauaccaagaccccauguaaugggcuuaugagaccauucuucuuauaaaaaucugacagaauuuuuguauguguuagaucaauaggcugcauacuguuauuuucaaguugauuuacagccagaaauauuaauuuauuugaguaguuacagaguaauauuucugcucucauuuaguuuucaagccccacuaguccuuugugugugaaaauuuacaacuuacugcucuuacaaggucaugaacaguggaccaaagugaaugccauuaaccacucugacuuccuucauuaguuuuauugugacaguggacucuuuugaccucaguaauaccaguuuggcauuuacauugucauauuuuuagacuuaaaaaugaucaucuuaacccugaauaaaaugugucuggugaacagauguuuuuccuugggcugugccucagauaucucuguguguguguacguguguguuugucuguguguccauguccucacugauugagcccuaacugcaucaaagaccccucagauuuucacacgcuuuuucucuccaggaugaccacaucaguggauguccuuguguccaucugugucaucuuugcaauguccuucgucccagccagcuuugucguauuccugauccaggagcgggucagcaaagcaaaacaccugcaguucaucaguggagugaagccugucaucuacuggcucucuaauuuugucugggauaugguaaggacacaggccugcuguaucuuucugaugucugucagggccauggauugauauggauaagaaagaaagagcucuggcuaucaucaggaaauguuccagcuacucuaaagauguaugaaaaagaaauagccagaggcaggugaucacuuucaugacaccaaacacagcauuggguaccagaguucaugucacaccagagggaaaauucuguacacaaugaugaaaauuaauaccacuaccacuuaaguuccuaugugacaacuuucccaagaaucagagagauacaagucaaaacuccaagucaaugccucuaacuucucugauggguuuuaaccuccagagucagaauguucuuugccuuacuaggaaagccaucugucauuugaaaacucuguacauuuuaucagcagcuuauccauccauugcaaauauguuuuugugccagccacaauauauugcuucuauuuggaccaauaugggggauuugaaggaauucugaaguucuaauuauauuucaacucuacuuuacaauaucucccugaaauauaucucccuguaacuucuauuaauuauaagcuacacagagcaaaucuaauucuucucccaccgaacaagucccuggauauuuaaaaauaacucucauacucucauuuaaccugaguauuacccagauaagaugauauaugagaauacaccuuguaaccuccgaagcacuguacaaaugugagcaaugaugguggagaugaugaugagaucuuugcuguuuauaccaagccccuuagacugugucacucuucugauccgguuguccuuguauggccaugcuguauauugugaauguccguuuucaaaagcaaagccaagaauuaaccuuguguucaggcuguggucugaaugguuauggguccagagggaguugaucuuuagcucacacuucuauuacugcagcacaaagauuuugcauuuuggaaggagcaccgucuuacuggcaacuuagugguaaaccaaaaccuccauuucacacaaaugauugugaaauucgggucuccuucauucuauacaaauucauuugauuuuuuugaaacuaaacuuuauauuuauccauauuaaauuacauggguuuuauuuuuguuuuaucuugauucaguaauuacuccuuucaguaaacacagacugagugcugugugucugacuuaugccaggcauaggugauucagagaugaaaggucaagucccugaacccaucucuugucuuccuggguauuaucugucccucccugcuuuagagcuccugaaauuugcuagaagcaugucuucaucuaaguuguugauaaacacaucaaguaggauuggacugaggcagagcccuguagucugaagcugcaguucuucuagcggcugacaagccccacuaucacuucccugcuggugcuuugcucugccagcugugaauucucauaauuguccuaucgucaagucuuuauuucugcauuuuacugcuugauacacugucaggacagacuuuaaaauuauucucagugcgaugaaacaauucugacauucauguuaugagcaguuaccucauaaauagauuacaugugagauugaacuugggcagacuauaauauagcauuaaugacgaaacagacacagucaucuucgggaagaagaauagaggcuuauuugcugccugugaaauuaaaauuacucugacugggaauccaucguucaguaaguuuacugagugugacaccuuggcuugacuguuggaaagacagaaagggcauguaguuuauaaaaucagccaaggggaaaaugcuugucaaaauguauugucggguauuuugauuaauaguuuauguggcuucauuaauucagaguuacucuccaauauguuuaucugcccuuucuugucugauaauggugaaaacuugugugaugcauuguauauuugauuuaggggugaacuggaugucuuuguuuucacuuuuagugcaauuacguugucccugccacacuggucauuaucaucuucaucugcuuccagcagaaguccuauguguccuccaccaaucugccugugcuagcccuucuacuuuugcuguauggguaagucaccucugagugagggagcugcacaguggauaaggcauuuggugcccagugucagaaggagggcagggacucucaguagacacuuaucuuuuugugucucaacagguggucaaucacaccucucauguacccagccuccuuuguguucaagauccccagcacagccuauguggugcucaccagcgugaaccucuucauuggcauuaauggcagcguggccaccuuugugcuggagcuguucaccgacaaugugagucaugcagagagaacacuccugcugggaugagcaucucugggagccagaggacaguguuuaauugugaucuuauuccacuugucagugguauugacacugcugacugccuuguccugucuucagagucugucuucccugagaaggcaaagcaccuuucuuucuugcugugccuuacauuuugcuggucaagccuuucaguuucuuuugacaguuuuuuuuacuucuuucuuuuuucaauguugcucuuaccaagaguagcuccucugccuuccacuuuacacaugagagcugggcgacgccauucaguccuaaggcuuuuaccaucaccucucuugguguuuuuauugucaucucuaagaucaaugccuuuagccuugaucauaaccuugaacucuaaucucaaauucucacuugccuaguggauugcuccauuuagauaguauauagauaccccaaccuggauauguccuaguuuucuuuccccuuggaacuuaaugcuuuucuugccaucccugucacacucaguggcacuaccauccacucgguugcccaagcuggcucuuagaguuauccuagaugcuugcuuugcuguugcagauuucccacauucaacugguuauguugucaguucuuccagguauggaccucuaaaauaaggcuuccucuccauuccgguugucauugccuuuguccaaacacagcacacaaggccuuuuacaguugcacaacucuuccuguccauacccaccacacccuuucccagcuguaagcuucagaugaguugccuccaaccaccaugcuccuguaggccuggcuugaaaugcccuucuucugucacagggucugguaguauaucccuugcccuucaagauuuagcuaaaaugugaagcuuuccuuaccugcugggagguguucucucuuuucucugugcucucagaguccuuaguccaugccuccaguacaacguacauccacuuacaugguaauuuccuguuuacauacuuuuccuacucggaguggagucuguuucuuaauaauuuugccucucccaugcccuagcacagugcauccagcguauagccccuuauucaguugguagauauuuggccacuguugccuugugggaucauaaguucugauguauuugagaagaauuucuaaaauucugacaaaauccugaaacucaaauauugacccagacaugagcaauuugcuuuucaaaugcuaagggauuuuuaauggauuugcuuuaauuaaaucuagccuguuucuaagcuuuauucauuauuucuccauacucagagcauuucuccagauuuucuaaagaauagaauuuuauugcuacauaucaucagcuaugccugcugcuauuuaauugguaucugaauuaaaaggucugguuugucccuagagaaucaaauuuuuucuucacucccauauuucagaacuugauacauuuuuaggauaaaccaugaaugacacccguuucuucucccucacccucccuucccucccauuuuuuuuuuuuuuuuuuagaagcugaauaauaucaaugauauccugaaguccguguucuugaucuucccacauuuuugccugggacgagggcucaucgacauggugaaaaaccaggcaauggcugaugcccuggaaagguuuggugagugaagcaguggcuguaggaugcuuuaauggagauggcacucugcauaggccuugguacccugaacuuuguuuuggaaagaagcaggugacuaagcacaggauguucccccacccccaugcccagugacagggcucaugccaacacagcugguuguggcauggguuuugugacacaaccauuugucugugucucugauagcauugagaaaagugaaagggcaguuuugaagguaaggaaaauaguggcauuugcuuggauccacuggcucaugccacugucuggguugguuagaagcacuggaaaagucaaaccauaacuuugagaauuaggugaucagggaaucagaaggaaagaugcaaacuuuggcucuuuuaggcgaaucaugugccugcagaugaggucauuuauuaucuuuuacacagucuauaaaauuauaauguauuacaucuuuuucuaccuuuagaaugguuaaaaauauuucuccgguagccauaugauuauuauucauccauuagauaauauagucaaaugggccauguuauuuacuguucauagaagaggggcuuuuugcaacuugggcuacaaaggagauauguaaggaauuuaaggaaugguuacauggaacuagauuuaauugaaucuagugguuuaauugauucacuaggauauaugcuacugaaaggggaaucugcuuaaagugcuuucugauauuuauuauuacuaaaacuuagaauuuauuaaaaauacugacugugaaaauuacuugggucguuugccuuuuuaaaaggauuuuuggcaugucucauuaaaaaaagaaauacuagauaucuucagugaaguuacaaaucgaauacacauuggcucugaaauucugauugauacugggucauaaaaaguuuucccaaaucagacuuggaaagugaucacucucuuguuacucuuuuuuccuugucaugggugauagccauuuguguuuauuggaagaucggugaauuuuaaggaacauaggcccaaauuugaggaagggccaugguuuuugaucccuccauucugaccggaucucugcauugugucuacuaggggagaaucgcuuugugucaccauuaucuugggacuuggugggacgaaaccucuucgccauggccguggaaggggugguguucuuccucauuacuguucugauccaguacagauucuucaucaggcccaggugagcuuuuucuuagaacccguggagcaccugguugagggucacagaggaggcgcacagggaaacacucaccaauggggguugcauugaacugaacucaaaauaugugauaaaacugauuuuccugaugugggcaucccgcagcccccucccugcccauccuggagacuguggcaaguagguuuuauaauacuacguuagagacugaaucuuuguccugaaaaauaguuugaaagguucauuuuucuuguuuuuucccccaagaccuguaaaugcaaagcuaucuccucugaaugaugaagaugaagaugugaggcgggaaagacagagaauucuugaugguggaggccagaaugacaucuuagaaaucaaggaguugacgaaggugagagaguacagguuacaauagcucaucuucaguuuuuuucagcuuuaugugcuguaacccagcaguuugcugacuugcuuaauaaaagggcauguguucccaaaauguacaucuauaccaagguucugucaauuuuauuuuaaaaacaccauggagacuucuuaaagaauucuuacugagaauucuuuugugauaugaauucccauucucgaauacauugguuuuauaugcuuacauuuauguguuaguuauuaaaacauacuaauauuguauaucuagucaaaacugagguagagagaauaaaugguugauuuugaguuugaguuucauaguccaaaaagcugauauauugccuguguucaagagggucuauaucagcccucuagaugccagcaucuccaaauuuuacuuuuuuggaaucuguacaguauuugcaauauuuuuauuacaaauuucuacucuguggaauuuaauuuuuaaaauaccugcaauacauauauauguugaauagaugaaaaauuauguagauaauaaugaaugauacgguucuaaaaagacagguuaaaaaguaaguucacuuuuauuuugagcuucagaaucauucagaagccagucgccacaaacgcagaccaaggcucuuggcacaucaaauaugccuauggcuuaggguuauugacaagucuuauguugcaguguaugugguuuauaguccugccuuccacaguugcuugggagagcugugagucacugaggcuuaugaauguuuacauuuuguuuguugcagauauauagaaggaagcggaagccugcuguugacaggauuugcgugggcauuccuccuggugagguaaagacacuuugucuauauugcguuugucccuauuaguucagacuaucucuacccaaucaagcaacgaugcucguuaagagguaaaaguggauuuuaaaggcuucuguauuuaugccaggauggagcaauuagucaucgagaagagagggacccuguaugucaagagaaugauuucagagaauccaauacaauuuaagaaaaagcauggggcugggcgcagugauucacuccuguaaucccagcacuuugggaggccgaggugggcggaucacgaggucaggagauugagaccauccuggccaacauggugaaaccccaucucuacuauaaauacaaaaauuagcugggcauaguagugcauuccuguagucccagcuacucgggaggcugaggcaggagaauugcuugaaccuaggagggggagguugcccagauugcgcugcugcacuccagccuggugacagagugagacucaugucaacaacaaaaacagaaaaagcacgcacaucuaaaacaugcuuuugugauccauuugggauggugaugacauucaaauaguuuuuuaaaaauagauuuucuccuuucugguuuccguuuguguucuuuuaugcccuuuugccagaguagguggugcaauuuggcuagcuggcuuucauuacuguuuuucacacauuaacuuuggccucaacuugacaacucaaauaauauuuauaaauacagccacacuuaaaauggucccauuaugaaauacauauuuaaauaucuauacgauguguuaaaaccaagaaaauauuugauucuucucugauauuuaagaauugaagguuugagguaguuacguguuaggggcauuuauauucauguuuuuagaguuugcuuauacaacuuaaucuuuccuuuucagugcuuugggcuccugggaguuaauggggcuggaaaaucaucaacuuucaagauguuaacaggagauaccacuguuaccagaggagaugcuuuccuuaacaaaaauaggugagaaaagaaguggcuuguauuuugcugcaaagacuuuguuuuuaauuuauuuaaagaaauagguuguuauuuuugauuacagugguauuuuuagaguucauaaaaauguugaaauauaguaaaggguaaagaagcacauaaaaucauccaugauuucaauaucuagagauaaucacaauuuacauuuccuuucagucucauucucuucuuuuaacagcuuuauucagguauaauuuacauacaauauaauuugcuuguuuuuuaagaguauaauuuagugauuuuugguaaauugagaguuuugcaaccaucaccacaauccaguuuuagaacuuuuccaucaccccacaucugucuuauauacacauauaaaugugccauacaauugagaucauacuguauguagaauuuaaaauuaguuuuuauuguuaaugaguguauuaugaauauuucccaguggguuacauuuccuaagauguggaauuuuacauugcuacauaaaaucccccuauguacauguaccuauaauuuauuuaauaaauuccuuauaaauguuggacacauuaguuuccauuuuucacuauguaaauaugucccuguauacaucuuuuauuauuuccucaggaacaauuccuacaaaguaaauugcccucucuaaagagcauacaaauugacugagccaccguuaggccauuuucugagacugcacaggucacaaagcaaucugaucuuugggaauacagcuacauuuuauaggcuucuuagauaauguuacucuaaguacuuuaaauauguggggcuucucugggcuuuuuuuuuuuugagacggaguuucacucuuacugcccaggcuggagagcaauggcgcgaccuuggcucacugcaaccuccgccucccagguucaagcgauucuccugccucagccuccugaguagcugagauuacaggugcccgccacaaugccugccuaauuuuuuuguauuuucaguagagaugggguuucaccauguuggccagacuggucucgagcuccugaccucaggugauccaccugccucagccucccaaaguucugggauuacaggcaugagccacugcgcccggcuucucuggacuuauuauguggagagauaguacaaggcaguggcuuucagaguuuuuugaccaugaccguugugggaaauacauuuuauaucucaaccuaguauguacacacagacauguagacacauguauaaccuaaaguuucauaaagcaguaccuacuguuacuaauuguagugcacucugcuauuucuuauucuaccuuauacugcgucauuaaaaaagugcuggucaugacccacuaaauuuauuucccaaaccacuaaugaacaaugacucacaauuugaacacacuggacagggggauagccaauaaaauugaaaagagcaaggaaauuaauguauucaugaucuccucuccugucucuuacauuuuugcaguagcaauguaaaggaauccuaagagaacagacauucugggaauagcaggccuagcgcugcacaacugcuuuccuaggcuugcuccuaguaccaagcuccugacgcauauagcaguggcaguaauaaccagcccauaguaagguuugucacagggacugguuguaagaacugauuugguugguauagcugugagggccuggcacgguguccacgugugccucaauccuaauucugaaaaaggcugacccugggggugcuaauuagauacacagagaggaaugaaugcugccagaaggccaaguucauggcaaugccgcuguggcugaggugcagucaucagucuggaacgugaacacugaacuucucucacaugugauucuucacuugacuggcuucauagaaccccaaagccaccccaccaccacauaaauugugucucuagguucuguguugcucacacucaaaauuucugggccuucucauuuggugcaugugaauggugcauaugagugaagucuaggauggggccuuagcguuaaagcccugggguagugugacugagauuguugguaaagaaugugcagugguuggcaugaccucagaaauucugaaaugggacugcaccugcagacugaaguguucagagagccagggaggugcaaggacuggggaggguagaggcaggaacccugccugccaggaagagcuagcauccugggggcagaaaggcugugcuuucaaguagcagcagauguauugguaucuuuguaauggagaagcauacuuuacaggaacauuaggccagauugucuaaccagaguaucucuaccugcuuaaaaucuaaguaguuuucuuguccuuugcaguaucuuaucaaacauccaugaaguacaucagaacaugggcuacugcccucaguuugaugccaucacagagcuguugacugggagagaacacguggaguucuuugcccuuuugagaggagucccagagaaagaaguuggcaagguacugugggcaccugaaagccagccugucuccuuuggcauccugacaauauauaccuuauggcuuuuccacacgcauugacuucaggcuguuuuuccucaugaaugcagcagcacaaaaugcugguucuuuguaucugcuuucaggguggaaaccuguaacggugguggggcagggcugggugggcagagagggagugcugcucccaccacacgagucccuucucccugcuuuggcuccucaccaguugucagguuaugauuauagaaucuaguccuacucagugaaagaacuuucauacauguauguguaggacagcaugauaaaauucccaagccagaccaaagucaaggugcuuuuuaucacuguagguuggugagugggcgauucggaaacugggccucgugaaguauggagaaaaauaugcugguaacuauaguggaggcaacaaacgcaagcucucuacagccauggcuuugaucggcgggccuccugugguguuucuggugaguauaacuguggauggaaaacuguuguucuggccugaguggaaaacaugacuguucaaaaguccuauauguccagggcuguuguaugauuggcuugucuucccccagggacagcagagcaaccuuggaaaagcagagggaagcuucucccuuggcacacacugggguggcuguaccaugccugcagaugcucccaaauagaggcacuccaagcacuuuguuucuuagcgugauugaggcuggauaugugauuugaucuuucucuggaacauucuuucuaaucaucuuuguguucauucccugaaaaugaagaguguggacacagcuuuaaaauccccaagguagcaacuaggucauaguuccuuacacacggauagaugaaaaacagaucagacugggaaguggcccuugaccuuuuuucuucuguagauaagagcauugauguuauuacgggaagaagccuuugaggcuuuuauguauuccaccucggucuggaauuuguuucuguaaggcuaacaguugcaauauacuaggguaaucugagugagcuggaauuaaaaaaaaaaaggaauuucaccccaaucuuauacugacuucaauagagguuucagacaaaaaguuguuuuguauauacuuaucagucaugaaaagauaauuacaacuaaauggccuuuuuccuucccuauuuauuuggagaaauuuaauuacauaaaaaaguacucagaauauuugaguuuccugcaucaauaagacauuuauaauaaugaccuuguuuacaaaugaauuugaaaguuacucuaauucuuugauucaucaagaaauaacuagaauggcaaguuaaaauuuaagcuguuucaaagaugcuucugcauuuaaaaacaaauuuaucuuugauuuuuuuuccccccagcaaauaagacuuauuuuauucuaauuacaggaugaacccaccacaggcauggaucccaaagcccggcgguucuuguggaauugugcccuaaguguugucaaggaggggagaucaguagugcuuacaucucauagguccguaguaaagucuuggguuccucacugugggauguuuuaacuuuccaaguagaauaugcgaucauuuuguaaaaauuagaaaauacagaaaagcaaagaguaaaacaauuauuaccugaaauuauauaugcauauucuuacaaaaaugcaagcccaguauaaauacugcucuuuuucacuuaauauauuguaaacauuauuccaagucagugcauuuaggugucauuucuuauagcuggauaguauuccauuaggauauacucuuauuuaacuauucccccuuuuguagacauuuggauuauuuccaacuuguucacaauuguaaacaccacuacacugaacagcaucaucccuauauccacauguacuuguaacagaauacaauucccuaggaagcuggaaugcuggaagucauggugauguucucaugguuacagagaaucucucuaaaacuaaaaccucuuucuguuuuaccgcaguauggaagaaugugaagcucuuugcacuaggauggcaaucauggucaauggaagguucaggugccuuggcaguguccagcaucuaaaaaauagguaauaaagauaauuucuuugggauagugccuagugagaaggcuugauauuuauucuuuugugaguauauaaauggugccucuaacauaaagggaaauaaaacugagcaaaacaguauaguggaaagaaugagggcuuugaaguccgaacugcauucaaauucugucuuuaccauuuacugguucugugacucuugggcaagugacuuaacuacuguaagaguuaguuucccuggaagaucuaccuccuagcuuugugcuauagaugaaaugaaaaaaauuuacaugugccaguacuggugagagcgcaagcuuuggagucaaacacaaauggguuugcauccuggcccuaccaauuaugagcucugagccaugggcaagugacuaacucccugggccucaguuucucuguaacaucugucagacuucauggguccaggugaggauuaaaggagaucauguauuuacagcacauggcauggugcuucacauaaaauaaguauuuaguaaaugauaacugguuccuucucucagaaacuuauuucugggccugccaggggccgcccuuuuucauggcacaaguuggguucccaggguucaguauucuuuuaaauaguuuucuggagauccuccauuuggguauuuuuuccugcuuucagguuuggagaugguuauacaauaguuguacgaauagcaggguccaacccggaccugaagccuguccaggauuucuuuggacuugcauuuccuggaaguguucuaaaagagaaacaccggaacaugcuacaauaccagcuuccaucuucauuaucuucucuggccaggauauucagcauccucucccagagcaaaaagcgacuccacauagaagacuacucuguuucucagacaacacuugaccaaguaagcuuugagugucaaaacagauuuacuucucaggguguggauuccugccccgacacucccgcccauagguccaagagcaguuuguaucuugaauuggugcuugaauuccugaucuacuauuccuagcuaugcuuuuuacuaaaccucucugaaccugaaaagggagaugaugccuauguacucuauaggauuauugugagaauuuacuguaauaauaaccauaaaaacuaccauuuagugagcaccuaccaugggccaggcauuuuacuuggugccuaauccuauuuaaauuagauaaaaaaguaccaaauagguccugacacuuaagaaguacucaguaaauauuuucuucccucuucccuuuaaucaagaccguaugugccaaaguaaauggaugacugagcaguuggugauguagggguggggggcgauauagaaagucaguuuuuggccgggcgugguggcucaugccuguaaucccagcacuuugggaggcugaggagcaggcagaucaugaggucaggagauccagauaauccuggccaacagggugaaaccccgucucuacuaaaaauacaaaaauuagcugggcaugguggugcgcacuuguagucccagcuacuugcgaggcugaggcaggagaauugcucgaacccaggagguggagguuacagugagccaaggucucgccacugcacuccagccuggggacagagcaagaccccauuucaaggggggaaaaaaagucuauuuuuaaguuguuauugcuuuuuucaaguauucuucccuccuucacacacaguuuucuaguuaauccauuuauguaauucuguaugcuccuacuugaccuaauuucaacaucuggaaaaauagaacuagaauaaagaaugagcaaguugagugguauuuauaaagguccaucuuaaucuuuuaacagguauuugugaacuuugccaaggaccaaagugaugaugaccacuuaaaagaccucucauuacacaaaaaccagacaguaguggacguugcaguucucacaucuuuucuacaggaugagaaagugaaagaaagcuauguaugaagaauccuguucauacgggguggcugaaaguaaagaggaacuagacuuuccuuugcaccaugugaaguguuguggagaaaagagccagaaguugaugugggaagaaguaaacuggauacuguacugauacuauucaaugcaaugcaauucaaugcaaugaaaacaaaauuccauuacaggggcagugccuuuguagccuaugucuuguauggcucucaagugaaagacuugaauuuaguuuuuuaccuauaccuaugugaaacucuauuauggaacccaauggacauauggguuugaacucacacuuuuuuuuuuuuuuuuguuccuguguauucucauugggguugcaacaauaauucaucaaguaaucauggccagcgauuauugaucaaaaucaaaagguaaugcacauccucauucacuaagccaugccaugcccaggagacugguuucccggugacacauccauugcuggcaaugagugugccagaguuauuagugccaaguuuuucagaaaguuugaagcaccauggugugucaugcucacuuuugugaaagcugcucugcucagagucuaucaacauugaauaucaguugacagaauggugccaugcguggcuaacauccugcuuugauucccucugauaagcuguucugguggcaguaacaugcaacaaaaaugugggugucuccaggcacgggaaacuugguuccauuguuauauuguccuaugcuucgagccaugggucuacagggucauccuuaugagacucuuaaauauacuuagauccugguaagaggcaaagaaucaacagccaaacugcuggggcugcaagcugcugaagccagggcaugggauuaaagagauugugcguucaaaccuagggaagccugugcccauuuguccugacugucugcuaacaugguacacugcaucucaagauguuuaucugacacaaguguauuauuucuggcuuuuugaauuaaucuagaaaaugaaaagauggaguuguauuuugacaaaaauguuuguacuuuuuaauguuauuuggaauuuuaaguucuaucagugacuucugaauccuuagaauggccucuuuguagaacccugugguauagaggaguauggccacugccccacuauuuuuauuuucuuauguaaguuugcauaucagucaugacuagugccuagaaagcaaugugauggucaggaucucaugacauuauauuugaguuucuuucagaucauuuaggauacucuuaaucucacuucaucaaucaaauauuuuuugaguguaugcuguagcugaaagaguauguacguacguauaagacuagagagauauuaagucucaguacacuuccugugccauguuauucagcucacugguuuacaaauauagguugucuugugguuguaggagcccacuguaacaauacugggcagccuuuuuuuuuuuuuuuuuaauugcaacaaugcaaaagccaagaaaguauaagggucacaagucuaaacaaugaauucuucaacagggaaaacagcuagcuugaaaacuugcugaaaaacacaacuuguguuuauggcauuuaguaccuucaaauaauuggcuuugcagauauuggauaccccauuaaaucugacagucucaaauuuuucaucucuucaaucacuagucaagaaaaauauaaaaacaacaaauacuuccauauggagcauuuuucagaguuuucuaacccagucuuauuuuucuagucaguaaacauuuguaaaaauacuguuucacuaauacuuacuguuaacugucuugagagaaaagaaaaauaugagagaacuauuguuuggggaaguucaagugaucuuucaauaucauuacuaacuucuuccacuuuuuccagaauuugaauauuaacgcuaaagguguaagacuucagauuucaaauuaaucuuucuauauuuuuuaaauuuacagaauauuauauaacccacugcugaaaaagaaaaaaaugauuguuuuagaaguuaaagucaauauugauuuuaaauauaaguaaugaaggcauauuuccaauaacuagugauauggcaucguugcauuuuacaguaucuucaaaaauacagaauuuauagaauaauuucuccucauuuaauauuuuucaaaaucaaaguuaugguuuccucauuuuacuaaaaucguauucuaauucuucauuauaguaaaucuaugagcaacuccuuacuucgguuccucugauuucaaggccauauuuuaaaaaaucaaaaggcacugugaacuauuuugaagaaaacacaacauuuuaauacagauugaaaggaccucuucugaagcuagaaacaaucuauaguuauacaucuucauuaauacuguguuaccuuuuaaaauaguaauuuuuuacauuuuccuguguaaaccuaauugugguagaaauuuuuaccaacucuauacucaaucaagcaaaauuucuguauauucccuguggaauguaccuaugugaguuucagaaauucucaaaauacguguucaaaaauuucugcuuuugcaucuuugggacaccucagaaaacuuauuaacaacugugaauaugagaaauacagaagaaaauaauaagcccucuauacauaaaugcccagcacaauucauuguuaaaaaacaaccaaaccucacacuacuguauuucauuaucuguacugaaagcaaaugcuuugugacuauuaaauguugcacaucauucauucacuguauaguaaucauugacuaaagccauuugucuguguuuucuucuugugguuguauauaucagguaaaauauuuuccaaagagccaugugucauguaauacugaaccacuuugauauugagacauuaauuuguacccuuguuauuaucuacuaguaauaauguaauacuguagaaauauugcucuaauucuuuucaaaauuguugcaucccccuuagaauguuucuauuuccauaaggauuuagguaugcuauuaucccuucuuauacccuaagaugaagcuguuuuugugcucuuuguucaucauuggcccucauuccaagcacuuuacgcugucuguaaugggaucuauuuuugcacuggaauaucugagaauugcaaaacuagacaaaaguuucacaacagauuucuaaguuaaaucauuuucauuaaaaggaaaaaagaaaaaaaauuuuguaugucaauaacuuuauaugaaguauuaaaaugcauauuucuauguuguaauauaaugagucacaaaauaaagcugugacaguucuguuggucuaca

SEQ ID NO: 13966 - RNA, 4160 nt, Homo sapiens
aaaaggggcugugaugagagacacuccaugcuccuuuaacuccauggaacagaacccaacaaaacauucaucauggaaaguugacugaugggcccagugagacuagcuggggaaggaagauggaaagagaagugccccauccaaggccugcuccuuuuccuagcugcagcccggagggauuuccucuuagcuugaggauugacuuuccauagaaucagcaccacugaggguaagcuucccugaagacaaacucugucauuggagagcucagccaggggucuaaaacuggacccuauggacuccacagauuuauuuagucugcacaguguuuaaaaauguuuuuaguuagggccaggcaugguggcucccaccuguaaucccagcacuuugagaggccgagguggguggaucaccuaaggucaggaguuugagaccagccugccugacauggcaaaacccagucucuacuaaaaauacaaaaauuagcugggcaugguugcucaggccuguaaucucagauacuugggaggcugaggcacaagaaucacuugaaccugggaggcggagguugcagugagccaagaucgcaccauugcacuccagcuugggugacaagagugaaacuccaucucaaaaaaaaaaaaaaaaguuucuaguuaguucccaacauaaaaaauuaacaauuuugcaaagaaagauaaaauccagauuuugggcuccccuaaacaaauugggauaucugaaaacagugggccacauuccuacauuccugccccuguugacaguaugcgccugcucuaauuuuacuuccccuuuuacccuaacugcccuguagggaauggaguuugcaauccccauacuaauccaucacccugcagguccauuccccuccucccugaccucuguucugauaaggggugagagaaugaacccccauauguauugaauggaaaauacauguauuggccaggcacagcggcucacacuuguaaucccagcacuuugggaggccaagaugggcagaucaccugaggucaggaguucaagaccagccuggccaauauggcgaaaccguguuucuacuaaaaauaauuuaaaaacaaaauuagccagacaugauggcaggcgccuauaaucccaacuacucaggaggcuggggcaggagaaucguuugaacccaggaggcggaggcugcagugagccaagaucgcaccauggcacaccagccugggcaacaagacugaaacuccaucucaaaaaaaauaaaaauaaaaauacauguauugaugagaaaauacaacugacuaaucccaccuaaaccaugaccucauauaaauucagaagaucuuucuaacauggcagggaggcagccuaguauaaagcaaagagcacaugcuuugcgaauguaaaccaaaaauaaaaguugaaggcccuccucaccauaugaauggucuccuuccuuugccagggcacccuaaaauuuaacugguugaggccaugauggguaguagggguuggacaugccucauuauacccuuccagcaguaacaucaacacagacuuuaagucugauaagaaacauuuacagucuauuuucucuaaagccugcuacuuggagauauaaaaccuaggucuccacaaccccuauuguaacccagccauuucuuucuaaugauaauaagucuuucaaccaauugccaaucagaauauguuuaaaucuuccuaugaccuagaagcaccccacucuuugaguugucccacccuuccagauugaaccaauguaaaugguucaauugauugauguguuauaucucccuaaaguguauaaaaggaagcuguaccucaaccaucuugggcacgcgucuucaggaacuccugagucugugucacagguguguccuuaaccuuggcaaaguaaacuuuccauuacuuauaauggcaaaaacugcaauuacuuuugcaccaaccuaauaaauggauugagacuugccucagauacuuauugguuuauaccuagaggcagaccuuggcucaaaucccaucucucccuuacucugggauauuguccaacuugcucagccucuugaaaccuacuuugcuuacagcaaaauggguauaaggggaucuuucacccaagccuuuugugaggacuaaaugugguaauggacauuaagugccagaccccuugaaugugccaucuucucucagcuucuauaaugucaugcugucaguucccuccuuuucuuuuuuucuuuucuuuucuuuuuuuuuuuuuuuuuugagacggagucuugcucugucccccaggcuggagugcaguggcacgaucucggcucacugcaagcuccgccucccggguucacgccauucuccugccucagccuuccgaguagcugggacuacaggcguccgucaccgcgccuggcuaauuguuuuuguauuuuucuuagagacuggguuucacaguggucucgaucuccugaccucgugguccgcccgccucggccucccaaagugcugggauuacaggugugagccaccgcgcccagccuaguucccuccuuuucauggcuucuuugcuucaucuuuucugucuccuuugaagguaugccuuccuggaauauaccauaaaugucaguguuccucaggauucuaucuugaccugacucccccgacccaacugcuagcuuuucccucugucuaaugcugguacagauacauaaacugauagguagauuacaacacaauucgauuuucuguuuugcuuuuuuuuuuggcuuauuauuacauaaacuuuuuuucauugcugccauacauucuucaaaauaaacacuucggggggcgagcuggcccagcacuuugggaggccaaggagguggaucacuucaggucaggaguucgagaccagccugaccaacauggugaaacccccaucucuacuaaaaauacaaaaauuagccggguguuggugcaagcaccuguaaucucaacugcucgggaggcugaggcaugaaaaucacuugaacccgcgaggcagagguugcagugagccaauauaguaccacuguacuccagccugggcaacagagcugcgagaccuugucucaaacaaaacaaaacaaaacaaaauaaacacuucauggcugaacaauaugccauuuccugaauagauuguaauuuaccuaaucauuucucuaauaguggacacuuagguuguucuaauuuugaaaggcaggaauaccaagaauguuuucuugcacauggcagauuauuucucaguauaggcucauccuuucgaguauauggcaucuuuucuucuuucccuccucucucuccucagaaguacucaaggccccggagauacuuuggcuguauccccaccaaucucaucuugaauuguagcucccaugauucccauguauccugagagggacccagugggagguaauugaaucaugggggcaggucuuucccgugcuguucuagagauagugaaugagucucacaagaucugaugguuuuauaaagggcgguuccccuacacaaguucucucuugccugccacuuugcuccucauuugcucucugccaugacugugagcccuccccagccauaugcaacugugagucaauuaaaccucuuuucuuaauaaauuacccagucucugguaugucuguauuagcagugugagacagacuaauacagcccuuauguguccagaaguacugacuuucuuggaugauaccuuaaguaaagccuaauaaagcuuuagugacugauacauuuuuaaaaaugaaguaauuauuuauguguaaugagacaaauuauuuauuucagaguguuauuugccuuacucucuucccccagcaaaaggaguccucaaguggccagccacauuuucucauuucuccuuucuucaaaaacugaugggaucuugcuugaugaagucacauaacaagugaauacagcaaagagagagggaagggggaggaaauagccguugggaauggaguguuguuggaugagcuuugugaagugugggaagagaaagauacuagaggagaccgagacaaauggauaggugaagaaacagaauuuuaguaaguggugcuguaugcuauauauguggauuugccucaaaguuuuaaaaaauggcaagc

SEQ ID NO: 13967 - RNA, 194578 nt, Homo sapiens
cgccgccgccgccgcccgccccuuuccgcuggggagcagcugcugcagcaggagcagagcaggagacgcguagccgccgucgccgccgccgggggauguggccggcgccugccucuagccgcgccgccucuugaguaccagccgccgcugcagccgccgccgccgccuagccgugcggugccaggccgcgcccuccccgggcgcccgccggcucgcaugccgaggggcuccggggcguagcugcgcgcccggcgccgccuccgggcuccuucggccccgccaugggcugcugcagcuccgccuccuccgccgcgcaggugaggggcucccgccucccggccgcccgcccggaugccucccgugcgccgcgucgcgcggcgggcgcccgccgcccgauaccucucgcuguccccagccuccccugagcgcaccgugcaguccaaagacccccacuccgccuuuccguccgccgggucccgccgaugcccgugcgcuggcuccgcggcugccgacucaaaggcgccucugcgcggcgccuagugcgcccucagcucuucccggccccuuccccagucggcccccuccucccagucacaccugagcugcccgucccgcccgccugcagguagaggcugcacuggcgccuccucugccccagguggcauccccuucccuguucuuccgggccuggcuccucucuuccaccuccguggagucuccccgccauccgccgcccguuuucugugcuccucgcagguguacccccagcaagagcucuucaccucucccaccgaauuccaguuucugcuucauuagauauucugucccuuuucucuugcccgcugcccccuggcuggguucagaugguuucagcgggucccggagcccuuccacggcccgcuccgcagaccucgcuugcucgcuugcaccccauccccccuuagugccgugacccgggccccgcggccuccccgcacucggaggccccugcgggagcgccgacucugggcugggaaggagauugggcaccuggugggugacgggagcgcuacggaaacucccucuuuguugccaguguaacaggaggaagagguuccgaauuuaguuuuucugugggcacuggcugaauguugucgcugagggcugagaugcagagauuucucucagcuucuacccugcccccauccaaauuucgccaaccuccuucucucggauccgagcccuuaaccuggguggaaauguuuagacaacuguacgaggaucaaauguaauagaacucgacuacuggccacuaauaacugagaggaccuguuuguaaauuaccuaauuuaguggauuagcgaguguauuuacaaauacuauaaaaagcaaucaggaauacugcaucaaacugucuuguggugguguaugaaaaauaggcucugacaacgccugggauguaaucucacaguuucauuagcguaguuucauuaacuguggucugugauuuguuuguuuuagggggcagaaaagggcucuuguuuuuagaaauaaaggaugguugguucuuggugaagaaaaacgcuaguuuggggggaaaaaauuccuccagaaagcuagcaucugugauaaugccagaaguguuuuugcugcugcuaaaugacuauauauaacucaguuuuaaauaaccugcauacuuguucugaaaaucugagaucuguuagagagaaaaugacuagaauugcagaugaaugggggacauuuguguuuuauuagguauccauccuaucauccuauuccuccagucuuuuuuuuuuuuuuuugaguguuugcuuacccguuagcuuuuuuuuuuccugcuagcauuauagucaggcuuuuugguguaguuaaagauuccuauucaguuauaauagcaaaguaaaacuauacguagagguguuaggaaggagaggcuugguauaucagaguuuucauauuaacauauaaagguguagaauugcacauaacuuucaacugguuaggaauuugugggggucuaguugggugcucuuuaauauuuacuuaaguauaauuuucaccaaaaagguguuuuucagauugccuuucuuuucagaauugaguuaauuuacauucccuuuugguggugaaaugccuuuaagacagaaaaguauugauaguuuauggauagcuuguucagugcaugaacaguuaaauuugggagggaugggugcugcaucagaacucugcuuuaaaaccgauagugggucuugcauuugucuagcuccacgucauacuuuucagaaugcuaucguauacguuuucuuuucuuuuaccuccucucacuguagaacaugccuuguuccacagauaagaugcaugucaugcacccaaggggugcauuuuuuuccuguggauuccuauaaccaaucaacagcugucacaugcuuuuaaguucagcuuuagggacuuguaguguucaguggagcauugaggagcagguuuugugccaaagagcuggugauuuuuuuuuuuuuuucuuauuugagauuuuuggcauccuucuucauuugugaaauguuacuaaucggcugguauuuuaacucuccuuucaggagcauuaccaguuuuagaauacuguuguuccuauauguguuuuuaaacaaaauaggguugcaacuccacaucuucuccagccucucuuaggggucucaaaaguauuuucuucuuuuuuuuguuuuucuucagacgggguuucgcuuuuguugcccaggcugcuggagugcaguggugcgaucucagcucacugcaaccuccgccuccuggguucgagcgauuuuccugccucagcuucccaaguagcugggauuauagguaugcaccagcucaucuggcuaauuuuguauuuuugguagagacaggguuuugccauguuggucaggcuggucucgaacuccugaccucgggugaucuacccaccucggccucccaaagugcugguauuacagacaugagccaccgcucccuaucaggggucucaaauguauuuucacucagaauauguuuguuucaugccuucuacuggauuguaagcuucuugagcacaggaacuguuuuuguuuuccuuauuuguguaucuacugcagugccucacuguaccuuguacuuaauaguugcucagcaguagucacuggagggaauauguagacauauauuugaaccucuggcuggcaaguggcaucgaaugugaaucuagaccugacccaucuacuguuuguaaauucuaugggcugguugauuaauuuugccaagcuguccucuucuaaacucaaaccuggacuguuuaaguuaaaauuuaccugccuuuucuauaucccuuccuguucuuucagugguaccaucagcuugcaaaauuguucaagguuuuccuuugcuccugaugaccugcuuaauguguauguuuuaguuggagcaguggcuacaacaucuuaaaagagcuugucugcaaacucuaaugauaaccuacacaacacaugaaaacagugugcuuugagguaaucugcaguucaguuuagcuuuucucagcaguaucuucagcaacuuuaaagcucuggcagguuuuaucaauguaaauaaagugcauuuucuuuuuguagcagggcuucacuuuugaaauauaauuuauuuucccuuacagucucuugcuauguuguagauucucauaaaagaguuuguggucuuccaaacuuugaucucuuguaaucuguccugguauuauuuucauuuucuuggcagugucuggguaucaugauuuuccaucaaaauaauuauacuguuuuaggauuuagaucaaagaaaagugucacauucuauacuagcauuucauugcuagaggagcagauuauuggcaaaauaauuugugcuguaucagcuauguacaucuaggaucuuaaaagugucuagugagucagggcucuuaaggaacuuuuuaaauuauuuuuuaaaaauuagugaccauuacaaguuguuuacuaauauugguaauugcucaauacaaaccaacacaggacagucuuugccuaaaagucuuuugaggggaacguaaaaguaagauagucuugaguuucuuuuuacaguacuaauccucccuaaggcucuuaaaauuuauucccaucucccuauaauucauuuguucugguauaaccugacauaauuucuauccuuguaauguuaaacuucaaauuucacuuguaaaucuucagauuuauuaaaugcucuuucccauugacaaaccaguuugaaugaaucuuuugaaagauuacuuagcaaauugccguaagucuuuguccuuaauggcuagaugauuauuucucacagcagugcuuuagaggccaggagauuuugcaaguucugugaaguucuguguccuucaguucuaaccuuaaauguuguaagagggauggaggagaaucuuucaaguugaacaaacugccgcuugucugucuagcguuaggagacauuuguccacugucucaucccauugucuucaaauugaaggcuguauauuuaacugucuuuuuguagcacucauauucuguuuugggaguaauaaaaaacaaucagaagugguuuacaaaugcugguuaauauuugcauaugcuaacugugcuuuaacaauuuuaauaauaccaucaucuguaucagcuuuguggaguuugaagugagaugguaaaaauuaaauuugaagaguguagugggaauuacccacagagacuaaaguugcucaguuaaauuaagaccugcaaaguaaacuucaucuaacgggaacagaagucauggcaugaagccuuuuuuuuccuucaucuucugaauacuguguuguuagcauagaggaucuacuccucaaaauauguaaaucaaaguuaauuucgaaauuggaaaauaauguagaaaugguaauuuuuuuuuuuuuuuugagccagaguuuggcucucaucgcccaggcuggagugugguggcauaaucucgguucacugcaaccucugccucccggguucaagugauucuacugccucagcuucucaaguagcugggauuacaggugcucgccaccacacccagcuaauuuuuuuuuuuuuuuguauuuuuaguagagacgaguuuucaccauguuggccaggguggucucgaacuccugaccucagaugauccacccgccucagccucccaaagugcugggauuacaggcaugagccuccaugcccggccaauucccaaaucuuaaauugcaguuuacuaauuuuuuuuuuuuuuuuuuugugaaguagggucuugcuuugucacccaggcuagagugcaauggcaugaucauagcucacugcagcuuugaucuucugggcucaagugauccucccaccucagccuccugaguagcugagacuauaggcacgagcucacgccuggcuauuuuuuuaauguuuuaaauuuuuuguagagacaggaucccacuauguugccuaggcuggucucaaacucccggguucaaacuaugcuccugccuuggccucccaaagugcuaggauuauaggugugagccacugcacccggccuacuuuuuuaucuuuagaaaauguuuacuuuucuaaagauaaaauuuugaauuaaggaauuuccaaguuaaauuucacaccaccauuuugaacuuucuacaguugccaucuggagaguagcaugguacagcaaaacuaguccacuuagaaugcuuccaggcuuaacaaauacuauacuaucaaauacuauuugauguguuaacaguacagucauuuaaaaauguuauuggccugggaaaauuauucauaaaaauauauucuacuaccaguaauugguugauaguuguuuuucuaugcuccccuuuccccugcucaaacugcaaagaaagaaugaaauauuucaauuuuguaauuuugccucagauuuuugggacuauaggggauauaugagauaaaccuacuaucacuuuucuguugaucuaaacuagaauguagagauaugaaguagacugaggucagagagauacauuaugagguagcugggauuagaaaccugcuuaaucucuuaaucucuuguccuuucuguaguacaguacuauuaauucuuaaugucucaggcuuucuuuuccuuucauccuuggcugcacauuggaaucacuuggagaaguuuacaaauguuauggaagugaugccuggguccuauucccaaagauucuuauguauugguccaagacugcgggcugggcaucaaaaaaaguuuuuuuuucuguuuuauaagugcuucuugcagagcagggcuaacccauaauaguacacccagaguagccagcaucaaaacuuuuaaaaguuccccugguagcccucgugugucaccaaguuugagagccacucuuccuuacccuuucucuagguaauuucaucccucguauggcuucaguuacagucuguauguuaacaguucccaaacuaaauuacuguccuggucgcugauccuuauauccaacugauuaauuagcauuuacacuagaauauuguacaggcaacucaaacucagcauguuuaaaucuguccucaaaaucguaccccucacccccggcuuuuucaguacuuuaucucugguucaccgaaugauaccaaugcccugguuguggaaacuggagacucgaguccuguagggaaccugccucucacucuucuauaucuagucaccacaucuugccucuuugaccuucucaacgucacugccagcacuccgguucaagccucugucaucuccagcccaguaccuugguuacagaucucuccguaacuguucaugcucccuucuaauuuuucuucguauugcagucuuggugaucuuugaaaaaucccaagcuaauuguguuccucuccuacuuaaaacccuuuaaugguuucccauugcucuuaggacaaagaccagaacccuugacccuggacaacaagacccuguguguggcuguucuccaucucucuauagggucaccuuguggugugcuuuucuuugcucauugcacugcagccucacagauucuucaguugguuguauuccuuccucuuagagggcuuuugcauaugugguucacuugucuaggaggcucuuugcuuugcucccuggcuuuuggcugguugcuuuaaguuucagucugaaagucacuuccuuggaaaagccuuuucugaucccuucaaacuaggccaugucuccucauuaaacucucauagccuuauguguuuucccugugagcacuuaaagcaguaaacacguaauuuuacaguuaauauuaaugucuagacuagguggcggcaaacuacagcccaugggccaaaucugaccugcuaccuguuuuuuauggcuuacgagcuaagaauggucuuuacguuuuuaagugguugaaacaaaucaaaagaauaugauuucaugagaaauuuauuuaauaaauuaugaaauuuuaauuucauucacaagguuuuauugggacacagucauauuaauucauuuacuugucuauagcugcuuucauaugacagugucagaguugaguaguugugacagaggccuuauggccugcaagcauaaauauuuacucugugucccuuuacagaaaauguuugcugacccuugcucuaggcugaguugaugaagagaggggccguguuugcuuuguuuauugccaucuuggugcuuagcugguaccaauacaugguagguacucaugaaauauuugaaugaauuaacagauauucuguuucccuccauggauagaggugauugaacuccuaccuuagaacacugggguuuuaaaauucauuauaagaauuuuaaaacgauucuucuuuggaagacucuuaacagcauguucagggcucucuuaagcagcuugucuguugaagguauacaugucacguauggagcaaguauacuuauaaagguguaaguuacugggucaagguggacaggaaagggcuagugcgcucaaguaauggaccagucagauuuacaguggugauguuuuuauagcaggcacaaaugggugagacuuuauggcaagcguuguaaagaaaacguguuugagcuggugaaaaauuuaagucauuaaagaguuagacauuguuaucucugcugugggaauucacucugugaagaugguuaaaguuuuugacacaguaauauuuccuccuuuuugauacuuuuuguuuucuaauuuauuuggaauauagcauagcauaauguuccaauuuugaauuuaugcauuguguaaaauuuaguaauuuuuuuggcaauuuaaaaaacagauuuacauuuuucaguauguuuuauuauacucaauagagggaugccaguuuuuccccucugggggacuccuuuguaauuguauaauaugauaauguuguauaauaggauucauuuaacaaacauuugguugauaaaccccuggaauuuauuuuuuugugaaaauauuauuauuccuuuuaguuacucucuacaauaucccacaaccagauauuuagacuuauuuaguaggaaaacccuuaaaagcaacuuuuauucaaauuuuuaagguugccagaaaugcugaaaauuauuaaauggaaguguuugacuucuggauauguuuauaauauguaaaguaaaaaaaccagcaggaagauggaaaaauuggaaacaugauuacuucaagauauuuaaguagcagggaagguauuaaaguuuguuuguuuuuguagauuugugauaauauaaucaugauuaugaucucagaaaauucuucauuuugaacuacuuaugauguuacagcuauaagaaauaaaaaaggcuggguuugguggcucacacguauaaucccaacacuuugggaggcugaggcaggaggauuacuugaagccaggaguucuagaccauccugggcaauauagugagacccaucucuacaaaaaauagcaaaacaaauuagccagguauggugucgugugcuuuuggucucagcuacucaggaggcugaggugggaggaagaucucuugagucugggagguugaggcugcauugagcuaugaucgugccuguauuccggccuggguggcagagccagacccugucuuuauuuuuuuuugagacagagucucgcucuguugcccaggcuggagugcagugacacaaucucagcucacugcaaucuccgccucccggguuuaagcgauucuccugccucagccuccaaguagcuuggacuacagguacccgccaccacaccuggcuaauuuuauguauuuuuaguagagaugagguuucuauguuggccaggcuggucucgaacuccugaccuugugaucugccugccucggccucccaaagugcugggauuauaggcgugagccacugugccuggcugagacccugucuuaaacaaagaaacaaacaaauaauaauaauaaaaaaaacccuuaaauccaaauagcuaaaacauuaaggaaaauugauuaucuccuauaggucaagggguaggguagcuuucagguugguuaguucaguggcuugaugucagcaaggacguaaguucucuccuuguuucuuuuuugucauuuuacggaagguagcuuuuucuuaauuagcuccccucaagaucccaagauggcuauggcucuucuuaccgucuuuugcugagcugacaaucuccagugguuuuccuuucaugggaauuagagagggcugcacacuuaucccuaaacaagcucuaacaagaggaaggcaaaggacucugcaauugauuuagaguaaccaggacuucccucugagucaagugaggggcagggcaacaccggaacaaaaggaggacuuugccagcaagguggcggcagggaugcaggauugggcguggugacuggguaggcagccaauacuaucugcuaugguuuugccauuuucuuuugucuuuaaaucagacuucuauaguguuuccuaacauuuuacuuauagccccauuaugaacuucacaguucguaguucaaagucacacaguuaguuaucuucuuguccuagugaugcugcucaagccauugcugaaaccccugucuuucuuuuuugcucacccccacugcaucuuucccauucugagcuaaggacagcuucagaugaagaagagcauuugagguuggaauaaugguuaaguggugaguuaguauucuugcaggccaugguccuucaagagcaccuuggcuguuaguauaaccucuucucucucuagcuuacaaucuccuuuucuaccucuuuugaagucucacuucugucuguguuuaucucuguuucaaaauugaguaucaaaaaacugauaguuuuuauuuuccuuauuuuuuuuccaccuccagcugauacacuuaaggagcuguaauaaugaguacaauccacuaaagagggaaaaaaagagagccucuguuuucuuuuguuuuaaccugcuuacuuucagguuuuuuuguuuuuuuuuuuuuuuaauaauuaaacugaaaagucaugucauuauuuagaauaucucugauauaaagaguucucacaguauauaaaaugcauccuugcaauacauaauuuacagaaggaaauaaaccaguguguaaauauguucaaucuuguuaacaaccaaauuaaagcauagaggcauccuuucacagcuguaacuuugguaauaguuaacaaaauaauauuaauugcccaagugguuuugacucaaauauacuuuauugauuugcugaauaaauuggaaugacccucuugagauacauuaagagccauaaaaaaguuaacauccuuuauuugguaauucuaaaguugaguaaugcuauauguaagaaucuuuuuauuguagcauuauuuauaauggcaaaaaguuuaauuuaaaacaucauauauuugcuguaaaacuuucuuccuguuucuuaauaaaauccauuugaauuuagucuguuauacuuccucauugccaacuaaaugguccugccuuagucauugaguagccuuuugccuuccucagaaguccuuucacuauuucuucucuaaacagcuguuagaauccagaggauugaacaucauuguguacuggcaggagggugggcucuauagccagacuauaucaauuugaaucccaccuuaucacuaguugaguuauuuggaccacauucuuuaaccuuuggugccugaguuucaccagcuauaaaauauaaacaauaauaaaacuugccucagauacuuuuagcaaacugcacaacucaugaauguaucucagaaauuacaauauuaauguaaacuaaaucucccugauguucuaauaaccauuaauccuucccuuaaaaauguuuuuguguuugaguuuuggaaagguacccugacuuccaaaaauuuuauuuuuauuuuugagacagggucuugcucugucacccuggcuggagugcaguaguggaucucggcucacugcaaccuccaccucccagacucaagcaauccucccaccucagccucccgaguagcugggacugcaggcauguaccaccaugccugcuaauuuuuguauuuuuuguagagauggaguuuugccauguugcccaggcuggucuugaacuccugagcucaagugaucugcccaccucagccucucaaagugcuggaauuacaggcaugagccaccacacccagccugguuuauauucuugugguaauuuuauugugagacagaguaucauuuaagaguuagauccagcugcauaugacagaaaacugaaagaaacuagauaaaccagauaaaaauguauuucuuacccaaaguaaguccagaaguaguguuucagggcuaauaugagacuccucguuuaucaaagacccacucuccuuuugguuucauuauguaagcauauggcuuucauucuuaagauuacaaaauggcuggaaacucuuuuuuuuuuuuuuugagacagggucucucucugucacccagguuggagugcgguggugagaucucagcucacugcagcaucaaucuccugggcucaagcuauccuccugguugagcuucccaaguagcugggacuacaggcaugcacuaccacgcccagcuaauuuuuguauuauuuuuauuuuauuuuauuuuauuuuauuuuauuuuauuuuauuuuauuuuauuuuauuauuuuuugagauggacucuugcugugucacccaggcugaagugcaguggcgugaucucagcucacuuuaaccuccaccucccagguucaagcauucuccugccucagccuccugaguagcugggauuacaggugcccaccacgacagagggcuaauuuuuguauuuuaguagaggugggauuucaccauguuggucaggcugcucucgaacuccugaccucagguaauccacccgccuuggccucccaaagugcugggauuacaggugugagccacugcgcccggccuuuuuuuguuuuuguuuuuguuuucuuugagacggaguuucgcucuuguugcccauacuggaguacaguggcaugaucucagcucacugcaaccuccgcaucccggguucaagcgagucuccugccucagccucccaaguagcugcgauuacaagcaugugccaccacgccuggcuaauuuuguauuucugguagagaugggguuucaccauguugaucaggcuggucucaaacuccugaccucagauggucugcccgccuuggccucccaaagugccgagauuacaggcgugagccacugugccuggccuguauuuuuuuguagagacgaggucuugucucccuauguugcccaggcuggccucaaauuccugggcucaagggauccacccaucuuggccuccgaagugcugggauuacaggcaugagcuaccgugccuggcucccagauuguaaacugugucuagaaaaugagugcaaagagagaaacaaacauaaauaauuagaggcuaaauuggguggcaaggaguucaggggacggggaaaccaagagaggaaagaauaguuggggaguuggcuuccugaaaaugauucuccagcaaaagaucuggucuggaagaaugggguuuagaaaaagugaagggcagacagauuuuaguagaaagcagggagaggaauuccaguguaaagaacaguuggucaaaggcaaggaagcagacaauaacuugcugcuugucaguauggaaaggagaccugaccagaguggagugaagagauguuauguugcauuuggggaaggcauucauauuugaaggggaggaaaaugggcagccauggaggaguuuucagagugguuuaaggaagauuaauuugacagcauaacugcaccugaaugggagaaauagaaggcagaggccgcccagggagcuguucaguaacucauaccaguguaaacaggaaacagagaagaguuauuguggagucaaaauaaaauagaccuuccugacuuaaucuggauaugugggaugaaagagaaggaaagaacagauguuuugaacgccacaucauggaagaaggguauuauaauggcuagacauguuaguugagauggggacuaguuuguggagaggggaagaugaauucaauuuuguauggacugacuggaggugguacugauauuaauaccuccaggcgguauuuuccauagggaauugaagacccagaacuggauuucagaaaaugcuuuaagucaugagcauauagaauauagagaacaccagucauugcuggggauuuacugugugguagccucugggcuaagcgcuuuacaugcaguucucauuuuauucucauaacucugaggugggucccaguuagccucauuuuacagaggaggaaacagaaacucagaaaggcuagguaccuugacuaggaucgcccaaguaguguaaaacugggaguaguuccaagccugugcacuuccugcuguauuucccucugcuguuccaaggacugcuauauuaaaugguagauugaauguaccuuagauaccacuuuuuugucucuuaauuucagagguugugugugcuguuugcuguuuguuguuuuguuuuguuuuuugggauggaguuuugcacuguugccuaggcuggagugcagcggcgcagucuuggcucacugcaaccccuaccucccggauucaagggauucucaugccucagccucccaaguagcugggauuauaggcgccaaccacaacaccuggcuaauuuuuguuuuuguuuuuguuuuuuuuuuuugguagagaggggguuucaccauguuggccaggcuggucucaaauuccugaccucaggugauccgcccgccuaggccucccaaaaugcuggcauuacaggugugagccaccacgccuguuuguucucucuuuaaagucuauguguagguugguuuuaaaucagugcaccucaaacuauagaggccaggguacgacaguuuggagcagagucugaaaguggugguuauaaacuucagacucuaaguaaggaccaauggcuacugugcguauccuccagggcccuuccauauuuucuucuaagaacuaagucugaacaagucugucaugacagcaaguuuacuacuuguuacuguaauuguguucuuuccccauaauucaccaauuccugaaaauacacuuuuaaauaaguaauggauauuuauauguuuagucagucuuuggagauucauggccuucgaaaggguuaauauaauugaugcuuguguuauuaauauugagugccaacaaggcucuggagagcaguaagagaggaaagggugaagaaaauggccucaauaaaguugacucuggagcacaaaugauuagugugcacauuaagaucaaauuacgaaggcagagauuccuaccaucagagcaagagcuggaauuuuuaaaauaauaaacuucauuuuaaaaacucagcauauuuaagagaguuuuauuccuugcuugcuaagccucaaaguuuuuccaaaucuauuuugcaugugguuuuguauuuucaugacaauucugaaaccacagguguuggaagacaauucuaaagauaccaaguuuuaaguauauuuugacauauuuugaaacuagccauaguuuuaaucaagaaaaacauuuuucaguguacacugcugauagaagcagauuucaguuaugaaaguuuggaaauaauacuuuaauaaggcacuucauuuuaaaacugaaagcaauucuaguuugcugcuaguuuaaaaaguuuauaguuuaaugugaucugagaaaguaaaccaagaccaaguggaaacacuuauuuaucuugagguugcaacaagcaaauugagcugggagacuucugggugaggaaggaucugcuacuuaaaucaggcucuaagauaugauagauggugcucuacaugccaucacuuugaaagauuuaaauguuucuuauguaagaauaucuuaaucaggauuucucccaaguaugugcuuccaaagcaccagggcuacaagguguucugccaaaaaaaggguucugaggucagaaaaguuugagagguucuucuugcucacuucauaccacccccucacuggccucccaaccccauuugaaaaguaaucaugcauauuaacauauuuagggucauugcccugccucccaggaaaccaguuuaacuuugcuuaacuggccuuuauuggacuuaucuguccuuuaaaauuuuuuucacuauaucuugaacugcucuccuacacagcacacuuugaguaacacugcuugaaauacugcuucucaauuucauucucccaaaugacaacaaaagugauuauggugaaaccagaagcaacaauaagguuguuggaucaggugacucuuaacuaagaaucacucagcucugaaacugacuuuaagugcaucacaaacuucauguucuucuuuaagauauuggcaaaaguagauaaauuucaagucacucaaguauauuauaacuuaaaacccuuucacgugaaucauuguuucucagauuagugauuugagaucuccaagggauauuagguaggguaaaugauugacaaaagaauccuucaaguuugaaacuugauaauaugaacugcuauggggucagcugggccaacagcaagaaggggagcuaugaucugcacuggaggauuuucuccuuucuucaagucugcugcagcagaggggcaguuacaguuaucacuuaaacuccaaaugaccauucggagauggaaugcuaucuuugguuggagaaagaauugaggauagggaugaugggccaagcaaauaauagauccucaauaaauguuuauugaauacauauggaacagggauggaguauucagagacuaaacauuuaguuuguggugcugauacuugucaagauuaugguuaaaacaaauacaacuugccaauggagagaaaugggaaugaaccugaaaauuaaaacuagcugccguucaaacuguuuaauucuggugggcuuuugaauucuaccuugcuagcauguguuccuagguuauaaugaagucuugguguauacauuaauauuaaccaaucaggaaaaaaggcacaucauaagcuagaacccucugggccucaucaaaaccucaguaugacagguaaucagcacuggacgauagauuuauuauauaagaaugagggccuucuuucccuucugccacaccgccuucccccauuucccugcaacacaccucuuguuucuggcccacagagcauaaugaaagcucuucuggcccauuuucucagugccugccugggaguagacuggguaaagcuccagucuuaaguauuuuguucagagugugaccuggaagaugacaagcagcacugcuucugcccauugcagcaaugaggaaacucaggacaaagggaagaugcugaaaaguaaaauaaaagaaccgagaauaucgguagaauaaaaagagaaucccaagcuggcugcaugcuuugguucuguucaauguucaugggcuggugugcugucaggcuaaguacugggcucaacaaagaaugagacuuuuccuucuguaagugugcagucuguuaagggagaugcuacggagggguguagcuuugucagugugccagagcccagcugaaucuguguuucucucucucucuuuuuuuuuuuuuuuuuuuuuugagagggagucucacuuugucgcucaggcuggagugcaauggcacgaucucggcucacugcagccucugccucccagguucaagugauucuccuaucucagccucccaaguagcugagacuacaggcgcccgccaccaugcccagcuaauuuuauuuuuuuauuuuuaguugagacgggguuucaccauguugaucggguggucucgaacuccugaccucaggugauccgccugcguuggcuucccaaagugcugggauuacaggugugagccaccacgccuggcccuguguuucuuauauagcuaaauauuaguauaguuuacaagguguaaaacacugauaauuccuugcuagauuuuaaacuaauuuucaaaacuaaaaacuagaaauacaaaagugcccuaaaggaacauagauguuauuuuugaaguuugguuuguguuugugcuucacugguaaggaugaaguucaguaaacuuuaggauaaaguuauugugucuguaggcaugacagcauuuuauuauacagagugaaaaaaauacuguccuugaguaagaaaauaacaaagcuucagaugccuguaugcaagucacaauggcuuuugaggcagucccauagaaaagauuguaccuauaauauggguaauauuuuaauuuucauguugaaaugaccagcuuuuaagcuaauaaaugaguuuucuucuuugauagagcagauucuagaaauuuuaaaguagaacacaucgaaaguauucuucugucguuguugacuaaccuaugguggcucuuuuguugcucuuauguguuuaugacuuagucauguaucucugcccuguuacccugccaggaaauccaugugcucuugccauagucccaaagucucauaccuaacugggcacagugaccuguuuaguguuccauggccauggacuaacuacaggguccagaauggauucagggacacccaaguauucaauuuguuuccuaccacuacaucagaccaccuuuccauuuaucuuccagcuuucucccauucagacauacauuuucuguuuaugcucuuuaaguuuuuaaaucucauuugguuccaaaaauguuuuagguaauuuuuaauaaaauguaaauauauuuaagacuuuugaaaugaaaagccaaaagcugaaaggagguggaggugggauaaaaggaaaaagaagcacaaauguaccgagugccugagcuucuucaccuaccaguguuucuaguccuauuuuagaaugauacugauucaaaggaaauugucacauggaauccuuuuacagaauuacacaacugucaggggcuuaagaggucuaccaagguagccaugaauuuuaugucacauacucuacguggauuuuguucagucuuuguuuaaacacuuccagcaacagauaacuuacugcuuccugaggcauuuguucuacauucaggcaguuauuagaaauuucauuuugcacuaccgagcucuguguccauguaacuucauuguucugauucugcacccauuagccaaacagaauaaaaaaccgaaauuggccuuuagugugugccaagguauguguguguguuuuaaaguuaaacaccuuuaguuuuuacaaccaugucugaaugucagacuuucagaaacuuuacuguucugggccacuucuuuacuuuacuuuuaugcuuucaugauuaaaucuauguaauuuuuauuuuuaucaguuacacauguguguauuuuuuuuuuuuuuuugagauggaauuucacucuuguugcccagacuggagugcaauggcgcgaucuuggcucacucaacguccaccucccggguucaagugauucuccugccucagccucccuaguagcugggauuacaggcacccgccaccaugcccagcuaauuuuuuguauuuuuaguagagacaggguuucacuauguuggccaggcuggucuugaacuccugaccucaggugauccacccgucucagccucccaaagugcugggauuacagaugugagccacugcgcccagcucauauguuuguauuuuaaagaguuaagcauuucuagggcuuguuauuuuaaaaagcuccccacccuccccauuuucugcugcccugagaccaccacuuuuaaaucuuuaauucuuuugcuuuucccccuauauaucuuuaauaugcuuauacugcuaccuccucgcuuuucaauuuuugacauuaauuuuggacuccacuguagaagauaaagauugagcugucuuccaacaccauccuuugcccuacccugugcaccuacuucggguugcccuuauccuucugcugcagauauaucaucauaacuuuguuuggaucaauguucagucuuuuuuguuuguuuguuugagauggagucuacucugucacccaggcuggagugcaguggugugaucauagcucacugcagccucaaccucccaggcucaagugauccucccaccucagccuccugaauagcggggaccacagauuugcaccaccacgccuagcugauuuuuaaaaauuauuuuguagagaugaguucucauuauguuucccaggagggucucaaacucuggggcucaagugauccuccugcuuuggccuccugaagugcagggauuacaggcgugagcccucgcacccugccuaauguuuagucuucaucuuaugacuaagugguugcucuuaacagccgagucauguaguauuucaucauuugucacucuuggagaucgugguugucuuguucuacugucuacccagcuuucuauuaauaugcacuuauaacuaauuggcuuauaaacucucaccuaguugugugacucuccuuugaguaagcucagauaccuuagauauucuuucaguuucaauuuccugaauagaucucucccauaccuccaaacugggcuggauacucuucaggccugcuuuuuuacaaagcugucaauuuaagaucucccuucacaucauaccuggaauuuuuuuuuuuuuuuugagauggaguuuuacucuuguugcccaggcuagagugcaaaggugcgaucucggcucaccacaaccucuaccuccuggguucaagugauucuccugccucagccucccgaguagcugggauuacaggcaugcgccaccacgccuggcuaauuuuguauuuuuaguagagacgggguuucuccauguuggucaggcuggucucgaacuccugaccucagacaaucugcccaccuuggccuuccaaagugcugggauuacaggugugagccaccgugccaggcccauucuuucuuguauuggauucccaauuaucuggaucccaugugcuuuuuuaguuuauuuuuuaauuuacauacgguacaauucacuuuuuguucuacaguuguaugaacuuugacagacgcauggccuuauggagccaccaccaccaguagcaagauacagaacaguucucacuuccaaaaauucccuugagcugccccuuugucaucagaucacuccucuacccuuggcaaccacugaucuauuccuguaguuuugcuuuuuccagaaugucauauaaauggaaucauacaguauuguaaaccuuuugaguuuggcuucuuuucuucaguguaaugcauuugagaugcauccaugcuauugcaugcaucaauaguuuguuuuuauggcuaaguaguauuccauuauaugaauauaucauaguuuauucaccaguugaagaacacgggguuguuuccaguuugggaugauuauuaauaaagcuccugugaacacuucuaugcagugugaauguuuucauuuaucuuugguaacuaucugggaguggaauugcuggguuguaugguaagugaauguuuauaagaaucugccaaacuguuuuccaaaugggcuguaccauugugcauucccaugagcaacguauaagaagaguucuaauuguuccauauccucgugagcacuugguauugucaguuuauuuuuuaaauuguuggcauagacguuuagugauaucccacugugguuuuaauuugcauuuuccuagugaccagagauguugaacaucuuuucauguacuuauuuaacaucuguauaucuuucuugguguuguaucuuucgaauuauugcucucucucucucuuucucuguguguguguguuaagagacauggucuaacucugucacccaggcuggagugcaguggugcaaucauaacucacugcagccucaaacuccugggcucaaacagucuuccuguccuagccucucaaguagcuaggccuauaggugugugccaccguaccuggcuaauuuuuauuuauuuuuuauuuuuauguagagacggggucucacuaugugcccaggcuggucucaaacugcuggccucaaccgauccuccuuucuugaccucucaaagugcugagauuacaagugugagccaccauacuuggccuucauugcuuauuuagcagagggguuuugugguauaagugaguucgcuucucaucuuuucccaccacuggcucgggaaugaauuaugcuuuugauaucauagcuaggaacacugccuaguucaaggucacaaauauuuucuccuauguuuuauucuaaaauuuucuaguuuuacauuuuacacuuaggucuauuauccauuuugccaaucuuuauauaagguuugagguacagguugaguugguuuuuuguguguguguaugaauauccauuuauuucagugcaauuuauugacaaagacuauguuuuccauugaauugccuuuguaucuuucucaaauaucaaccauauauguguggaucuauuucagaacuuucuguuugguuucauccauuuguuugucugucuuaauacuaguacuguauggucuuaauuauuguggcuuuauaguauauauugaaaucagguuaugugaguccuuuaacuuuuugcuuccuuuucgaaguuauuuugacuauuauaguucuuuugccuuccccuauacauuuuagaaucagcuuguuaauaucuacaaaaaauuuugcugcgauuuugauuuggcuugcauugaaaugcauggauccauuagggaagaauuaauugucaaauuaauacugagucuuccaaucuaugaaugugauguaguucuccauuuauuuaagccuucuuugaguuuuuuuuucuccccaucagugucucuguacugguguuauuuuucuugguuuauucccuugauuugguagaccaccuccuucaguagcuuacugagaaaggcuccaugagggaaguuuguugacaccuggcauguuuuuauuuuuaugucacauauguaauaguugaguggauacagaauucuagguuggaaauuauuuuuccucagaauuuuaaaugaguuguuccauugccuucugacuucuagggucgcuguugaagucugcuauucugauucuugauucuucauauuaaacuuauucucucucaaaccuuuuaggaucuuccuuauaacccaaguucugacauuuuucagcgaugggccuucuauccauuaugcuggauacaguaugggcucuuucaaucuggaaauuucugguuugcaauugggaaaauuuuuucuuaauucuuucuuggauuuuuuuccccccauuucuuccccguuucugaauuuucuuaccauuuaaaaguauuuuugaacuccuugucuuuucuccacaaugcaauagauuuccuuaauuuaccuuucaguauuucuauuguguuuuuauuucugcuaugauuucuaauuuccuagugggugcuuuuguucuuuucaguauucuuuuuuguuuuuacaucaucuguuaucucucuguguguguuuuaauuucacuucucucugcaacugcaucaucuuuuucuuccaaguuauuuuuuccuguuugucaugguaaaagauuccuuaacugucuggucauccuuagcuaucuaguuauuauuaauauuuaggaacggggcccuaaaagauuguuugaaagcauuguauuauuuggguaugggauuguuggcuguggcauuuucuguagaguggucuggcucgccuuuuucuucgggaaacacuaagugucaguaucguuuggucauuucucuuggacucaucagauuuccccaaacaagucucuucugggcuccuggaaaggauauuaaucuggcugccagaguccugggacucaagcagggaaagaagguugggguggguguugguuucaauauucaguguauaaacuuccacuucauccuuuuguuuucugugugguaccugugugugguccaacucuucuggguagaagaggggcaguuguccaacugcacagaagaucugaaugcucucaugcaacccaaugaauccuucauuuuuagccccauugucaucuccaguuccagagauauauuaaaccaugaauuccugaguuuugagggaguuuugugguguaaguggguucacuuccuaucuuuucccaccacuggcucgggauucagcuuuuucgaguguacuaggucaauuuauucucccaccugcuucguaguuccaaauguuuuaaaucccucuauuauuucaguggaguuuuggaagggagccgaauucagugcauguauucaguuagucaacauuuacucuaaguagacuauccaaaucucuuucauugaucugaguucuauuuuaacgaucuucuuuuuuuuuugagacggaguuucgcucuuguugcccaggcuggaaugcaguggcgcgaucucugcucacugcaaccuccaccuccuggguucaagcaauucugccucagccucccgagcagcugggauuacaggcaagcaccaccacgcccagcuaauuuuuuguauuuaguagagacaagguuucaccaaguuaaucaggcuggucucgaacuccaaccucaggugauccgcccgccuuggccuccaaagugcugggauuacaggcgggugccaccguaccuggccaacaauuuucuuaaagugggguaugcaaaaagcaacucacuaaaguagauauagguaguccuuucuucuggauucuuaauguugccuuauguugaauucgcuuuuucaacaacuucacuuacguuaccuugccguucaccaaaagcucuuaagaaagccagcuuucccuuuugugcucuuguuucuuguagaauuuuaaaaacauaaguaugaaguuggaauuuuccccaagaaauuuaaagcuguugauuuuugcccagcuuuauagacugucaugagcuuuuauuuuuauuauccaguguaugugcucuuccuuucccagguuucuauuaucugauuaauauuaauaaauuuaugucugcauauuaauuuagggaacaccuccuaauuguggcauucacuauaggguggccuggcuggccuguuugcuugagaaaccccuaauggcaauaucuuuuggccuugauauuauuuaucauuuuguuuuuauuuuuaaacauuuccuuucagauccucucuuuagacacucuuuuuaacuggucaccucuuuucucaagaccauucuggcaguuuccuauacagcugaccuguacuuuaguccauuuccucccauguuauccccugaaauauuacuagaguuaggauuaauaaauuuuaauaaaauucagguauaucauguauuucccaaucuccauucuucuaucaaaaaaggacaagacuuuagccaggaauggcuuacucaggugcauguguuggcucuuacugguccccucuuucuuguguaagugcccacaaacccucccuuugauauuuuguuguacaguuuuacugagaguugacauuaugcucaauugcuaaguggguagcauucacuuucuucccccuuuuaaaaccagggaugcugccauguuccucucuguguuguauugcugugguuuucuacaguugcuugaagguuacugacagcugccagcagucuucuuugcacaaauccucuugguguuuguucaggcgugugacuugucuggaccaccagggugugaacucuaacuugggagacaggagaggcaggucuuaaacucucucgucuuagugugccacacugguaacauguagaagacacucaguaaauguuucaguaagcuuguuuauuugaaacaguuuacucaccuacuagagcuucaauguuuauagaccaauauugaaucccaucccacuaaauuuugguuauacauguaaggugcuuucuuguguuaaaguguuaaaauuuauugaaaaaaauaucuuuucccaguaccugcuaaugucccaagcgucgugcugggcuuuggagagaucacaacacaugacagcucuuacugucauggaacucagugauguuucgugcaugaucauccucuccacuuguuuauugacauuggagguggcauaugugaugucccuuuuucuaaaaaauuuucuccuaagacugucuguagucuuucuuuacguaaucauaucugacaugggucaacuuuguugcugccacccuagcccaacucauggucgucuugugcuuagcugccuacaguucuuucuccacucaauagccugagugaucaaaaaggugauucagacuccacauccucuccccuccagaggcuuccaucacacuuaaauauaauauccagacuucuucucuaccuuacucuggcucugccucccucuucaccuccccacuaccauccuucucauuuauuauguucuggccaaguucauuguugucaaacaccucgagauccuucgucuuucagggccuuccuuuucucucuggcucuacccuuagauuugccagacuuccucccucaguucuacaccuuguacccuagcugucauuuucuguuucuuuacuuggcuguauuuuuuuaaaagcugaucaucaccugaaaucauuaucuauuuuuuguauuggcuuucucccaccauaagcacugggauuuugucaggucuguugacugcuguauccccaguguuagaacagugccuggucaauguuuguugaaugaaugaugcaguaauuguaucaacuuacauuguuucuuucuaccucucuauuuuuaguucagagcccuuuggaugagacaggcguuucugaacaaaggcauucuuccagacuuaauuagguucccucuucuaggguuaagugcuuaaucuuugcagcaucuuaaaacgguaaaaacuaaauucuauucuuugaugccaucuauguaaucagugguuaacuuucacacgcuucuuuccuguuggaauaauagaugaaaagaccaagcguggcuuuaaguccuucuguuuuauaauuccuggacacauuucucaaauuucugcugcagguuuucuuguuaucccauaaucuugacagguuuucucucaccucuuggauuccugcugucagaccuuguuaggcuuguuaauuuucuguauagcauggaaugaugguuuucuagaagguucugacaaacccuuacucucauuuaucuuauugcuccucugguacagaaucuuucauuccucuccuauguucccuuguaucuuuuuuucccccuaaauuaccucccuuaauuccaaguggguggaaggaaaaggaauggaauuuggucuuaaaggaugaauaaugacuucguuggaauaucaguaaaggaacucuagucugcgggaaugguacgagcaaacacauagaagugugaaauguguaauguguuuggcaaaagugguuugggauggcuggaguguguguuuaucucuagugugaagucuggccagaaagguagauugugaucuuuuucuuuuuuuucuuucagacagagucucacucugucacccaggcuggagugcaguggugcaaucucagcacacggcaaccuccaccucccagguucaagugauucuccugccucagccucccagguagcugggauuauagacaccugccaucacgccuggcuaauuuuuguaguuuuaguagagacgggguuucgcuauguuggccaggcuggucucaaacuccugaccucaggugauccuccugccucgaccucccaaagugcugggauuacaggcgugagccacugcgccuggccugauugugaucuuaaaugcuaguucuaggguuauggaagucuguacuuuggucucauaauauuuuuguuucucugguguagaaauuauuuuguuauguuuuacauacuaguugaaagcaagagucuguuuuuauuuuuuccucaucuucaacaguaucuaauagaguagcuugcacauaauaagaguucaaaguugaguugaauugaauucugauaaaaugguuuaauuuucccaagaaaaucuagaagccuggacucuuucuacugaauuaaucaaaaggagaaaauacauaacuuuuuuaauuguacaccuuauaugagucuguacuguagauauucauuuuuuugucuucuuuauaucuccuaccucacuuuuccuuuuuguaauauguaaucaccacaacaggcagucuugggaucaaggagaggggcuugggagauauuuaacuccucaguaucuccaucaaguccccauucuuugauaggacaguuaaucuuuucauaaucuucaaugcagugcuaugcagaggcauguucuuguaccuccuuccaaucagagaacugcgugugucccucaaugcagaaaaucuggaaccaccaucaagaacaaacuuauauaccuuugagaaaggcugagagaaaaaaaaaaaagccguauguauuagguaucacuauucucuuuacaggugaaaaagcugauucauaaagguuaaaggucuaagauuauuuagcuaguaagcaaaugaguuggaauuagaacacaggucuuauauuauuuucuuuccucuauuuuuuagguaucccaaauuccacuuaagguugaugaauggccuacuggucaguugaaaaaauucaauuuguguagcauugucuagcacaaaugcugaaaguaggucuccucaucugcuaagggauauaagcaaauucaaagccucuggccuuucuugugacacaugcaugaaaguagguaauaaaaagaaaaguaaauauuauuuuaugccacaguaaguauaauguuaaaauaauuucaguacguuuaauuuucuuucauauauauauauauauguauguauauauaauuuuuuuuuucuuccuugagaugaagucuugcucugucacccaggcuggaauguaguggcgcgaucuuggcucacugcaaccuccgccucccagguucaagcaauucuccugccucagccucccuaguagcugggauuacaggugcccaccaguacaccuggcuaauuuuuguguuuuuaguagagacaggguuuugucauguuggccaggcucaucucgaacucccgaccucgggugauccaccugcuucggccucccaaagugcuaggauuacaggcaugggccacugcgcccagcccgauaauuuuuauuacaguaaguuugauuagaguaugagugaccaaaaucuauuucuaaaacauagaguuauuggugaauuagaaggggguggauguuauuccuuauugucaacaugguucauguagacuguggagaugaauggauuacauuuggcuuuuauuaaugcuuacaagcuguauuuuuccuuuuuugcuuuuuucuaguucuuauugaacaggauugauuugaaaaauucacauguaaacucaggaugcugggcucuuauaucauuucaugguggaugauuuguguaaaauugcaacugagugaauuucauucaagcaguaggaaucuugaagaugugaguccauuacuagcaaauguuauguucugaguauauugucugaguuuuuuuuuuuaccugcagucacagagcagugacaguucauaccauuguacauagccguaucauacuucauuaagcaguuuuguauugcucuaaaaucacuguuuuugcuuuuuuccucaacaauaugugucugaguuuuuuuucucuuaguaggauuaauaauaaucuacuuucccuggcugugaugcucuuuagagaucaaacagcauuucuaaguugcaaggaaucuuccacccuguugucuucugcuuuuacacacccacacagucacauguuaaugaaugugauaguucuguagguuauuauuucuuuaugcauauaaauauguuucaugguacuuaaagacaggguaggguaguaauacugacacugauguuagagggaaaaguagugaauaaagccaauaaaaaaaccaguaaaggauauauccaucugugagguuuugcuuaugcucauuauagcaaacucuucauucauucacuagauaaaccacuaauucgcauuuuaccagauguuccccuuaagcaauaugaagcuacuccuuuuccgcuuugauucuauuuugcaauauaucuuuucuaucagcauuagauucaaaguuaccccuggacugugcccucaguuuacucaucuggccuuugucacugaacaagaauuguacucguggagguguauuggccuuuuugaaugagcgucuucacuccugccucacugcuuuuacuuaugauguucuuguuuggaauuuuucuuccuccuaucugaauccuauccugaugagccaguucauauucccuccuuucaagaagccuuccucuucaguccacacugaccaccuccuucucugaacacagcauaaauuaccuuggcuauuguuaacuaaguguuucaugucaccuaccuauagaaauauugaaucuuuuaaagcauaggaugaggaccuaucauucugaucaugaaacaaguucuucugcccagaauuuaauaacauauuguugaacaguauggguagaguaaauaacaguaacacaacuauguauccauuguuuacuuauuugcuauauguagugguauguauuuuacauauaccgugguuaaccucacaacuguuacaggugaggaaaauaaggcacacauagauaggguuaagugauuugccugugucauguaguagcuucuuuuuaguagagccaggaacucuuaguuaucucauccauuccaaucugugaguuucucagguguuucuaucuuucauaaccuugauccuauugaaaaguaagcaccuguacuuuuagagcaauuauauaauuugaaauccacacauguggacccaugugaaguuuaaauucuuaacaauaaugauauaaaacaguucaauaguauuaugauuucaaauuuaauuugaagucaguuugaaaaauaauaaauuuuuuucuucagaaguacaaaguuaaaggcuuggagcuagucuugacaggagaguaguguuuaagaaacaacuauacaaccguagcauguauuagggaggccuaucucaauuuguuguaaugcuagauuuacaucacagaugguagcuucagcuuugauuuuagcucuuucauggaaaauaauguguuuuacagcaucagggauuguaaacaaguuccaaaguugagugcauuucagaaguuuuggcauagcucuaagcuuaguaaauucaucuucagaaugucaugaauauugaguuuuuguuggucauauuuugcuuucagcucuugaauuuuguucaugaaaaugugagccaugcaaugggauaaaugcuugguaauucaggccugucccugagggauccaccuuggagguaaacacagacaaugaaagugugauuccuuauaaaauuuguaaccuucuuuugaaauugaguucuaggaaauauucucaaaguuuuaaauuuagugauucuguugaguuugaggauuggucagcuuaugaaaaaugaaugcagucuccuauuauuugaucuacaugucugguuugaaucagagcacuuguguuuccuugaucauaucagcagugcuacugcuuuuugcccccuguaguuucaguuuugguguguucagaugucuugucacaucauggaagaacaauuuuuuuuuuuuuuuuuugagacggagugccgcucugucgcucaggcuggagugcaguggcgcgaucucagcucacugcaaucuccgccuccuggguucaagcaauucacuugccucagccucccuaguagcggggauuacaggugccugccaccaugcccggcuuauuuuuauauuuuuaguagagacgggguuucaccauguuggaccagguuggugucaaacuccuggccucaggugauccgcccaccucggucucccaaagugcugggauuacaggugugagccuccgugccugccuggaagaacaaucuuagagucaccagggcgucugacaaguugagccacuccaagcccuuuaauuccaaguguccuugaucugaggaagcagcuuaauaaaucucuugaacagguuuucacagccuagccauaugacugcauuaaaauaaagucaacuucuuuauaccucuucaaauauuucuuggauuugugaagauuaaggugacugaagagucacaaucucaaucugucacugcuuucaucaugucaugcagugaaccugauucauucauucaguaaguaguuuuugagauuucuaugcccuaggaacuauucuauguacuggggauacagcaaagaacaccaagcuuacuuauuuuuuaaggggacuaaacagagacacagguaaaauauacaguauagcagaugaagauauguacuguuuuggagaaaauuaaguuaggaaacggggauggggagccguguguguguguguguguguguguguguguguguguguguguguguguguguguaugugccugcaguuuacaauaggguugucacgaaaagccucacugggaugagggggcaaacaaacuugauauuuaagaaaggaacauuccaggcagaaggaauagcaagugcaaaagucaggaggcaauccugagagcucaguagcaucaagaaaaccagaguggucugagaaguggaaggaagggaacagcagguccaggcuauuuugugcccaagcaucuaggguguuguuccaagccauuauaaaaacuugacuuuuguucugcaugugacaggaagauauuaugggguuucgagcagaggaguaauaagaucuggcuuuccaaucacguuauugaaacuaguguugaggggacacggguggaagcagauagaaggcuauugcaguaauagaggugacagauaauggugacuugaacgagagugguagcaguggagaacugauaggacguggucagauucuggccauauuuggaagacagagccaucagcauuuucugaugaacuggauagaugcugugagaaaguggcaauaagguuuucagucugaacaccugaagguggaauuacuguuuacugaaguagggaaggcuguugguggagcagguuguguagaauaucaggaguugguaauagauguguguuguggaugagacaauggaacgugaguguggucagccucaucucuugaauacacuucagaaauuugcacaacccucucuuuacugcaguuacuccauucaugauaaugauuuaaacuuuucagugucuaaaucaagugucuuagauucccugauggcagguacucgugccuguuagcuaacuggguuucaaagaaaaucucaaaucucaagcaggccacacucugguaagcagguagcacaagauccagugguucuauggggagccaaauguuucugcugccacaccauauaggugaaccuggaaaaaacaagcaaacaaaaacagaauaaaauggaagccucaacaauaauugaaaaauacaauaaacaacccauguuugcaaaaucaggcacugaaaacaauagggcugaugggaguugggacggaccaacuaaaacugaggaacuuuguaaaccaaguagccuaauagggcuugguccuucccauguaaccaaguagugcaugggaaguacucaaaaaauguuaguggcaguucuguuguugacacaagaguacuaaaaaacaaaauaaaacaagagccagcacagucaacucuaacugguacuuguuuccaguaucacagucagaaaauucuguguagcuguaaacccuggggcucaugcuuucuucuuugggaaauagguguuagaggguauuuugcuuccaauagagaccauuuggauaaaaauugaaaagcugauccagcauauagccuucuuaauccauuguuucaauacagggaggaauguauuugcagccuucuuuuuuuuuuuuuaagacagggucucacucugucacccagacuggagugcaguggcgcugucuccacucacugcaaccucugccucccaggcucaagcgauucuccugccucagccuccugaguaggugggauuacaggugugccacuaccgccuggcuaauuuuuuuuucuuuuucuauuuauuuauuuauuuauuuaugagauguagucucgcucugucacccagacuggagugcaguggugcggucuuggcucacugcaaacuccgccucccggguucacaccauucuccugccucagccucccgaguagcugggacuacgggcgcccgccaccacgcccgguuaauuuuuuguauuuuuaguagagaugggguuucaucauguugaccaggagggucucgaucucuugaccucgugauccacccgccucggccucccgaagugcugggauuacaggcgugagccaccgcgccuggccuuuuugaauuuuuaguagagacuggguuucacuauguuggccaggcuggucucgaacuccugaccucaaaugauguacccgcuucggccucccaaaguccugggauuacaggcaugagccaccaugccuggcuguauuugcagcuuucucaucugcauuugcagcuuugccagauaacuuagaaggaaaguauagugguuuuugaagccacugaaucagcuaccacauaugcuaaaguaagucacuucuguagacuuucagcuuuuuuuuccgccuuuaaggucaucuuauauugccaaggcuuucucuuuaaucaugagaaaacuugucuaugcuugaaaacauuauuaugcugagaaaaauugcaugugagccaaugugacuucaccauuaugccaacagcauucaucuguugccagucagauaugagguaaugcuugucaaagaaacugcagcagaacaaacugugcugcugaccuaggacuccuuagauuugcccuucaacccgggaaccaaacucagaucuaccuccuuauugauagucuaggauuuuucaguuuaaaauagguauuccccgggaggcggagcuugcagugagcugagaucgcaccacugcacuccagccugggcgacaaagcaagacucaaaaaaaaaaaaaaagguauucaguaagaacaacuuuaaguuauuuuaauaauaugcucaaaaaacauuugaaaaagcucaacaucuauuuuuuuuaagccauuuuaaaacuaggaaaagaaaacuuuuuuuuuuuuuuuuuugagacggagucugacucuguugcccaggcuggggugcaauggcacaauuucggcucacugcaaccuccgccucccggguucagcugauucuccugccucagccucccgaguagcugggacuacagcugcacaccaccaugcccagcucauuuuuguauuuuuaguagagacgggguuucaccauguuggccaggauggucucaaucucuugaccucgugagccgcccgccucggccucccaaagugcugggauuacaggcgugagccacugcgccuggccgagaaaacuguaucuuuaauaagauccacugucuuaaaccaacaagucagucuuguacucgacagugauacaguagggcaucuucaguuuacaucaggaauauauaaaccuucuaucaccauuaacauuguucuagaaguucuaacucgugcaauaauccaccauaccaaaguaaguauaaugaucugagaggagauaaaauacaaaaaaaagaaaaucaacuaaaaauuacaagugcuguauuugguaaguauacaaaaaucaguaucuuucucaaguguuagcaauaaccaguuagaaacauguagcauaaaaaaaucccauuuaucaaagcgucagcaaauauaaaauuagaaauaacccuaacaaauauguccaguugaaaugaagaaaacuauaaaacuuuucuugagguuuuuaaaauaaauaaaugaacuagagggacauacauuguuucugaauacaaaaacuagaauauugagaugucacuguuccaauuaaauuuaacgugauuugaguaaaauugacaaaaugauuuacaaaaugauucuaagcaagaagcauaaagggaggacuaauaucaaaauuaaaaaauaguggucaacacuguguugcaguuuagcaauaauggucaugaguugagguauuggagguagaguauaggauuccaggucuagcucugauuuaucagccacaugacuauggcccagguaccuaaugucuucaaggauaacuuuacucaccuguaaaguguaggauuaaaugagauaaagaguugagcaaauugcuggugcuugggaaguacucaaaaagauguuaguugcuauuuuguuguugaccaaaaguuaauggaagguaauagucuacacauagaccauaguauaaauaagaauuuauuauuuguuaaauuagcuguucugaauuaacaguauuacucacacuauacgucaaaauaaauuccaugaaaccauaaacagguauuaauagaagaaaacaguauuaaauagcugaagagcuuuaaaguguugagacaaggucuaaagucaaguugauuuggcuguacaaaaauuuguuuccacaaaaagaaaaacaaauuggguaacaaacugaggcacaaguaguguuguauugguguuuaacaaccagcucuccaagugaagaaaaaaaauccagauuugcuacauuugcugauuuccaugguguauauacucccacuaugacuaauuuuaagcuaccgauguaaaguccaugagcagaaguuaggaagaaauguucaagguugucucucaugagcuggugugagucaaugugagaucacugcagcacacaaauggcacagacauggcaggacaugcugagaaacccucuuaagaucacccagcccaccgaggugaaccugugacucccaggccagagcacauuccuuuuuguaguugccuuccccaggaagcauaagauagacauaacagagcaaaaaauucacuguugucauggagagcaccuugagggagcuggaccuguagaugcucucaguagagaaaucccuguaggguggcuggggcguacccugggagcagccucuuugggaacaaagucauacaaugacugaagauuaaggagagggguguugcuaggcaaaugcucuggaccagaacagagauguuccucuggugccuucuuuucuuuccgaaaccuaugauauucuuggcaguggcacauguguuuuacucucuuccuugauaaggugcuuauagucuuucucuuuguuuuuuuacuaucuuuuugauauuauuuaauuauugccuauaauaguuuucauaaauguggucaccagaaagaugagucauggaggcagugguaguauaugaaugcaugaaggguugugucuaggagugacgacuaaggugauaucuuguuguaaaggaugugucugauacgggccaggcagacaugauaucgucuggaagggagguuugaagguauagaggcuugggguccuuugccauguuuguugacauagggcuuccaucaggggcuugcacuuuuuauucuacaguggaugacuacuagcuggucauuucguaacccaggcuuacaugugccaucuuaaaauggguuguuccuuugugauugcaucuguaguucuaauagaagaucagcuuauucuuggguggacuuuguggaaagaagcaggauuuaacuggcuuucagagaaaugaagacuuugugaauuugggagccauauuguuuaaguuguauaguuauuugaagccugugacugagaaucauuacuuagggcaguacagaaagaaccaauugacauggagugggaugggguacagagacugaggagagaagaaaauaguuacuuuugugggauuaacacagauuaauuuuacacugugagaaaaguagcuguaacagacacauagaagacuggcuggugggcaagauaaauugccguaauuguauacaaaccagugcaggucugucugagcuugggaccuggcuuuacaagugggaugucuuaaugacucauuggguguggagguuuauagauacauguguuuuuagagcauuuacuuauucaaguuaggcuuauuagcauucauuuuucuugguugcuuuuuuuuuuuuuaagaacaaauuuaguaucucucauuuguagagcuauuaauuugaugguucacuguucccccucacuuauuugagugugucuaaucuaaucacuuuugaucuuuagcuggcuuuccuuaacucagcuucuggugugcccauauguuuucuugugaauguuugcugaucauggaaucauugaaugucaaaguuggaaaggacugcaauagucuucugaucagacugucaauuugauguuugaguccucuguguuauuuccuucucuacuugcuucuuaauaauagauugggucuugauuuuuuuuuucuuuuuuugagauggagucuugcucugucagccaggcuggagugcaguggugcaaucucggcucacugcaaccaccgccuccuggguucaaccaauucuccugccucagccuccugaguagcuaggauuacaggcgugcgccaccaugcccggcuaauuuuuguauuuuuaguagagacgggguuucaccauguuggccaggcuggucuugaacucugaccucgugauccaccccccuuggccucccaaagugcugggauuacaggcgugagccacugcgccuggcacgucuugauuuuuuaauaguuggaauuugccaagaaggaggauuuggggguuuugugacgauauaucaucuucauauacagcagucacuuggagauaacccauuggucauacuuagggguagcugaaggucagcugguuaucugaugcugaaaugucagugcacauucaguggcccgugcugcaggauacuucaaccuuuaauuuuaaaccuugggccacagaugggaguuuaguuggacuuuggacccaaauuguaaggccagguuaaacucagcacucucaugcuccuaggacuuccuccaugguucugaucuauuuccgggcauggagcgggugcugaagguugguugauuguggagaaacaaccuuguuuuauccaaagauaguaaggcaagccugcagaucuaagagcugcuuauuuguaaauuauacugaaaugcuaggagaaguucucuggaaacggucuaaauuguaguucuuuaauauuuucugcuuguagaauuugaaugggaaguacuuggugugguuuagguuuuaccaaggaaggccagcugauagcugugaagaggcgcucugcuaagugucauugaccuuagaauccacaaagcucuggggcuuuggagacuuagaacuuuauuuugcuagauuuaaaguguacucuucucuuaacguagaauucauguaaaacuacaucauaagacacaccuaucaacccagcaggcuaauuuauucaagaaucaacugacaggcagaccagaaauuuuuugucaguuugguaagugugaaaguaaagccaaauuauuauuauuuaagaacuauuacauuuauucuuaauagaaaaguaguaugguuauuuuuuaaaaauccaaucccaauaugugcgaguccuuucucauuccaccuuaugagauaacaaauguuagcagcuuagucuguauauauucuucccaagugucuguaauugcaauaagcuccauugcucuauugcuuuauuuuucuguaguucucuaguuauguuuugcacuccacuugucaaccuguggaaggcaagagcacagucagaagguugccugaugacauggaaucagaugaagggaaggggaguaggcuggaugacccauggugcagccucaguucaguagccugaauugucuauucagcaguaaaagcacgucugcaugagaagcuaggugccagaguucacucuucuaggacccuuuccccaacacaguuuggaaggacaguaucaagguuuaucugucacacuuuuauuuuucacuauaacuacccagguacaaauccuggcaccuaauaggugcuaaguaaauaguaguaugugucuaccugcccuauccauuuccuauuuucugacaaauacagucuuuuuuuuuuuuuuuuuuuaagagauagggucucacuuuguugcccaggcuggucuugaacucugagcucaagcaauccucccacaucagccucccaaagugcugggauuauaggcaugagccacugcacccgguccugacaaguacaaucuuucuguagcuguguuuauacugcagucugguuuugccuugucacgugaguccuuugaucucuauaagaugauuuuucuaauucagaucuauuuuauguuauauuuuaguugucugcaacauuauuuacccucuucccuuguguugccuacagagggauugaaagucagcaccuuaucuaguaauucuaguaacuucugauuucucagaaacaugauuuuguucaucaaauuucauuauuacccaagucuuuaccuuaaagaccuuccacuuucaucucguauaucugaugcgguagcuauaugaaaaguguucauauggagucugucaugaagucagcagaacucugcaggugaaguggccaauguggacccuuugaaguguuuuaaugugauuucuuuuauacauauaacaaauuuauugagauauaauucauauaccauacaaaaugauuuuuaguauguucauagaguugaauagccaccgccacaaucaguuuuagaacauuuuuaucaccucaaaagaaaccccauacccauuagcagucauuccccauuuccucucaacucccacuuucugucucuauagauuugccuauucuggguauuucauauacauugaauuauauaauauaugggcuuugugccugguuucuuucacuuagaauguuuucaagguucauucauguuguagcauguguguaucauuacuucauuccuuuuuauugcaaaauuauauucuauggcauggauguaccauauuguguuuaaucacucaucaguugaugggcauuguaugugauuuuuuuaauagcaaaguagcacuuuaaguauuauuguuuuugaaauacaaucaaguguuuuacagaauuuagguggaaguuacagauggcuaggaggaaacaacaguuuguuucugccuguuaaauaucacugcagguguuuucuucaaauaucaagaguaauauuuggacauuuggaaauuaccuuugaaaucaaaagacaaaauauguuaauaacaugcuauucuugguuaugaccuauaauuuuccuguaagaaaaaguuaaccauguaaaaaaaaauaauuuacccacugucucacgcguccaugugaagagaccaccaaacaggcuuugugugagcaacaaggcuguuuauuucaccugggugcaggcgggcugaguccgaaaagagucagcaaagggugguagauuaucauuaguucuuauagguuuugggauaggugguggaauuaggagcaacguuuugcgggcaguggguggaucucacaaaguacauucucaaggguggggagaauuacaaagaaccuuuuuaaggguggggaagauuacagaguacauugaucaguuaggguggggcagaaacaaauuacagugguggaaugucaucaguuaaggcuauugucacuucuuuuguggaucuucaguugcuucaggugaucuggauguauacgugcaggucacaggggauaugauggcuuagcuugggcucagaggccugacacccaucuggccaacaugaugaaaccccgucucuauuaaaaauacaaaaauuacacagacaugguggcaugugcccguggucccagcuacuugggaggcugagaugggagaaucacuugaaccugggagguggagguugcggugagccgagauugcgccacugcacuccagccugggcgacagagugagacccugucucaaaaaaaauuuuuuauuuuagauaaauuaagcuguagaauguacugcgguauuuuuacugcaauucuuacgccucucauuuuccucuuuucccuccuuuuuuccacauaguucauuccacagugucuacacaggauaugcuaaccacaguaaacagagcgcagcaaagugucauggguccuggcccaacugucugguucacauuccugcuguaguacguacugaccauuugaguugggcauauuacuuaacccccuuugucucaguuuccucaucaguaaaaugggaauaauaacaacaucaacuucauaacacuuguucugaagaauaaaugaguuaauacaggcaaaauggcacauggaauaugcucaauaauauuagcuaaaaucugucucuuuguaugguauuaugauuuaguguuacacagucacuuuaaguacuuguauaaaacaucauuuugguaauagucuuaauuuugauugaucuauaaucuuuuucuaccuuaauacgugcagcuuuuccuauaauuucgccaacccucaauuacgaacucaaauggguuguguuauaaaagggaggacaaccaggcacaguggcccaugccuguaaucccagcacuuugagaggccagggcaggaggaucacuuaaggccaggaguuugagaccagccugggcaacauaaacgagaccccaucucuacaaaaaauaacaauaucagccagguauagcagugcaugccuguaguccuaacuacucaggaggcuaaggugggaggauuacuugagcccagaaguuugaggcugcagugagcuaugauccugucacugcguugcagccugggugacaaaacaggauucucucuuuaaaaaauaaauaaaauaaaauaugaaagggaggacagaaaggguagaacccagagacaaggaagguaaauuagcaagagaacagcagaaaggugaaaguaaaguagcugaaucucuuaagcuccaagcacccuuccuuuuauaugauaaguuauuuauugaaugaauggauuuuuaaguuugguugauuacagguuucagaauugaaguuuccuucaacuuccuuuaaaacuuuaagaccucacagucuguauguuuaucaaaacaucauguuguacaccuuagauauauauacuuuuuacuacucaauuauaccucaguaaagcuagguggaaaauuuaagcuauaaaaaaggcauuucaguuuuucucauuguauugucauuugaaaguuacuauuaauuuguuucuuacacaauugucuauaaaacuguguacucauucguugcuucugguuguauuucccuuacaacuaguuuuucaguuuucaaacacacauuuuauaauauguacaguaugggaacaacuuaaagauguuugagaugaauauuugugggaacucacuuuuuuuaaugcuucauagggaagauuuuccuguaucccacuaggaaaggacauaacaaugauuuagggcuuaguccuaggaacuuaaaaucauuuauccugaaaacaaugcaugcuauagaguaguuguccuuaccuugcagguggggaggucaguucagcugaucaucuacuguuuagaagacuagcuagaauucaagcccagguuuguguuccuuucccucuccauaccuguuuaccucucuaaauugccaguuuuccugcauucuucaggagaaaucuugcuccuaccugggucauucucagcauacagcuuucuaaggaaauuugaaguguucuaaucucccaucaauaaguguuagguuaaaugacuuaaacauuuucuggugguuuugauauauaggugauauaaugaggaaguagaaaaagcauaaucuggauaaaugggagcauauauuauauauaauguauguuauuucuuucauaauuaaauagcauuaauggaaaucagaaugggaaaaaugcauuauaaaucaaauuacuuaaaaauugcaucaucccuuucuaaugcuuacauauuugcauauucuccuuugcauauuuguauaaucagagcauagaugcaauuucaaaccauguuucuaacacaacuguuuauuauaaucauuuuuauauguuacuauacagucuucauaguuauuuuuaugacuuuaauaucccaguuguagauuuauuuucuauuauuggauaguuaauuuguaauuuuuuuucucauaauagcauuguauugaacauguggagcuauuuuaauguuuuuuuuguuuguuuguuuuuuguuuugagacagggucucgcucugucgcccuggccggggugcgguggcaugauuacggcccacugcagccuccauugccagggcucaaacgauucuaccaccucagccucccaaguagcuaggaccacaggugugugccaccacaccuggcuaauuuuuuaauuauuuauagagacgaggucucacuauguugcccaggcugguacuaaaccccugggauuaagcgauccucuagccucagccucucaaagugcuaggacuacaggcaugagccaccaugccugguccuauuuuaauauuucggauuauuuccuugggcuucugaaauguauugccaaauuacuuucuaaaagugguuaaccaauuuacauugcuuucaguuucuuaaccaauguuaucagcguucugaaaguuuuucagugagaguaguauccuaacuaugaauucuuauucucugauuucuagaaauauaaugagagaggucagcauugucugcaaccacuuaccccaauggguguaugaccaaauauguuuuggagaaucuuacaauaaaggcucaaagaaauccuucuugaaagacuggacuucguuaacccgcauuuccaaaacuuauuuaaaaugggauuaauuuuucucauauaauccauuaacaaacaucuuugggaaaugccagccauauaauaucugcgggaaaaggaaucugcuuaugaugcaauagauacuuuuuggguaaaaaaucucauguaggggaagcgguaaggccgucuguucuaacaucaugccacuccagugguaagagaccuagccugguuuauuuauucacuaaauaaaugugcugagagccuauuuaugugcuaacugcgguaacuauuggggacauaggaguuaacaaagucaagucccuguccccaaguagacgauaaagugggaagacugaacauuauauaugcaaccauuuaggggaagcuucuguacacauuguuuugcauggaauagguuuucauuugaagaauauuugagugcuuucuauaaacaauguuaaucccuggguuaaacaaaaaauagacacauuacacuuaccaucaaaaaggucaucuacugggaaaacauaaauaauuauaauauggaaugauaauuacugugaugguauuuacauagugugcuguagaaacacaaaggaagggaaccuaguucaccuuacggguuccucugguagggauuugguucacuuaagaguuuuaugccacugucguagaacugaacacauauuuguuucagugcgugacugcugugaacuaaaaacaucuuaauugacaaagacaauaccuaauuuugauuuagaacauaaauuuaccaaauucugcccaccuauuugcuauauuaugaucagugcaaucuuuauguuacuucuguauaagucauuauaagucaguucucaguguuuuuuuuuguuuuuuuuuuuguuuuuuugagauggaauuuugcucuguugcccaggcuggagugcaaugguggaauaucaacucacugccaccucugccucccagguucaagugauucuccugccucagccucuugaguaucugggauuacaggugcccaccaccaugccuggcgaauuuguuuguaucuuuaguagagacaggguuucaccauguuggccaggcuggucucgaacuccugaccucaggugauccacccuccuuggccuccuaaagugcugggauuacaggcgugagccaccgcaccuggccuguaagucaauuuuuaucuguuccaucauggaaaagagagcaagauuggaguaagaaucuuauauugcauaugcaugaaauuuuaaaaaaugguuacaggauagccaaaaaagucaauacacccauuaacagucuggaaacugacuauacuguagcagaugggaggugcgaaguagagcuuuggucuaucagucuguccuugguaucaucaaguacugaagaaauucugacccuuguaggaugugauaggaaaaaaaugaagcccaugaaaacuauaauuuaaaaaaauuaaauaguaauuuuaaauuauaaagguugcuuaccacugauucaggagaaagacagguuagagauacuguuugaggauugcaggcaaggcuugucuguauaauuuugauuguuucuuugauaauagagguaaaauauguuauuagcuauguugcagagcaggauuaacuuggccucugcccaguaauuaucacguguucauaugcaagaaagacagucauugagaagucugaugcaagagagacaucuuuguaacaggcccacaauuauuuuuuaggggaauuggaggcagaaugaagucauuggcaauuuaucucucugugaucuuucuaucacuauauaaauaccuaacuuacaaagcagcucuaguugccauuucccccuuucuccuuaaauggaugaauguuugugauuuagcauaaaguucaugaacuaagaaaagcaguugggcacagaauccuguaucuuuccacgcaguguaucuuaauaccuuuaacugucuguuaaaauaaugcuuuuaguuuuaccuuuccauaaugaauugccaucaccaggcuuagcaaaugaaacagauuacuuaugguaaccguaaguaguuaugcacuccagauccuugacagagccuucccaaaggacaggcaaugucuuucaaaauccuauuacaagauuuuauuugcagaugcuaggaacagaaggcuagagccuccauaguuuauugcuacucaacuucaucaggucugcucacucuauugaaaacuguggcaaaaaugauauacaucagcucuuuuauuuuuuuguuaccacucugugcaaauaaaagcauauuggggaauuuaaugaagcaguauguccuuggagggagcuuuaaagauucugaguguacaacuauuugucuuuaauacuggagguuucuguguaaaacuggcaggagcaaaauaaagucuucacagaccaauguuugccacauacacacuugaaucgcacaaaugucuacgcagcggugaccuuggagauggaugcauucagugacuauuauaguggcuuuugaggugugucagggaguaguuaggacagugaaaacuacagcagagcugcuggaacugugggauuguuuuggagauggucggcuaccucaggaagugaagacugugauguucaaacaaaaaauugggggagggguugauuacucaacaaauuacccaauucaacccaaggacacauucuggacucugugcuugaugagaguacaucuuagcuugcuuuggccuucucagguauaguggcuuuucaucagaaucugggaaaaguagcagugauggaucugugcugcaaaggucuaggcacacaggaagaauagcauuccuuugcuugucaugagguauaggcuucagguuauaugggauuccuggccugccagcuuaacucuccuuacuagugaccuguaagaacacaaguauauguugauaaccuugucagaaggauacucuugauugugcguaaauuucuaagcuucaguacuuuguuaguaguuaauacuuuuauaccucccaguugaucagaaaaaaauauaagaguaugaguggugcuguaauugugaaauggcagcccaaaugguauuggaaucuauaaugguuggucucuuacuuguuugcaggcuuaacccugcccauauaccacuucucuucccugggaccagccuccgaggcugcuauuuauuguuacuuugaaugucggagaaugcaguucucuggcuuagucugggggaaugccaaaggagcauguaguccuuuagccugucagaaauuccaaguugcagcaccucuagauauaugugaccagauaguacuuaacucauuguuaguaggaaucucaccagugacaucuacaugaaaauauuauuccaguagcuuaguaaauauaacccuacacaauaagugucagaaaacaaaggaagauauuuuuccucauuucugaggcugaaaggccucuuccuaacuggagccacaaaaucuuuaguguguaaaaaaaucuugaaaugaagugagaaauggcugauuucuuuuuuuaaagcaacuuaauguccuguuugcuacuaaacauuucuggguguaauaauucuuauuuagcagucaauauuuccccaugauaacaaccaagaauuuuuagaauguuuuggggcacaaaacacauucuauuuuagacacugaaagaucauuuuaauguuugccucagaauauaagcugcaaaaguuuaugagguaauuucaacaguucucacaaacguuuccuuaauguuccccaugucuauuccugcaguaccuuuucugucucuaucuuggcaaaucucaugcuaucguaguacuugguuugucucuuucccacuuaaacuagagcucuggggcugucuuacuuguugcaucucaaguauuuuguguggugcccaguauuuauuugaagaaucaaagaaaugcuuaagaauauuuucugaagcugggucugguggcucacgccuauaauccuagcacuuugggaagccaaggcuugauccaggaguucgagaccaaccugggcaacauggugaaacccaauccauuuaaaaaaaaaauuaacagagcaugguggugugugccuguagucccagcuacucaggaggcuaaggcaggaagaucacuugagccugggagaucaaggcugcagugaaccaugauugugccacugcacuccagccugggugagugagcaagauccugucucgaaaaaaaagaauauuuucugaaaaucaagcagcuucauauaauugacucuaaccuuuuuauagcacauuuuccauuauuuuaaaaccugguguaugaaggaaagauugauagcauuagguaguacucuuauuguauuacuuauaagaauuuuuugggaagcuuuguacuucugccuuaauuaggagaaagucauacaggcaguaagcacagaguaugaaaagggagcaggaauauucagucuuugccuuuagauauuacccagaugucuucugacuuccaggguuuuggacccuaccugccucaauauuugagaccuaguaacucuuuuuguauguaaucuggaucguugauaaugcuugucugaucuuuugauaccuuccuaauccugccagccuggccuaauucugugcacuugaugcauaauugccagaccuuuucuacuuaauuggccccuggcguuggcccacccugccugccauaucacuguugaucccuccagugacggcuaauuugaccuaauuguuuauaacauaucacuuaccaaaaccucuguguuuuacuauuaucugcaaauacauuuauucaacaacuguaucuuuauuugcaauaacauggaaauuuagauuaaaacauuuuacagauuuguuuacuaaaaaaaauacacccuuacuauagcauaucaaauucaccagaaggccuuggguuuaguuauuagggcucauggugaauguggagucuaagacauaguaguacuaugacuucucuaagagauaccauggaagcuaaaaaauuagauaucuaugcuguacaaaauauaggaaggcaugugaagguguuacacauuguuccucccuaacuuuaaggauauaaauguacaaacaagagguaugugccagcuguggucugacuuagaauuguucuugaauucuccaguaguaguauuagaaauuguaauucugccuuccagauuacuaaccuuguauaugugugcaaaaaaagccuguacuguggauauuguuguaggaauauauucacacacuuauuuuuaaacauuaaaaaaccuuuuauuauggaaaaucucaaaccuucauuuuagccauuuuuggaaaucuuuuaaaucuucuuuuguaccuccaaguuugucugguaucaauuccuugugccugaagaacuuuccuuaacauuucuuacaguucaggucuauggcuaauaaauucugucacguguuuugguuugaaaaguguucaugucugagagaucuucugucagcguagaauuugggguugguaguuguuuuuuuuuucguuuuccuuucagcgauuuaaagaugucauucugugguuuucuacuuuucauaguuucuaacaagaagacuacuguaaucuuuguuuuucuguaugugaugugucuuuuuuuaccccucuggcugccuucaagaagaucuuuguaucuuuggcuuucaaggguuugaguauaauagguguaggggguguguguuuguguauuuauucugcuugggauucucugaacuucuuggaucugugcuuugauuucuuucauuauuuuuggaaaauuugcagucauuuuuuucaaauauuuccucugccucauucugucuucuucuuggauuucaauuacauguaugucauaucauuuguuauuauccuauaguucuuggaugcuuuauucugguuuuuaaauuuugagucuguguguguguguguguguguguguguguguguguguguguguuucaguuuggauaauuucuguuaaccugucuuugaguauacugauuuuuuuccuugccuguguuuaguacacuggugagccugagaaaggcauucuucaucuuuguuaccauguuuguuuguuuguuuuuaguaucccuggauccugucuuacaguuccuguuuuucugcuagaguuugaggacucagguuucagacauagauuuuccacuuguuuucuuugauuuuuguuuuccuauucuauaaauuagaaaagucaggaguauauaguaauuaacagaauuguuuuaggaaucaaaugcggucauagauaauauaaauguaugcccuugggcaagccucuucucuucucuggguuucaaucacucucacuaaaggcuuggauuauaugauuauuuugguacuauucaguuccuaaaccgcaagauccugugaaggggagagaccuaacauuuacugaaagccugguauuaaucucauguggaaucugagaaagggguaaaaucacauuuaaaaagugcuguugcaaaacaguuuacuuuugcuaggucuaugcagaauuuuaauuggaagaaacagcauuaaauccuguugccacuugguuaaaucuguuaaagaauuauuaaaaauuuucaacucuucgguuuucugacucacuugagaaacuucauggcucauaacacaucucacuugcuuucccuguaccaacaggauuuaaaauuauugaguuggcucccaaauuuuucaaugugaggagaaacuaauugagguuauugcuuuuuacuaacuaguacaaauaaaaaauagucuuauuggaauaggcuuuggagucacagacuuggggcggggagugggggggagggcgccaaagacugauugugcaggugugaaaccuuaggcugauuauuuaacuucugagccugaguuuccucaucugugaaauagagacgauaccuacaugagcuguuuugaauguagaagacauaauauuuguaaagcuuugagucuaaugucugauuaauaguaaucaauaacugauggcauuaacaauggcagcuaaaaugaaauaugccaccauuaagucaaaauuuuaguacguauaagggaaaaagaguuuaauauucuuuauauccuuuuuagugggaagguccacuugguaaaaggauauuuuaauaacagagagaggguuaacugaaaaguauugaugaauaauaauaaccaagaauugagugcaugcugugugacuggugcucacauuugcuucucaaaacagcccugugaaguaagccaccccuccuccgcuaaguguuccuuuguccaagugagggugaucacuuuuguucuuccauacuacuuaagacucugucaguauuuuuuauauguaacuccuacccucucuccacuucucauucccagugaaagaauuucuguguauuuagcacagacgugacccacagcaaguugaaucgacuuguugagauguugaaucuuuguauuuuucuggucaaaaaugaacuaucucuguauguuauagaugaaaauuuaggcauuaaugaacugaauguuggucuaagguaaaaauacuaagaaaauaguuggggauaaagaaacuacacaaccaaccugaggcuucucccuuucuucccuccccauacaugcuguuuguuaagacaaacaaauacagcauuucaaaguagcuuuugcuuuauaaacuaccauagaguaaacguaaugaauaucaaacauguguccaaauucucuguuuggaagcaguuuuacuguaauggguacuauucaagacugaaauuauuuaauacaaagaaacauucuuuauucacacugugaacaacugucuuccaaaauacagaccacaauacaggcauucuuauaugaauaauacagagaauuaugucaaauuauuuugcaguuuuuccuagucauaacaaaguuuccacaaaagugcguucuugaucauagauuuuagaguuggaaggaaccuaagagauccagacuaacuccuuccugccacccagagauaugaagcaauuuaucuaaauucauguagcuaacuaaugacagagccagggagagaaccaguccuucaucucuuacgccacaaugcuacauuccucugggaaaaaaacugccuacucauucuugguuuuuaaugcuaguuagagucuuaggguaagguuuuuuuccaugacuaacuagugcucuuuuguuuucuguguggguguuugggaacaagcuaacugguuguguuuuuuguuuuguucuguucauaacaauuauacaguguaaggcaauaacaaagcauuuguuuaacacuuuagggguuaggaagaaauuguuuuaacuccaauucuccgcccucauuguugauaggcagauauuuuaaaguuguguuuuuucaucugggguuugaauucccuaaauucuuaugaaaauuaugugaauauaugcuuacuuuuuuucuuuguuuguuuuugagauggaguugcgcucuuguugcucaggcuggagugcaauggcgcgauuuuggcuuaccacaaccuccgccucccggguucaagcgauuuuccugccucagccucccaaguagcugggauuacuggcaugcaccaccacacccguuuaacuuuguauuuuuaguagagacgggguuucuccauguuggucagacuggucucgagcucccgaccucaggugaucgcccgccucggcaacccaaagugcugggauuacaggcaugagccaccaugccuggccugugcuuacauauuaagaaaagaaucuguaguuuucaucagguuaucaaaggauacauaguucaacacuaugguuuuagagggagagagaacuaagccugguugcacucuauauauacuaauuguaccagagggcucccuuaucuccagcccccuccugcucaugcccuuuccuccugacaagacuuuuccaaauagcuuccuggaucuugucacggaagccacuggaggccugaaccuucucagaggaaccuuucccauagguuuuccaaggauaccuucuuucucccuucacugcuuacuguuuccaggagagggugugagacucgggcauuuuuguucauuagaaagcucagggggguuauuucaguuagauuuccauuaaaagggauuugugagcugacccgagauccuaagacuauugaaauaagaaaaaaaaaaaugcaguuggaauuccagucaauacuuugcaaguuaacuuuuagaaugccgcuaguucuguaguucaggauucucuguguuugaucuagaaacuaacauuuucuaggaacaagaugaaaaugcauggauuguuuaggagcugcacagaucugucuauagaaacugaauuuuuuuuugacuuagauaaaucuaccccugaauaggaaucccguuuuuguuguuguuguuguuguuguuuguuuguuuuugagauggaguuuugcucuuguugcccaggcuggagugcaguggcacgaucuuggcucacugcaaccuccgccucuugaauucaagcgguucuccugccucagccucccgaguagcuggaauuacagcccaccaccacgcccagcuaauguuuguauuuuuaguagagacgggguuucgccauguuggccaggcuggucucaaacuccugaccucaggugaucugcccgccucggccucccaaagugcugggauuacagaugugagccacugggcccggccugaauaggaauccauuuugaugggcaucuuuccuagaagagaacauauauauaaacagcacauucuaacuuuuuuuuuaaguuuagcaucuggacacacaaagaaaaagcuagcauuaagagugaaguuggaagaguguauucauuuauuuauucauuuuuaaaaagcccucacugaguacauauuaugaacccucaggcaucauguuagaugccgagaaauaagccuggucucuuccuuaugacacucacagucugcugggacacagcauaacaaauaagaaugacaauuuagccugcuaaaaacucuaauacagguaccaaaaaagcgaugaacucaguaccgggccuggccaggaagaggggugggaguagggccaguggaguuauuagcuguggggguuagcauaaacgucacagaaaaggugacaaauauuugaguugugucuuaaagguucaauagaaacuuguuuggcaaagaagggcucuagcuauagcugguguauuugugcccuucuaacuuuaacuaaacuuagcauuuaacacucucuuauuuuguauuuccaauuagagcuccaaacgagaauggaagccgcuggaggaccguagcugcacagacauaccauggcugcugcucuucauccucuucugcauugggaugguaaggaaacucucacagaugguccaaacuggacucaugauccaagggaaugacgaguaguuguuuuaaugagggcaguuguggaauauaccaguccucauacaauucagugguauuuugugucacucuugauuuguuuuucuacaugaaaacugagcucaaauuaaggagcagcugggacucauaugccauucaauagaccauuucagaaagcaaaucauuugacguaagucucugaauguugaucuugauagaguggugagcaaaacagugaccaugagucaugagcccugcauauucacccaacccagucacaccaacuuguugguuaucuuuagggcagucauuuccucucagggacuugguguuccacaguucuuccuagaugggaggcugguugcucacugcuccuuccuccuucugccuguccuaggccccugcugccuucugugucugcuguaaugaguggcaucuuucgauuggagaugaagggaccuggugguuuuccaacggccccugcugccugcugugucugcuguaaugaguggcaucuuucaauuagagaucaagggaccuggugauuuuccaguggguauagagaauggaggagcagaguugcugguauaagguauuaaggaugugcacauucaauugcauacucacucugcccuacaggaguuucugacacagacuucaguggcauuagagucccugccagugugcugggcuggaaaaaacauagaaaacugcuauuuuuaaagcggucugauauuuagaaguagaaaggacauggaaauccucaucuaguccaucgcccuuauuuuacagauuaaaaacaucaaacucagagauggaaauuacuaucccaaggccacacugcuaguucaugacagagcugagaacagagcccaggucuguucacuuccagaucaaugcuguuuucuaacaccccauuuccucuuccucaaggggacucugcagauacauuauugcucucucuuucuuagucuucuacaauucaaaaugcaauuacacuaccucaggcagccuuguuccuacucauguguauuuuuaacccccuucuuacuauaccuuuuauagaguuucuuuaugaaaaucuugcucuuugucuccucugacugcccaccaggccagcgccauuugugaaucacagaacaacugucaucuuggcuaauaggcacaauuguagguaccaguucugccucugagaaaaggaaaagaaagcaauacauuuuaaugagauacgauaaauccaguaaaauaaggaguguuuauuuuaaagauaaaagcaccguuucaccaaauuuaggauauuuaggaaaggucaaaauacucaucuccuaacuuaaugacuuaaaagauauugcucaaaaguuuacuuaguuuaauggaauggcagcugaaauauaacaugcaugaauguuuaugcagcguguggagaaaaaaaauuuuuuuuuuuuuuugagacagaauuuugcucuuguugcccaugcuggagugcauggugugaucucggcucacugcaaccuccaccucccagguucaagugauucuccuuacacagccucccaaguagcugggauuacaggcauguaccaccacgcccagcuaauuuugaauuuuuagaugggguuucaccguguuggccaggcugaucucaaacuccugaccucaggugauccacccaucucggccucccaaagugcugggauuacaggcgugagccaccgcacccugccauagaaagauucuuugauaacagaauuaguccacagccuuuccccacucccugaauguaacccugggacaaauagcagcugaccuuucaaaauuguuuacaaaaacauguaccaugccacccgaggugcuuuggauuuucugugcuaaaacaggucaggaaagugcaaucauuaauguuaauaggcugauuugggagugacuugagacuaaggaguuauuuguuuacugaaacauuuuaaugcaaugguaauuaauauaauguugauuucaguaugaugguaauuaagacccacuguguguacuuuuaaauguuggcauagcauuauuuguuuucgaaugauuccuuuaauggauuacuaccuucauggaauugagcuaacaucguauuuugccauguggaaauaagaaaucucaaaguucuauuccuuggcacaacagagauucagcauuuuuuggcuucugaguauuuguuuuaaacgauuuuuagacgauuucucucucuuuggauuucauucuauaguacuuuuaaaauaaacauuuaacaaacauuuguugggcauuaaucuaugcucaacacuuuaguacguguauauauauauaucuguauguaucuuuuaaauuuuuuucaaugaaauagguuuuauccccugcuuauagacaaaguauagcaagguuaaauauuagcuugucuaagaauauacugcuggaaauaaguggcaaagauagaauaggaacuggaacuuucuggcuauguccuuuuaaucgaguggcccagcugccugcuucucuuacagauuauuucuucuuaguaaucuugcagccugacacucaaaccauaccuuuauucucugacuuuauuugcaguuuuuugcugauuuuuugauaccuauggucuaguucuuaaauauucuaagaucuugucaucuuucacucaucucuaccauuaaaucuuauacauguucaucucuucaucaauauuuguacuucucuuuuauuucuucccuuaguuucaagguuuuucuaaugcuugaguugucuagaacuuagaguguuuuucaaagcaaguugcugucagccuucuuaaguucuaucuucuacauuugaacuuucaucacuauuuuggaauuacugggcauauacuuaacucugcuccaaagaauuacuuguaacauugcacauuuguauaaauauacaaauauaaauuuguauauuucauuaaggcaguaaacaagugguuuuuagcccuagcuguacauuggaauuagcugggaucucuucuuuuuuuucuuuucuuuuuuuuugagacagagucuugcucugucauucaggcuagagugcagggugcgaucuuggcucacugcaaccucugcuucccagguucaagcaauuuuccugccucggccuccugaguagcugagauuucaggcacccagcaccacucuugguuaauuuuugcauuuucaauagagauggaguuucaccauguuggccagguggucucgaacuccugaccucaagugaucugcaugccucggccucccaaagugcuggaauuaccggugugaaccacugugcccagccuagaauuagcugggaucuuuucuaaaaaaaaaaaaaaaaccuaauuccucaggccuaccucagggauucucauauaaucucugcaaaccugauguucagccaaaguugagacccacuauuauaggcacagauaaaccacugaaaaguauugagcaagaagugauaugaguggguuuagaaagauggcgcuggcagcuaauguuaaagauggcuuggaagguugaaagagguuucaggcagaucacucuggaggcugauguaaugguccagauaagaggugaaaaaccugaaauaaaguagugcuaaaggagaggaagagagagauugaagaauuaggauccguaacauuuaucaaugguguuaucaguguugcagacaagugagagacagaucaaggaugacuaagagguucuuguguuagggguucaggauagguuucucagcucaaaucccaccccagcuccuccuggguucucaaccacgguuucuguacacaucaggaaacaagagugggauggauaaauaaagcaccacuuuauuaguagauaccugauuaugcccaauaagguacucccugguaaaaauaacuuguggaaugaagcuugggcccaaaaggcuaaaguuccuucccaucuaggauggucugacuucauucugucucaaggagagguauuugucagaaaaggagaagaagagagaauggagaucuaccuggaugaaaucugcccagauuagcuuaccacaaaaaggcaagaagggaggaggcuggauggcccuaacaagagugcuuaccauggaaaacagaagauacagagacccccuacaacuuacuuacccuaguaguuauugcugcuuacuaugagcuagacacuguucuuagcacuugacauauagaaacucauuuaauucccacaccugcucaaggacguauacauuguuguuaucacauucccauuuuacagagaaggaaacagaggcauagagauaagcucaauaacugucuaagauuacauaguggcagcacugaacccagaagagaagagguagaaggggaggccucaagagguagaccccacucuguugccuggaauugaggacaacagaaaaaguuguucagaacauggaccuguaggaccaguaaccuugcuugccagugaaacguggucucaucaguaucucaggcucugaccaaaucgcuuggcaucaccucuuccuuuaguauguuguuaggaagcuagggugaggagcagaagcauggagaaaggagacugcagucuuccacuucauaucuugugugugccaucuaguagauaaguggugccaccaauggagauagaguauauggaggaaagggaaguguggaaugagaaaaugaguuguggacauguagaauuugugaguaaggagaagcaguuagaaaugcaaaguuggaaucuuggagaaugaucuggaauagaguuggauuuaggggacaucaucucauaguuugucccuucagacugcuuucaaggaaggaccuuuucuauuuuauauagcauugauuuacuucccagggcaugauguuucuaccucauuaacuauuguugagcgugcagaacagagugagagauucacugcaguauuuagacaccuguuugaugggcuguucuuugcugggaucacagaaauaagaacaacaacauuccaaaaauuaccauaagguuaccugauccaaaugacuugcuacuuucuauuaagucuguuuccuuucuuuauuuuaauauugugauuauuacuuauuaauguaccuaacauaguauuuaccauuuuaaccauuuuuaaguauguaguucaguuaaauucauuuguuuuuaaucugcuuuugcuuuauuuauucucagucacuguaguaaaccaaacaggugugaacuucucccugcaaguauacucuuaaaaauuguacucugugucugcuuucccuuagaaucauaauaguuuugaagaggaagggcuuuagagauucaucuaauucuauccuugugaugauaaggaaacugaggcucagggaauaaaaaguuacuugcucaugaugguaaggaguguucauggcaaagugagggucaguuuucagucuuccuugucuguguucuuuucauuguuuuagcugcccaugaaauugagccuaugauuucacucccucaugcugauuauuuucuucccucuugaggacacuucaauucuuuuaggguaaaccuugcauuuguauaugcucaauaaaugcuuauugaguaguuauucccuagacuuucuaucguuuuuuuuuuuuuuuuuuuuuuuuuuuuuuuuuuuuuuuuuucagagucaaggucucacucuauugcccaggcuggagugcaguagcaugaucauggcucacugcagucuugaacuccuggguucaagcaauccuccugcuucagccuccugaguagcugguacuacaggcaugugccaccaugucuggcuaauauuuuuauuuuuguagagacagggucucacuauguugcccaagcuggucucaaacuccuggccucaaguaauucucccaccucagccucccaaagugcuggaauuacagggaugaaccacugcuccuggccucauucuuuuuuuuuccuucuucuuuccucauucuuagagagaggcauccuauuacauuuuuuuaaaagucuggaaaucugacagauugauacaaguuuauaauuaauuuuguuuaauuuguuuacauaaauacucacucugcaucaggccuuuuauccugcccuaucugcugggucccaauagcccucuguaucuuaagguucucaaaagaggcgaaacagaaggcaaauguuccaggauuuuacaaaucaguuauuaugagcucgagcccaagcacugaugagauacgggcuuuauagagguuaagugaaggaggugguaucugagaaaaagagagucaauauauguuuucauuaauuccacaggagagggcuuuaagcagaacuccuuuuuucccuaccuuuuuauuuugaaacauuuugccauacucauacaccaucucccacccacucuauacauguuuuuguugaccauuuuuuucaaaacuaaauuuaguccuucugcuuugcucaguuacuuaguaaaagcucuauguguaaaauucaaacaugcuugugaaauaaaaguguguccuuuuuuuuuuuuuuuuuuuuuuuuacuaauagcaaauaaaacuaagcaaaagcccuuacuuagguacaacuagaccuugugauaugaagggaaaaugagcacaguucauuaaugaguaaauugucuuucuccacuuaggcaguugguacuuaugaguugccaggucaugccucugacccaccaucccuguaugccuucaucugauuuaagucaccuccuauuugugaauaaauuugucuguuccucuucucucucuuaaaauagcagugcugaaagcacuuccauagcucagucauuugaacauuuuagccgugguuuucuuccuugcuaauagucuuacuuucucucuaagauugcuuccuacuccaugcuuaugaaagccuuccuuaugcccuuaucauuugcuucauuaaugugauuuuuccuucuguugaaugccuuuucccucucucucugcugaaccauuaaauuauggaguguauucuguaaaguuucucucaccccacuuuaauuucaugugccacauuuuuuccuuucugaaacuauauugcuucccacauucggauuuuagaauuuuucuuuuuaaagagauuguauuuuuaauuauauuuggccuacuuccccauugucaaugcuuguaccgugugagaagucccuaggaugauagucaugguuuuuucccaucuuauuagcuuauuauucuccuugcccaccccccaccccuggcagcuucccacccucucuaaugcuucuggaagcuacuaagaaguuuaaguggccuaugugaaaauaugucagugucccauuuuagcauauauauguaacauuuacaauuuauaccccugccuacauccgagaggguugugagguggcuuaugaugauaaagaaaaaaacccacauguccaacaguacaguuaagaauagucagaaaaggaaaucagaaaccacuuaaagguaucuguaacacaauguacuuaucaaacauaagaagaaaauuccuauaaaaaguaaaagaagaacauaaccuuuuaauuaucuaacaacuuugcuauuuuagauuaguagugaaagaagauuguaauuguggucugaaaauauuuuuguacgguaacgaaauuacuggcauucucacuguucccccuagaaauuuuuguucuaaaauagagaaccaaagggguuuuuguuaguguccaguuacuguuguuaaccucuuuagucugacuuucccauucaaauucaccccuaacagcuaccauuuauugaucaccugccauguaccagacauucagcuagggaucggauaugcauuauuucauuuaguucucaucauuaggcugugaaauagaugguauuacucuguauuagagaugaggagggaacagagucuaaguauguaauuagaucaaaauuacacagcuaguaauuggcagagugaggguuugaauccaggucuuacugaauacgaaguccauucccuuaccauuaaucugagucuucuuguuaaaacauguguuggaggccacacgcgguggcucacgcauguaaucccagcacuuugggaggccgaggcagauggaucacuugaggucaggaguuugagaccagccuggccaauauggugaaacccugugucuacuaaagauacaaaaauuagcugcaugugguggugcaugccuguccucccagcugcucaggaggcugaugcaggagaaucgcuugaaccuggaaggcagagguugcagugagccgagaucgugccacuguguuccagccugggugacagagcuagacuccaucuuaaaaaaaaaaaaaaaaauguguuggaaagguuagcuauuaaaccuccuaauacuuaaccuccuuuuccaguuuuuacucagcacagggcuuccuaauuuggaauucaaagauaugcuuaaaaugguaugcugauucacacauguaaauaugcaaauauguaugcagaggauuaaauauuuuuuuucuaugucuuagcauuggguugaaguucugaggugggauugacugcccuguaguguccuuggaggagucaggagagggggagaggggcaacagggugagugugaaugaguaaguacugaccagcugugucuaacccugcugcuagcaguuugugcugcuuggaggcagaaggagacuaacauguauugagacuugcacuuuacauguaacauguauuauuucauguaauucucauaacagccuuugugguaagugguuuuaacuuuaacuuauagauggcaaacugaggcacagaauuaaguaaguuuguccaaggucacccaagaagaaaauggacucaucaguauuccauugaucaacacaggcuuuucugaccccaaagcccaccaucuuucccuuauagcauauucucauuucuaauaauaguaccuaacaacuauaauagcuaagacuuuauugagcucuuacuauaugccaggcagguuuuuuaccacuuuacuggauuacaucauuuaauccucacaacagccugaugagcuacaauuaucucaauuuuacagaugaguaaauugagacagaaaguugaagcuagugaguagcaaaucagggcuagucucuacucucagucuacuuuuuuacgaaguauagcuucacgaaguuucuacugacuguagcuauguucucuauucuuuccuuguagcucccuuaccugcacaaugaaaguacagggcuuauuuagaacacaguuuguuugccuuuuuggguaaguauauuuaaaggggaaauacuuuucucugaggaauugcauaugaguauaguauuuuccacuguaggccuuggaucuagcagggcuauuuacauaaguacuacucgugauacuuggcugugauuaauuaaauaaugauagucucugccuucuuagccaguuuacuaaagauaauaaaaauguaaccuuuuaacgaucagauugcaagaauaguucuuaaccucagucuuucccaccaauacaaucaauuuaucaguagugauucacuuucuguucuucuggcuaguagcuugcugucaagcguaggcuuuuauugcuuuguuuuggucagugcaugcuugacuuagcaagcaugaugugcuucugaaguaucuaccauuugccuuuaguacugugaugaagcauauucccaugaaaugaagugaccuuugcaguauacaaagccagugccuuacucuccuccagucuucaauauuaagagcauggcagugcuucacgauguaauucuuugacuuguauacagcuuuauugcaggaaggaaacagaaguauugggugcacugaagugauaaugauucaaaacccacguuccuauuguucuuugaauuuuuuucuuucauccuuugcugauguucacuuaacggaaccccuuuacaaccaaaugaaacuagagaaugagggaagcuggguuugauucuaugcucugaucuuuacuagcuuugauggccuuggauaacuuguuuaacaucucuacgccucaguuucuucaucaugaggauuagagauaacguacuacaagcaccuauuaagaguacacaaacuggcacagagcagauguucuguaaaggggagcugcuauuauuacuauuauuauuauuauaaaauucaaaguugaccuuaugauguaaagguugggauuuguuuuguuaugguaguaaauaguguuucccuauggacuucuuuguacuguuuaugugcaauccaaggaaaacaguggaauaguguuugcaguaagaaaagauagcucuuuguucccuucagcagacaaaaagaagcucauuaucguaucaacuagugacuguuggcuauugaaaugguuuauuuguauguuuuuuucuguuucuuuccuagggauuuauuuguggcuuuucaauagcaacaggugcagcagcaagacuagugucaggauacgacagcuauggaaauaucugugggcagaaaaauacaaaguuggaagcaauaccaaacaguggcauggaccacacccagcggaagugaguagacuugcugaaugaugaacacauggaaacuuugaaagaggcacagagaaaauccugcuguucuugcuguuuuaaagauaauaucuuaccaaauauuauuuuuaugugacuucuguugguguguuugauuuuuuuucacugaacccuugaaugauucuucuuauuggucuacaaauaacauucuucaggaaacagaauuagcuaccauguuaaaauggucuaccuuuacccauguuaauggguaaaggcuugauuugaaaagguuauucuuuuacucuuuuuuuuucuuuagccuuuaaguuauauacuaguuuuaacccuguaacauauuuuccucuaagauuaugcuuaaugggagacagagggaugauaauggauuuugaaauauuaacauaauagaaaauauuuuauguuguaucauuuauaaguauacaucaguuuccaacuuuauaaaagauacauuuugucagacuuuaaaauuugcuuuggguucucaauauucaucuuuuagauuucaugaaauuccugacuuaauugacuguuuucuucaaaagggcuaucauuuuguuuuuaauaccuguagggaaaauagauuucaucuagcauauuuuauguaugaugcuaauauauuuguacagacuauauauuuaugccccaugaaaccuuauuaggcauuuuaaguaucuaacuuguucuucagaauuaacaaaacuaauuuuaagguaguaggcuaacuaauccaguuaaugcacuuuauaggaaaaggcuaagcagguaucauuuuuaagguuauaggucuauuauaaagcauuuuccaggaaggugguauguaauaacuguauuuauuauuauauaaaucugucaguuaaaucugggccccuagugggaaguauaagauuaauuugauaaugucacaaaccugaagaaauccaaauaguuaauuucucagcguuauuacucccauuaaugaagauaagauaaugcaguuuaaauaaacaaaauuguaaauaacagcgaugaguguuuguauggcaucccaaagucaacuagcaugugauaccacccugugagguaggugaaacagaggcuuggaagauugaaguaauuuucccaaagucacaugucuggugggcuguagaauauccagcccagaagaugaguuuuucucuugauaugcaccuguauccauugagagaagugaaaguuggacucuuagcaauuugaagaauuguuacauuucuucuucuuuaugauugcuucaugaaacuaaugcaaauuuuagacuguauguuauuucuuguagcaagacuacgauuuuuuuauuuuuauuuugaaauaacuuuagacucauauaaguugcaaauauaguacagaguuccacaguacuauuuuuuguagauagcaucuacucuguaaaauauuauuuaacucuuuaaugcugcugacagguaucaaauauaaaauauuacaauuuagauaauugaggagauaagaggaaaagggaucugcuccgucaggucuucugcuuacaugggauuggaaucauuuuuauggcuccuuucauaacuugccaugacuccaagccuguucucaccauaaaguuuguguaaaugcuacucuucauguuuaaccuuguggugauucaucuguucaguagagcaggcugcaaauacuuggauuauucuauguaccuuucagccucuuccaagagaggcuacuuaugauucugaaaaaguggucacuauucccugaauguuuagaauagucaagagccauucauacagagggaaaauaguuucccagguguagcuguuccuuaauucauguacgcauguuuaaaauuuauuuuugauuucuacuucaucuucucuuacuguaugaccuuuuuagugcuaaccuacuuaaguauuucugucuauaaguguuuuuguaaaaaaaugaacagacuuuuuuuuacccuucucagauaagucuauaauauuucgaucugaaaacagacagaaaagcagcagucuuuguguuugucaccuucauuccauccucuucuuucuccugaaaaugcauugguuuccuuccuuuacacuuauuuccucguacuucuuugcuuccuuaugaacuguaggcccuuguguagcuauauaguauuuuuacaccuguuuugucugcuaauacuucagccuaaccuugaucacuuucuccuguuccuuacugucagccgcuaguacaguagcuggucuuacuaagaccuuuauacauauuuguugaaaaagucaacaaaucaguccucuaaaaucucaacuauagcucuuucuugacuucaugaauauuguuucuucuaucagaaaaaaaauuccucccaaucugcacauggcuaaacucuacucauccuucggcucucagcauaaaugucacuucccagagaggucuuuuuguucucauaauuuaaauccaauauucaaaaguacucucauuauauccuguaauauguguaauuauauacuuauuuuuugauuauuuguuaaauguguauucuaagugccaugagagaagaaaugagauauauuugauucgcugcuaugucucagauccuaguucacugccuagagcauaguaggcacacauuuaaaugcuuguugaauggauaaaucaauuuauuuccuuagaauauguuuuaagaaguaaauuagugagucugaggauuuguauauuuuaaaauuauuaaugcauauugcugaauggcuuuccauaaagaccguuccauuuauauucccaccaacaguguuugagauugcuuuaucuuugcuaguauuauuaguuuuuauuauuuacuaauuuuuuaagccagaaaaugguguuuuauaguuuuaauuugcaugucuuugauuauuaaugagugugaaccuuuuuuccccauguuuguuagccuuucaugaagacuguugugcuagcguaucuauucuuggucgucuuaucucuaaucugcuccauccuuuauacugugauaagauuaaguuguuuaaaauagggcucuuauguugucauuucccuccucaagagccuuuccuuuggugguguugucuauagcaucaaagaagagcccacucagcccugcccuuccaggacuccugugauguggacccguuucaccuauucagucuccucccacuguuccucagugugauguucuuauugucugggacauucaauugauucuuaccucuuugcuguuccuucuaccuuucugccagucugaauucuugaaacacuuaagaugugucucauaacuaaccucuguaugaaauguuucaaaacuaaccuuauccauagugagcuuuccuuuaauuugauuaccugaacgucccuauauuauacuuguuauucuacugccuucaguuugcacucuaauuauauuguguguuucuccucugucuguauuaauuggcaguugcuagguaacaguauuacuguaaacuuaguggcuuaaaacaagacacaucugugaucacuuucuguaggucagaaaucuggauguggcuuaccugggucuucagccacagagucucucauaaggcugcacuuaaauuguuggucagggcugggauuucaucugaggcucagugaggggagguuccccuucuaagcuccugugguuguuggcagcauacaguuccuugagggcuguuggacugagggccuuuguuccuugcuggcugccauuuuuuugaugguggggaucagggugguaguaauauauuuugaacucugauugggaauuccaaaaacauacuuuuucugucacauucuagauugucuacaaucuuuaggucuauaauauauaaguaggcuuagaguauauaugucaauuuuagauaaaaaauuauuaucauuauuauuauuauuauuggaggcagagucuuucucugucacccaggcuggagugcaauggcgugaucuugguucacugcaaccucugccuccuggguucaagugauucuccugccucagccuccugaguuagcugggaccacaggcaugcaccaccgugccuggcuaauuuuuuuuuguauuuuuaguagagacuggguuucgccauguugcccaggcuggucucgaacuccugagcucaggcaaucuguccaccucgaccucccaaagugcuaggauuacaggcgugcacgacugcgcccagccuuauuacuaauauuguuauuauugccagagaggaagcucgcugucuuccauaucaauuuggacagagcagaaaugguccuguuuaguugcaagaugccugaauuagugaguguguggacugagcugggacaaaaggucuagcuuuguuugccucuggggagaagauuggggugagggcagggauguugugcuucuaucaaagaugcucccaugugcugggugccugagaugggagaagauauggcaaaguggugguagcucuuaguaagcauaggccaucauuguaaaacugggugacaguaaguaaggaacugcucuuaaucuuuuugacauaaguauuaagucauuauuagaacuuuucccucauucuucaaacaguccuaacacagagcuuagugucuacuuucuuuguuacuccaagaaguuuucccaguguaucucacacaucaguaucaauuauuccauagagguuuuaaacauauauuuuugcacaaaucuaauuuucuuuuuuaucuucuugucuuucuuccaaggaaggcauuuaaagucccagucacugauaaagucuccauugcccuaaaaugccucuccaaugucagauaaucuguauuaacagguuguaaagaacuagaggucugcggaggaugauagcaucuauguaugaguaaaaucuauagggggugcauuuuauuugagcucuuuucaauuuccugcauaaucuuuaccagauuaccuaguaaaaacagaaucagagugugaguuuuacuucuuucucuuaauuguucucauuggcaagauacucaaaguuuaaaauguaugugcuaaaacaauccuugagaucauauuacaggugaagaaacugagucuaggaaacaugagugacuugauggagacagaccagcacucaauucucacccucagucggugcucuucgcaucauacacuaaaauagaucuggugagcuguaugguaauuccaguuucccaccuuuuuugcuuugggaguuucucccuccuaacguuuaaagaugaaagaaauuuuuaggggaacuugacgaguccccauucacauuaaaaaaacuuugaaaggcaccaaagcccuuauacaaucuaggaaggcuuugaguaauuugaaggcaauuuugucuauuucuuucucugucaaauaaagaauaugaauugugaugaugaacugcguuuuuuuguuuguuuuuuuuuuuuuuuuaccauuuguauguuuucaauauuuacugaaaaauacuuagcuucaaauugauaguaggguuuuuuuaaguaagauaauugauuguuuaauaaacaguggucuuauuuuaaggaaacuccauauuugcaauaucuacacauauacagaauaggacuuuaguggccacugaucaccuucuuuaaagucauaguccuguaucuuuagugucucugguucagucuaccccgugaucacauauuaacuuaugcagaggauuauuuaggggauuguaccaauaugaaaacugugcucacacuuuaaaugauugccaaacuuucugggccuauacuauaccacauaaccaucuauuuuagggagaauauuauucuuuaauuagcauguaaaacaugccucuuuugaagacuuuuuaaagaguuacugaaucuuaucgacugugcauaccuguuccuguuugaaaaagaacuagaaaaauauagauaaaauaugcuaaaauauuugcauggaagauccucuuaucagcuaagcacuuguacaguguuucauuaugugacuaggacuucucuuccucgugaugacuuaaaucauauugcuguuuacugagugacuauccuucaccuuuuuugaaaauuauguuuauuauuuuauuuagcccucagcaaauauuuauggaaaaucagcuguguccuacagaccacuauuacgaauacuaaaauaacaagcgaccuaagugguugaaaaaagcguuugguuaaauucauucauucauucauuugugaacucuguuuccuggccaucuucuuugaguuaggcacuugagauuauagucuugagcaaaauaaacauacuuuuuuuuuuaucucaugggaauuacaguuuuguggagacaacaauaaaaucaucauacaaucacaaauuauuauagcuauaggaagcguuuugaagagagagguguaaggguaugagagguuauaaugggaaggccaugagaaagguuacaaugggagguccuggcccggucuuagauacuguggagucaguaaaaaugaugcuguagaaguauguccauagcaugcaauauaugcauaacauuauuaagggaaaaaugaauugcaaaccaguauguacagcaugauuuuauuuauaaauguaaaaauauacauguacauagaaaaguauagaaugacaugaaaaugucaacagugugauuagcuguugaauuauggaugguuuuaauuuuauacuuaucucuuuuuuccuaaguuuucuauaaucgauauauacauuacuuggguaauggaaaaaaaggauaaaaagacaucuguagucccugugcuugaagaccuugcauucuaguggggaagacaaaauacauagagaaauuaugacaguucagugaugaaaugucauguaaaaguguugucuauugaaagcugagugacuccacuuuccugaguuccuaacagcaggcugguggggagaggaaaagaaggcaauuuggugauaguacuggaaccaccauuguauuacuuuccuaauguugcuguaacaaauuaccauaaaguaagaagcuuuaaacaaugaaguucuguaaaucggaaacugaagcaaauucauugcuuuuaacaacgaaguucuguaaaucagaagucugugcacagcauggcuuagcugguugcuguggguuuugaaggcugaaaucaaaguguugacagggcugugauuuuuuucuugagguucuagggaaugaauccucuuccaagcucauugaggcuauugacagaauucaguuucacauggcuguaggacugaguuccuaucuccuugcuggcuauaaacugagagucaguuucagcuucuggagguaacauauauucuauagcauauauucuauggcucaugacucccauccuccagcaaaauugggucagauucucagucuugaaucucucugaccuccccuuagggcagcaucuugguugcagguuguacauaugaguugaagacucucagccagugacaggguuucagggacaggguaauuuuaggcagaguuuuggagccucauuuagguauaaagaugcuaacuaaauuuucagaagguaaguuuauggagaugucuuugaaaauauuuuuugucauauuuuggggguucaaggcagggcuugcauuuuaucaggguaaagucaaguaaagucggcuguggaaggaugguacacauaauggugauuggacgaagaggugacuagaugguuaugaggguuuggggacugagagguggcuccaggagcccaucuucuagugaagauggaauucugauuagaauaccaagcuugguucucacugucugaggaauagugugguugagucuacagguuggaauucuuguuggccauccuaaagcccagagaagacuggcacacacaggaaggugcuccugacucuaucuuguacuccugacucuaucuuguggaguuguagaagcucagaagaagagagguauacauuuguccauuggacuaauucuuaaguuuuacagaguauucucccuaccuguugucaagguauuccucagagcagcccaguagaucaccuacuucuucccacacuuagggauacguuuaaacaaauggagaugcucuaagccuuugaugaauuuggcuuugcuuugagggaaagcacuccucucucugucuccugucaguacucucugauucuaacucuaaccuacugucacucccacuuuagcauaaaguggaaaagagcagccuagauagauaccucacauaaacuuguauuugagaacuuauuuccucccaaauuuacaagcauuuggaaauaguaacaucugugacguucuaaaugaaaacuuauuguauuauuuauacagguuuuuuuguuuguuuguuuuuugagauggagucucgcccugucacccaggcuggagugcaaugggcaagaucucagcucacugcaaccuccgccucccgaguucaauagauucuccugccuuagccucccaaguagcugggaucacaagcaccugccaccacacccagcuaauuuuuguauuuuuaguagagauggaguuucaccauguuggccaggccagucuugaacuccugaccucaauguuccccccaccucagccucccaaagugcugggauuauaggcgugagccacuacacccggccuauacaguuuuuuuccuaaacuuucauucccucucauggaaaauauuagaaguuguaaagacgcuaacuaaauuuucagaagguaaauuuauggagauuuuuuugucauauuuugugaccauacuacucuuaagccuaaauuuuuaaacucuuuacaaagguaacaucuguauugcuagugcauuucugccuuuaggauaauacuugcuguggaaaauacugcgagcaauuugaaagaggagauccagcuacguaccuuagaaaaugcgggaguucaaagucaaaauguuuugccaauucuaaauagggaagugaaaaccuguuuaacagaauuagaugacauguaugcagcuaggcggcaaggaagggaugauugguuuuucuccguguuguuugacuagguguauauguuugccaugucuaaguuaaacagcugguacaaaugcucaaucugaagucucacuacuugaguugguucuagguuaccugacaccugugaagauuuuuacaagcuuuagucauuguucaugagcugauagacaaugaccuuuguaauauacuucagguaauuauuaacugcuucaacuaugaguuugauggcaaucaaguggguuugccacccacuuguguuuaccugggugucagaguugagggcaucuaagaaguuagagggcacacaguccacacacaaccacccuuauaucugaccccaauugcaagaucagggguccauaaaaccaccuauuuccuggcaaauuauuugccaggaagacuugcagaacucacugaacgcuacuguacucaugguuaugguuuauuuuuaggaaaggauauagaguaaaaucagccaacaaaaggagugcauggggcagagcuuccauuguugucucccuuggggagaguggaguacacggaguccgagcacaguacuuucucagugucagugugugacaauacacagaguauggcuaaccaaagaagcucaccuaagccucaguguucauaauuuuuguugggacuccauuauauggcugacucaggcuccagucuccagcuccucuggucaauuugauaccaugugaucccaaacucuuaaucuaaacaacauuguuggucuuucuaggguggucgacgcccacccuaaauaguauguggaguggucuaccccaacccuaaaacacauuguuagacuucugugacccaagagcaccaaguaaacaaagacacuccuauaaggcuuagaaauuaacucccagaagugaagggcaaaguccagaucucuuucugaguaagguuaaauucuuacuacacacuggggcucauuaaauuaaauuggauuuuguaaagucgauuuucaggaagaaauuuaaaaauauuucauuguuauaguuuuguugaguuauaacuuacauauaguaaaauuuacucauucaaguguaguuugaauuugguaacuauaugcagucaugcauccuccaucacaauccauacuucuuuugcucuuagaaaauuaccuugugccccuuuguagucaguccuugcccccauucuugucccuagacaaccacugaucugcuuuucguaguauaguuuuguuuuuucuagaaugucauauacaaauaauuauauauuauguaguauuuugugucuaccuuuuaaaacauauaauaaugcuacugagauucaugcauguuguuaaauacaucagugguuaguuccuuuuaaauuacugagaaauauuccauuguguggcuauaacacaguuuaucuguucacuagguuuuuugccauuuggguuauuucaauauuuaacuuuuuuuuuuuuuuuuuuuuuacuauugugaguaauacugcuuuaacaauuuguguauguaauuuaauauauuucauuacucuugaagaguuagauauauagcauugagauugcagagucauguggugaggauguuuaacuuuauaagaaauuaucaagcuguuucccaaagugguugcugcacuauuuugcauucccacuacaauaguaggaggguuauauuugcuucacuuccuccuaacauuuuguauuaugagacuuuuuguuauuuguuacauuuuauuuuauuuuauuuuuuuuagagauaggaucucacuauguugcacaguuuggagugccauggcuauuuauuggcaugauuauagcacgcuacagccucgaauuccuggccuuaagugacccugaggcucccauauagcugggacuauagguacagucccaugcaugucaccaugcaugucucuguucuuuuuauucuuagccauucuagugaaucuguagugguaucucacugugguuuuaauuugcauguuucuaaugaccgaugauguugaccaucuuuuuaagugcugguugaccauccaucuguuuucuuuugugaaguauucauaucuugcauauuuuaaaacaaacugguuagucuuaaugaguuaugagcacuaaaucuguauacaagaccuuuguuagguaaguguuuugcaauuauuuuuucuaaucuuugguuugcuuuuuguuuucuuagugacaucuuuugaugagcaaaaguuuuacauuuugauaaaguugaauuuguuuguuuuuauuaauggcucauguuuuuuguguacuaucugggaaauuacugccuuaccccaaauucacaaugauuuuuuuuugugcuuucuacugaaaguuuuuuaguuagcgcuuauguugauauauaugauucauuuugauuuaauuuuugauuauggugugaagaaaaggucaagguuuaucuuuuuucucccauacaaaaauacaguuauuccagaagcauuuauugaaaagacuaucuuccccauugaauuacuuugccaccuuugucaaaaauagauuuuguuauagguuugauggcaugaaaggaggcugauggaguuucuaguaauagcagcuaccaguauuauggagaaauagaaauaguuuaccucaaauuaaauaagcaaggacaucaucuuuuuaauagcacuauuuuaaauaacuaguugcagcaaaucauaauaaaagagauaacuagaauauguauagguaguuagaaagaaaaauaauacuauuugccagugacaagggacuauaaccuggaauguuuaggagauucaacaaaaacguaucuugaaaugaggcgcuuaaauuauagguuauaaagcagaugccuaacuaaagucagucguuugucuuaucagugcacagaaaauacaaugaaaaauauaauacuuguuuuauuaaaauaaaaucuaacaggauauaugugggaccaaauacagagaguuauaguauuuuaauuaaaaaaaaaaaacaagagagauauaaucuacuucugguugaguagucuuaauauaguaaagaugacaauacuaacaaaguuauuauauagauuuaauaaagugccaguuaagaucccaguaggaugugcauugaacuugauugauaguauaaaucacagaguaaaggaucagggaagaauuucagaggagaaauguuuuuaaauuguuucucauucacaaaauaauuugaaaggauuagaaguaggugcauauauuguaagacaaugaaaugggaauaaaaaagaucaggaggcacaccguggaaguggagaagagaugagaccagaaaucuaggcuaaguguaguuacugacauaaagcacuaaauuagcugugaacuuucugguuuugaaggcaggaagggaaacauauggguuucaccauggguuggauauaagacaacagggaauauuggacacuuuggacuuuacgugugugugccccauguaaaggagauagcugcuaauuggggugaguuuuggcauauggguagauggggccagugaugcuaaguuuucaaaagaagccggaagucuguuaaugaguagaagaguguaucagucuuaugauuuuuaaauguuggcaguuagcauacuagccaaauaaaaggugggagugaaggguuacucauugugugaguacaggucguguaucuaugguugucauuaucuaauuaauaauugugucacuuagaggagaaugaaagggguauugccauucuaggccgaaaccuguuccaaaggacaacaacaagacuaccuggacauagguuaagaacagugauuggaacaaaauagaaacagcagaaauaaauacugugaaaguagucaguguuuaacaaaaaauauuggguugagugauacugugaagaaagcuacauuuagaucuacuuuaaucucauaccaugcaaaauaaguuccacauggguuaaauauuuuaaaaucaauguucuacuuuguauaauugaaugaauauuauacuuuaaugguuguuauauuuuguauaauuucaauauuauaaaugaauauuauacuuuguauaauuucaauaauugauacauuguugaggcaauaaagaaauuaaauaaggcugggcgcaguggcucaugucuguaaucccagcacuuugggaggucaaggcgggcggguuacuugaggucaggaguuugagaccagccuggccaacaccccgucuauuaaaaaaaaaaaaauacaccaccaggcgugguggcgggcaccuguaaucccagccacuuggaaggcugagacaggagaauugcuugaacccaggaggcagagguugcagugagccgagaucaugccauugcacuacagccugggcaacagagugaaacuccaucucaaaaaaaaaaaaaaaaaaaagaaagaaauuaaauaauaccaagguaggcauguuugauuaucaaaaauuugauucucugauauaaaagcaauacaaugggaacaacauuuagaguuuuucuaugauagguaagauuuuucaugcaacuggggauguaucuguacgaguagauccaguaggcagauaaucaaaggacagguuacacuguugaaaauaacaacaguaauguuuggccuaaagaucuucauuuguaaaaugaaaauaauagcaguacuuccuuggguguuuuagaggaguaaagaucauaaaucauguauacuccuuagcacagugccugguaucgugaacguuaacuguuguuuauuauaaucaucuucauuaucaucaucuaaaacaagcuucaaaguuacuuaaucaaggcuucgucccuuuuuaaccuagauggggaaaacacagcuauuuuaaccaacuguuaaauuuauguaguuuacaaagcacucucacauauucugucucauugauucucacuaucccugggaacugcuuaaauuuuuucucaggggaggcuuucaggguuccguuuuucauagacacagcuuggucuuugucaucacccuuaauuguucuaccuauaaaaucaauucagaguaauucuaaacuuuccccacucucaccauggucuucuguccuuccaucuugcauugcauguccuuuuuugcccacugcagccauucuucgaccucuaguccuuugacuccuguacuuucucccaagugcuuuuuguuuuuguuuuuguuuuuguuuuugacggagucuugcucugucgcccaggcuggagugcaguggugcgaucuaggcucacugcaagcuccaccucccggauucacgccauucuccugccucagccucccgaguagcugggacuacaggcgcccgccaccacgcccggcuaauuuuuuguauguguuagccaggauggucucgaucuccugaccucgugaucaggauuacaggcgugauucaccgugcccggaauuuuuuuuuuuuuuuuuaaagacagaguuucacucuguggucuaggugggagugcaguggggugaucucggcucacugcaaccuccaccuccuggguucaagugauucuccugccuuagccuccugaguaucugggauuacaguugugugccaccacaccuggccaauuuuuguauuuuuuuuguagagaugggguuucacuguguuggccaggcuggucucaaacuccuggccucaagcaauccaccugccucggccucccaaagugcugggauugcaggcaugagccaccacgccuggccuccaagugcuguuuuuacucuacugucauccuugcuuuuuguuguaauauaauuuuuucauaauguugugacaauaucuagugaauaucugugccuuacucugucuuacucagagaucugaaagaaaucugugauaggcaaaggauuccgagggacauuucuccaaaacagcuaugugaaugucuaacaggcacaugaaaagauagccaacaucauuagcuaucaagaaaugcaaaucaaaacaacaauaaguuacuauuucacauccacuagaauaauuauaauaaaaaggcaguuacagauguuggugagaauguggagaaauuggagcccucauacguugcugcugggaauguaaaauaugauagcugcucuuguaaacaaucugacaguccaucaaaauaucaaacauagaguuaccauaugauccagcaauuccacuccuucguaucuacccaagagaacuaaaaacagauguccccacaaagacuuguacaugaacauucauagcagcugcagcaucuaauagccaaaaacagaaaacagcacaaauguacaucaacugaugacaggauaaacaaaaugugguauauccacacaaugaaaaguuauucagccauuaaaaggaaugaagugcuuauauaugccauggcauggaugaaccuugaaaguguuacacuacauaaaagaagccagccacauaugguacaauucucuuuauaugaaauguauagaauagacaaauguauagagacauaagguagauuaguaguugccuagggcuggggaguaguuggacauggaaggaugauguauucacucguuuucuguugccuacagcagaauaccugcaacuggguaauuuauaaagaaaaaggaauguauuucuuauaauuauggagguugagaaguccaagauggagguucuacaucucaugagagccuuuugcugguggggacucugugcagaguccugagauagcucaggguaucacaugaugaggggucgagugugcugauaugcuagcucacaucucucuucuuacaaagccaccaauuccccucccaugauaauucauuaauccauuaacaagggaggaacucucauaauccaaucaccucuuaaaggcaccaccucucaauacugccacacuggggauuaaauuucaacaugaguuuuggaggggacaaauauuuauaccauaacagaugaggaguaauucuaauggauaggagguuucuuuugggggugacaaaagguucuaaaauuagauuguaguaaugagaugaacaacuccgucaaauauacuuaaaacauugaauugcacaguuuacacaggugaauuuuaugguauguuaauuauauuucagaaaagcugauaaacuaaaaagaaaaugaaauuucuggccauuggcccaugacacauauuauuucucaguaugagugcugaaacaaguugauuuaggaguguucuuucaauuuauuggacuaaguagaaaauuguuuuuuuaugugaaauguucuuuuuuaagagaccaggcaggucuugcuuugucaccuagguuggagugcagugguaccaccuugguucacugcagccucaaccucuugggcuugaguaauccucccagcucagccucccaagcagcugggacuacaggcgugugucaccacaucuggcuaauuuuuguauuuuuuguagggauggggucuggcuguguugcccaggcuagucucaaauuccuggccucaagugauccuccugcccuugucucccaaaguacugggauuacagacaagagcuaaugcacccagcuaaaguuguuuuaauuuacuuucuugccucaguuuauuauaaguaauaucauuugcuauaagugacucuugguugccauucugacaauuaugucucccuccaugguacauggauaagcaggagacaggcauuguagcuaaagaggggagucuucccccgugcuuuuccaguuccaugccuuugcuuugcaauguuaguaucuucuuuggcucuuucgucaucuugcuuuuuacucuuacgaggccuuugacaaucuauucgaaacuaugaaguauaaaaucugucuucagaaaaauacauauggauuugcacaucagauuuugcuuaugauuucuggaggcucacagauuucacccagguuaagaaucuuaacccuacacacugacuuuggugaucucaugcacucccaggggaaagcuaccauuuauauaugccgauuauuccaaaaucacugucgccuguccagauuucucugcuagaauccuacagccaacuguauagguccauuuggacacuucauaggugucuccaacuuaaauucucugcaguuggaacgucauccuuguccuucgguacucugcuccuccuccugaguccccuaucuuacagaauugagcaggauuccaaaccagaauguccuaaccguuuagucugagaugcuaagcauuauguuuaauuuuuuuccuuuccaccuauguauaaucagucauaaaguuuucuucauugugucuaaacuuuugaaaucuccuuuuuauucacauucccacccuaguucaagucaucauuucuugguagaaauuuaguagccuccuggccagucucuuuucucuugcuugccucugacucauucugcaccuugcagcuggugagcucccaguggcuucccagugucuuuaagaugaacuccagacuuucuaacaucuuuuuuuuugagacugagucucacucugucacccaggcuggaguacaguggugcaaucucaacucacugcaaccuccacuucccagguucaagcaauucuccugccucagccucccaaguagcugggauuacaggcgcacaccaccacaccuggcuaauuucuguauuuuuaguagagacaggguuucaccauguuggccaggcuggucuugaacuccugaccucaagugaucugcccaccucggccucccaaagugcugggauuuacaggcguaccauuuauaaggcccugcaugaucuagcaucagcuugccuguccagccgucuaugaaccauccugaccauuuucuuguuuucagcugugccaugcucccuuuaaccuuuuugccuuugccugcucuguuccugcgcuguuccuacccccuuucauccacacugguuaacucuuacucauucuuuaggucccagcuuuagauaucccuuccucaggacaccuauccugauuuuccauuaaugggguacguuugaugccuccucuauaauccuguuuucccugcucuagcacuagcacacuguuuguaauugucuucuuacucucuggauugugaacacuaagaagggagacacuuaguuguguggucuuauuuaucaucguaucuuuaguacuuauuuaggccuacaccuggcagaauagguguuugauaaaauucuuuugaauaaacgagaguauuucucuguuccugaaauaucuucuuccuuaccuucacuccccucuggccccacuuagcaaaaucuuauauaauuaccaucuguuuauuaauuugggaaauaugcagcuucuucuuuauuccaggcaucauuuuaggcacuaaggauguagggaugaauuaagcagucaaauaucucugcccuguuggagcugauauucuacuagugguggugguggaaaauaaacagauaaauaaguaaaauacacagugugugaacgaguguaagucugaggagaaacaaagcaggaaagaugaaggcacaucagaguggaaaguuggcguuuuagacaggcuggccagcaaaggcuucacugagaagaugucuuuugagugaagacuucaaaggagggaaggagcuagcucuguugcucucuagaaaaagaacauuccaggcagauaggcagugcagcagccccacggugagagugugccagguugcuugaggaacagaaaggagaccagugggagaccaggcgaaggugagguuagagaggugcacauucucugaguauugcugucuuagucugauccuugggcuuccucugcaguuuaaaguuauuuucagcucucagugcugugaauuaccagaaagggccaugaaaguuucucuucuuagcaguugccuguaaaugaaggucuacagaagugcuggcggaggaggcugccaugcuguuuagaauucaauugucucuuuggggguuggugagauggauccuuagguuuuaguuuuaacaaauggcaccucuuccuuaggagauuuuugccucuuccuaguuaggauugaggaagcaguggggaaaggcacaccccugucagcaaccucauggguuggguuucuuggguuucaccaacucuggugugcuggccccauaguucuuuccuaguauaacagggcucuccugggggcauuugggucccaccccagauuagaugacuggacuugccuugcugguaccccaacaccagccccucuggaaauaagaggccuccucugggcagaauuccgcuguggguggaguacagaucugcggggcucucuguagccuauguuuagcaauagcaagccuccgcuaggcugucaugguuuucaguuugguaugauucacucacggcaacacucucuguggaaaggggcuauaaauuguaaauugauaugagguaauaauugggaaaaugaucagacuccauuuuuauuccccucuggggaagacacauaucaggaaucacuaaagcagaaggugacagagggauuuuucagccugcuuuccagcuuuagugcugcagugcuuccauccugauuggagaggagagcagccaaauucggcaggaggcagccaaauucggcaggaggcggccagcagaucuaguaucugcuugccaccuuuugcuccaaaaagucuugucacagaguugccauggcagcaggaggcaauuuaauggcaaaggcucaucucuggaucagcgcugcuguuccccagccauucccucucuagccuucaauucgaggggcuggccauaccaggguaucacuguuccguggccauuugaguacguguugccuaauggaagagcuguaagaucuuccagauucuaaggacggcuacauuuucuauccccugcuucuccuuggugcauagcucuuugauaccccauccuauagucgacuuuaucagauuauuugcaguuccuuaaauaugcucuuucaugauucugugcuuuuagacaugcaguuuucucugccuagagugcucccuuccccaucugucuggaaaauuccuacucaauuucaaaauauggcuuagauacugccuccuccuccuuaaugguuucucuaaccccuuauccuccaugcagaauuacacaauuuccacugacaucucagccuugccuccuaucacaugguuuuuaaaugacuguauauauuuuuguguguucuucucuagacuguaacuuacuugcauucaagaacuauauuuuaugaauuugguauccaaagggucuggcccaggaguauacaccuaguaauguuuguuauaaaugaaguuuuucuuauccuauuuaauuccugucacgugaguguugcauaccacauagaguacagcccuauaucauguacagguagggcuuugucugucagggaucccagaagauuagggaucuccagggaucccagaagauugcacugauuuaaucaacugacuugcuggucuguaacucacuuuccuuugcauuuauucucacuuuacaguuugaacuggaaaguuagguuagucacccagcuugccagucaguuccaucauuuguugaauuaggauguugugaggcuaaagccuguaaugcuuugugacucaaaguaaauuauuggugaaucuuauuuucuuuaccuucuccuaucuucaguaaagaaaguaaaagcaaaacagaaguuuaaaccaguuuuaaaccuucuauggcaucauaucauucauuuuaaucuugcucugagugcagcuuuaaaagucacuucuuuucugacucuuauccuuuuuccugaguuucagugauauaaugucccaccuuugucucguuucccuguuuucaucuuuggugcaucuguccuccucguucaccuuguagacagagcauuuuauucagacaucucuccuuuuccugccuguugggauaauuuguuauuguaucucaaaaauauccauuuaaaaauaaaccuuuuccucuuccucagauaauuucuggaaaccaccccaacuguaauaaauacacauuuacaugccuuaccagcuguccucuguaauguuugcuuugcaguuuggucugagcauuuuucuccauucccaucuaccuuuuaaguucaaagcuuacuuaggcuguuuugcaauucccuuugcaaaugcauuucuguaucaucugaucaugcuaugugcauauuguauaugccaaugccugcaggugucuaggcuguuuuguuuauagaguauuuuucuguuacugcuucuugucuuucauucucacuuuugguauuuuauuuauuccuguuccucuaaaggauaugaaacuuaaagcuguauuuaaguuauuaauaagcuuaguaaaagauucacugaggauaacaacgacaaacuugcucuuaacuuagguuuauggauuaucugugacaugggcucuccaccuuggagauggcauagggaagggggagguauggaggccaaggcacauaaucagaguuggccugagaagcuuuuucaaaauguaugugcugcaucucuuuccugauccuugcccuguugggagugaaaguagguggauacugcguguuacccucucagcugaaauacucaucuguaguuuucaguuacaauaaucugguuugucaauaccaugcuuauuacgauuauuuguuucauugucuaaaaauaaaacuaucaguucauuuuguuuaaagugaaaacugaaaaacuaauguaagcauuuauuuaccugguuaaggacauuuuccaaucaaaaggcaagaaagugcaguuuuaauaaaucauaaauugguuugauacaagcacuuggccuccuauaaauauucaguuaaauaugaauuaguuaaaguauaauuacuuuuaagcauguugccauggauuggaugaacuucagaaugcuggaaacagaauauucaaaguuaauagagaacaguuaaauuuacuaaugauauuuguaggaaauauuuuggaauagugcagaauggaaacagugaaacucagaaucagagguacuauguuugaauucaugcuuuggcaccuacuagcucucuugggccuggugguuaggccucaaggccucaguuuuaacaucuuuggaauaguuauggccccuaccucacagaguuguugcaaagaucaaauaaguucuugaaugugacagugacuaacaccuacacacccaacaaauguuaauagaaucugaaccuaaggucaaggucuguauguuauuuuuaacuucaugugugugcauuugaauaugugaaaggcauagagaauuaagcuuaauaucuuuucuuuuccuucuuuguuucuuuuuuuuuuuuuuuuuuugagacacagucucgcucuguugcccaggcuggagugcgguggugcgaccucggcucacugcaaucuccgccuccuggguucaagcgauucuccugccucagccucccaaguagcuggaauuacaggugccugccaccacacucagcuaauuuuuguguuuuugguagagaugggguuucaccauguuguccaggcuugucuccaacuccugaccuuaagcgaucugcccaccuuggccucccaaagugcuggguuuacaggcuugagccacugcaccuggccagcuuaauauauucuuagacuauggaaggcagguaagauacagaguguaaacaugugauguaugugaguguguauuucuugaagauguguauuucuuauucaaauaaguuuuuagaucuuuucaaaccauauacacaggcugaaaaaugugcaguguuaauuucacaguguuguagucaugguagcauucuucucacccuccuguucuuguuuucuuugugcuggaucuguuuugggggccuacuugguucucaaggguaaugaccuuacccuuagucaugaauacuccuacacagauuuuuuuuuccuaaaugaaaaccgaauguuaguauuguaucccuguuuuaugcccauauaagaaaggguugaguuuaguuccuuacuaugaaauguaagauguauggaaagcaaauaguauucuuaaugguaaugacacgaaucacugagugcauacuauguuaggugcuuuauauauauuauugaucacauuacaacaaacuauaaaaucggugauauguaauuuuucagauaaggaaacugaggcucagaaggauaaauauauuuuccaaggucagagaacuauuaagagagaaccagaaagcaaguucacauuggucugacuaaagcaagggauaagguugcugcccagucacuagcauaaaucaaaggaauauguuuuaagguauaaaagaaguuagaaauauaauagggauacuuuugcccuuggaggaggcugaagccuacaggacagacaguguaucuauucucaagagguugucauugauccagccuaggcccagcagcaaggcccuggcagcuucuggcuuuuuuuuccuuuucccuaagcuucuuuuucuacugugaugugauuuccccagaugguucucaaggcauugcucaucacuuagaacuguguacucaaugccucucucccaucccaguuccacugcccaccucccaccccauagagaaacacacaacagaauuacugugagaguuaaaugaguuaauacauguaaaguguuuaauacggugucugauaaauaguaaguacucaauaaaauuggcuaucauuuuuaaaagucuuuaucauuaaguauuauuaggccaggcacaguggcuuaucauaccuguaaucccagcacuuugggaggccaaggcggguggaucaccugaggucaggaguucaagaccagccuggccaacauggugaaaccccguuucuacuaaaaauacaaaaauuagccgggugugguaguaggugccuguaauuccagcuacucaggaggcugaggcaggagaaucguuugaaccucaaaggcugagguugcagucagcugagaccaugccauugcacuccagccugugcaacagggcagaacuccaucucaaaaaaaaaaaaagaaguauucuuaguagugauggugguggugauggcaaugguagcagugauagugguggugguggugguagcaguagugguugauucaaagguuuugugacacauuucucaaggaccugauuguucccuguccagaaucugucuuugugcaauucauuauacagggucaaaggcauagacaugcuuagucagacgcccaggauagaagaagggagaauuaguaagagaaugcuuguuucuacucagaaguugccagaaacaauucucuguaugcccugcuuccuuguuaucagccauggaaacaguccacaaaaccuacuucuaaaccucaucuuucugccuggcuuuuuuucuuuccuucuaucugcauagauagaacauuaauggguuuggagucacugauagggucacacacacauuuuuuuuuuuuuuucguuugguaaguuauaccugaccuucaugccggguucccaguccccuugcugcgcugaagugugcaguguuacuugaucugcaaaggccucuguaguagcccccuuuuuuuuccuacuuauuuuuuuuuccuuuauaguuuccauuuuagcauauguauugacuuuaccuuuucugcuuuucaguuuguucuccuaauuuuuauauuagguuauauuuccuguuccagauuugaaaccacauuuugcauagcaacagaguuuaacugugugaaaggcuauugacagaugcaugauuuuauaaaacuuccuauggacucaguggaauugaacccuggcuggagauucauuuuagguggaagcauuccuucuuguacucccuuccuugauccguguuauugcacuuagcuuaucucaauugagaauguuuagcccuuacuuucucuuugagcaaauguuagcaucuacaaucuuuaucaucucaucuacuuuauaacauuaaaaauacaugcuuuggcgugcuuucuaauuaaucuucccuuuucuaaaauacaaguauacaggauguaaaggguauaauuucagauuuggggauuauuuuaucuaucuguaauggacaguauuuaaacuauuaauaaacaauauuuacugccguuauaucaguucaaaaguaauuggcauucuuucuaaagaugcggauucugaaagguaaaauaaauuaaaaaucacuuuauuuuaacacccagcgaugacuguaguugaaauguugguguauuucccucugguccccauuuaacuuuguauauucaguuguauauauucauugauaucuauaauauauauucauuuuuggaauuauauaauucuguucauaugaauuauauauaaugaaugaauuacauuuauuaacuaaaguuuacaguuuauauauaaacuguuauucaugcuguauuauauagcaguauuaugauauuccaauaauuuuuuuugguacaaguuugacaaaauaagaaaaaauuaaugauuugaagaaaacuaaaauagaugauuucugauuaugaaauaugcaugugcacaauacaaacauuuaaauauuagaaaaauagaucaugaaaauuauaaguccuacaauuccccuauucccacuguuagucuguuaauaagcaauuuuuuuaaaauguauuuaugaugagauuuuuaucguggaggaauguggaauagauguucuuugcucuaggcuuagucaaauaugcagggacccacaauguguuuugugaaguaauaucucaguuuuuuucuccaugcuuuagguauguauucuuuuuggauccaugcaaccuggacuugauaaaccggaagauuaagucuguagcacuguguguagcagcguguccaaggcaagaacugaaaacucugagugauguucagaaguuugcagagauaaauggugagacauuaggccauccaaaucuauguccugucaccuuguucucuuuguuaaauauaaauuugcccuaguguuaaauaaauuaucaaggaaccuuagauaauugaaguaauuuuggacuuccuugcuaaaaaauauuauagucacccagggagcuuguuaaacuccagauuccugggccccucccugggcaaaauucugacugagugggucuuugugcucuggaaguuaguauuuuuaaaauaaauaucucaggugacuuugauguagucuaucgaguauuuggaaauuacuaaaccacucuauguaaaauuuauuucuuguucccccuucccaaguauugguuaaaaguauuucaauucacauauauaaaaauugaaauaaguuuuauauguugaaacaauauauauacauacauaugugugugugugugcauguguguguguguguguguguguguguguaucucccugguuagcaauguaacauaugcauauuauaggaaauuuggaaaguucagaaaaaauaagaaguagaaauuuaaauucuagcaucaguacuuuuucaaugagucgguguguauauaguuuuguguucugcuuuuuaaauuuaacguucugucauagcucuuuuucugauaauaauugugagcaacuuugaggcuaaagauagaggaauuagcugagaaaacuaacauaguuuccugaaaucuagcucuguucucugaggcauuuuaucucuaguaccauccucagguccacauggcuugccucaguucucuucagagaaucguuuuuuuaaccacccuuuguagaggccuaucuuuuugaauuuccuugagguuucaugcuuguauuuuguguguaggaauccucagagcugccuugauccugcccagauccacaggcuagugcugguugcuuggaacaaggaacgacccagguauccaguggguacaacuucuagcuggguggacagacagcauggaaccauagcucuacacacacuagcauggcuccagugucuuccaguuggggaugcuagccuucugaaggcaggaggacugcagccucccaggcuggcaguaucccuguuccguuguuccaugcccucagcauaggauaacauggguugauuugggucuggauuccagugcugacugucacugacuggcucuguaaugaggguaaaggguaaaaguucucugagccuagguuuccucaucugaaaaaauguggauuaaaaauaauacucccucauaaguuguuaugaagauuaaauaagaugauguaugaagaauacuggacacuugguagguacuugaauaaagaagugccaaccacucuucacgaucucauuuuuuauucccauauuguauccccacauguguuguugcugagccucauaccagccucaacauuauaagguuucuuagggaggggugagcccuuccuuaaggguuuuuccagaauuuuagacaaugugaguauacucugacaaguggugugguugagugguuaaaaguauaugcuccggaguccuauuguuuggguucagauguugcuccuaccacuuacuggcugugagacccugggcaaauuacuugacuucuccuugccucaguuuccacaucuaugaaauagggacgauauucguaccuaauauacuucauaggaugguuaugaggacuugauacaugaacaaugcuuagaacaguaucuggcaaauauuaaguugcuaagaaaaauuauuggcugcugcuauuaucauaauuauuauuauuccacuaauggaauguaauagucuuucugccucuagucucucucuaauuuuagcucucuuacauacuacugacauauuaacauuccuagaacuucaaucaaugcuaaccccuugcucggaaaucauccauaguaaaaaauaaaagucuguaugucuuaugcuaucauucaaagcuaugaucuagucuugaacugucuuccaauauaucuucucaaaaaacccacuggaugugagucuuggucccuugaaccugagcugucaucuggagggcuagaagagaacuagguccuuauuggcgguguggccugcugagauguucacuggaggagagaugcccuaugguccccugcugguaugcuuuguuuccaggcugguauccuucuaagugaauaugauacugacuguggccuguucaggucuaguuaagaagacccuccugguggguuuuacagcuuuguauuucucacugugucuugcacaaaguaggugcucaagauguauuaaugaauaaacauuauuucagcaaacagacuucuuaaauuggugccuagcuacaaaggcaccauuaggguuuugugccagcuguaugaauaguaagucaauaagguagccauaaaaaaugacagcauccagaagcacaacaauggaggauagagaagacaaaauuuuaacaggcaaauagaaaagcuguaaaauuauaucagagagagagccuuuuguauagaggccuaaauaccuuauuugaguagcaacccuaaguugaaauuucugaauuucucaaaagaaccuauccugcuguuuaaauuggugacuuaaaacuagaccugguaauaagauuuaauuccaauauuauccuuaucacugagaaaauuauuucucugcuuuuugcauuauuuuuccuucuuuugucuuuuuaaguuaucugguuuuuuucuuuuucuuccugcuuaagagacaggcugaagugcaguggucuaggcuguaguacaguggcacaaucaugauucauugcagccuuguacuucugggcucaagugguucuccugcuucagccuccugaguagcugggacuacaggcaugugucaccaugcccagauaauuuuuuuacuuauauggcagugagguauugcuguguugucuaggcuggugucaaacuccuagccuuaagcgauccucccuccucggccucucaaagugcugggauugcagguaugagccagauaccuggccauucaguuauccucucaaucauuugaggugcaaguugauucaagaguagcaaauaauuuuuauuagaaucuaugucugcauguuguuacagcauauuucuguuagaaaauacacagacccuuuagccucaaauauauagaccucaaucauuaauuucagagaggaauaucuuuaauauauaauucaaacuuaagugggaaauuuucaaaucaguaagaggggcuaguuaaagguccaugaaagagccuaaauguaagagcuaaaacugcaaaaacucuuagaagaaaauguagcagaaagcugcguggcauugcauuuggcaauaauuucuuggaugguaccaaauugcaccaaaagcacaggcaacaaaagaaaaaauacauaaguuggauuacaucaauuaaaaacuguacaucaaaggacaaaaaucaacagagugaaaagucaacccauagaagauauuuauaaaucagauaucugguaagcaguuaauaucuagacuaucugaagaucuacuauaaaaaaaaaacacugaaaaucacacaaguguuggugaggauguagagaaucggaaccuuuguguaccguugaugggaauguaaaacagugcagcugcuauggaaaauaguauggagguuccucaaaaaauuaaagauaaaauuagcauaugauacagcagucccacuucugagaauauauccaaaagaauucaaaauaggaucuuaaagagauauuugcacaaucauguucauuguagcauuauucacaauagccaagagguggaagcaaccuaaugucgguagaccaauaaauggauaaagaaaauauggugaacugccagucgugguggcucacaccuguagucccagaacuuugggaaacugaggcaggaagaucacuugaguucaggaguucaagaccagccugcacaacguagugagaucucgucucuauaaaaaguaaaauuacccaggcaugguggcaugcacuuguagucccagcuacugaggaggcuggggcaggaggaucgcuugagcccaggagguugcagugagcugagauuaugccacugcacucuagccugggugacagagugagacccugucucaaaaaaaccucaaaaacaaacaaaaacaaagaaaauguggugaauacaugcaauggaauauuauuuuagccuuaaaaaaggaggaaagaaugucauaugcuacaacuugcaugaaaauugaggacacuaugcuaagucaaauaagucagucauaaagagacugcauaauuccacuuacaugaaacaaaaaguagaagugugguugccaggaacugaaggagagggaaaaagggaguugugguucaaugacuagaguuucagauuuacaagaugaaaaaguucuaaaaaucuguuguaccacaauaugcauauaguuaauagugcuguacuguacacuuaaaaaugguuaagacagucaauuauauguuaugcauuuuuuaccacaauaagaaauaggaaaauaaauucugacacaugcuauaacauggaugaaccuugaggacauuaugcgaagugaaguaauccagucacaaaaggacaaauacuguaugauuccacccuggaguagucaaauuuauauagacagaaaguagaaugauaguugccaggguggcagggagaguggaaggggaauauugucuaaugggugaagaguuuuaguuuuguaagaugaagagaguucuggagauggaugguggugauucuugcacaacaguuugaaugaacuuaaugucacugcacuguacacuuacaaaugauuaagauaguaauuuuauguugccuuuauuuuaucauaauuuuuauuaaguucaugaaagagucccacuugagguaguaacaguuuaagugcuaauuuuauaccuuauuuuaagaugcaaggcaauauaacauguuucuuacuagaaugagaagauaauauaaaugcuuuucaaagaauuuuaaguuuccaugacaacauuugaaaguacuuuuuagcacuuacaaccauccauucacaugaaauuuuauuaccucuagaaauuaaaggggaagaagcucucaguuccuaugguggugguuguaagaaaucuauuuacuaggcaaauaaauuauuuccucaaaucuuuguuucuuuuaaacaagaaaaaggaguuguuuucuugggcacuuagaguuuguggaaugccccugucaaguaugacuacaauagacaguuuggaagaaauagcuggaaauuagauugguauuguggagaugcugucauauuacaaaggcuuuuaaaggcagacagacaaauauaaaaaugugagggcuggccaggcgcauggcucacaccuauaaucccagcacuuuggguggccaagguggguggaucaccugaggucaggaguucaagaccagccuggccaacauggugaaaccucaucucuacuaaaacuacaaaaauuagcugggcaugguggcaugugccuguagucccagcuacuugggaggcugagauaggagaauugcuugaaccugggagguggagguugcacugagcugagaucgugccacugcacuccagccugggcaacaagaacgaaacuucgucucaaaaaaaaaaaaaaaagaaaaagaaaauaauaauaauaauaaaagaacugugaaugcuaguacaugaguugggucgugggguacaaaugugcauuuauuuuuaugguucauaauucauauaacacaaauauuauaaauacauaaugcuagagaagaaaacaguuuaaaaauugccuuuaaaaaauugaaguugccaaauaccauaaggacucaguaucauacuucuugcaguuguguaugaauuuccuaggggcaagcucaugcucuauucaucuaggaauauccaggcccuaauauagaggcucacgcaguagauaaguagauauccauaaauguuuuuugaaagaaugaugggcuggauuucccuguucuauucuauugccacuuaauaauuucucauucucacagaacacuuuauccucaauucuguaucugugugaguugacaccagcagguaaauuguucuccagucuaaccaguauuucuguaaaaucaguuauuuuuauucaucucuaaauaacucauuuuauucauucauuuaucucccuuauacauacuauccaagugauuauucauaucucuucuucucuuaagcccucuuguuuguacucuuuccaaaacuuaugcccuacagagaaaacugaaaccaucuggugaaugcucucaucugaguucuuauuuucagcagggcaugaauuccaucuuacuuucacuuuccuucucuucagucugaugaacaggcuacuuuccuccuuauuauaauuauuuuugaaaauucaaauaacacauacgguaguucucccuuauccauaguuuuacuguucaauuucaguuauccauggucaauugcagucugaaaauauuuaauggaaaauuccaaaaauaauucauaaguuuuacauugugcacuuugcuuaguagcaugaugaaaucuugcacggaccugccccaucccacccagauacagaucaucccuuuguccagcauauccacacuguguaugcuacccaccaguuagucucuuaguagcccuaucaguuaucagaucaaaaagacauagcauauagaggguuugguacuauccacagcuucgggcauccaccgaggggucuuggaauguauucccauggaucagagggaacuauguacauuguagugggagaggagaaucucccuccuucagcuuucaucucagcccagccauaccaagacagguggugaagggaaggggaagacaaugccugcucagacaguucuucuccuuucucucuccccacucuaauucugacgcagcaucucugguccauagaccacccuucacuucacuccacuguccccauuguucagcaugggcaucugaauuggaauagaaacaucagacguaagcccugaguuuuguuucaacauaccauuuauugguagcuauuguaugccauggacugcaccagaugcuuugcguauuguuuugauuuuugcacuugcuaucuaaguucuaaauggcaguuuagaaaugagcacaaucuuccaaguguagugaugcgugccuguauucccagccuacugagaggccaaggcgggaggaucacuugagcucaggaguucaaggccagccugggcaacauagcaagauccuugucucuaaaaaaaaaaaaauauauauauauaaauaaauagaaaugaacauaaccugugaguaaguuaggggcugacuauagauucucagugcuaauaguucacauggaauuuuuauuaccguuuccauuauucuuaucaaaguguuuuauaauacauguuuuaucuucccuaacacaguaguaaagucuggcagaaaucuuauuuuccuuuuguuugccucccauuuauaguauguggaaaaagcacucccauuuaugagugcuucuucaauguacuauauuuugaaaaaaaauuugagagcuuuauaaucugcccuugagauaauguucacauuuugaguagagccaugaagcuuguguuuucuuaaugauuacuguuuagccauuaaaaacuuuaacagauuaugugaucuauucagauaaugcuaauugugaauacuaauaagucuuuuugauuauuguuaucugguuguuagauuaaucaguaucaauagaugaucaguauauuacccuuuuucuuaccagucaguaugaauaaaauuuaaaccccagaguaauuauguauucuuuuuagcacaguaagucaaaagauuugacuugauaucauuuauaaaugaaugaaaugaucaacucuagcaaccgaauuaauugucuccaagucagagaucagcaaugaugcuugguuguuuaaaaagaaggaagauccuuacauuugauaaugcaguuuaaacuaauucuuucauucaacaaauacuuaguacccauuaaguaugcaucagauacaaaguacaguccccacauuuaaggaguuugcaguauaguugagucagaauucuccuuuuccuccacaacaccuaguagaagucuuguacauagauguucaaaauuaauucacucagcaaauauuuauuaugugugccuagugugugccaacagugguugacagacgaugccacauucuuaccuggcuaauuucuguagguggaugcuucuugggaauugcaaauauguccauauuuuucauggguuacuaggaauuaaaauuggaaaauuaucuuccauucucccagcauguaguguuucuuaauuagugaaaaagagguuaaauucauuagacaucacaaggcaauggaaaucuuucauaauaaaaacuguucugcauugagagacuuucuuauuaauugcaaauuuuuaaaucauauuuuaaggaauauuuuuccuuaauuuuaaucuauccugcaaauauuguggugguaaauuaaacaaaauuuuaaagcaagaaaaauuagcccccagcauagaaacucuuuguuuuguaucuuuauuucaaauaaugugauguuuuaaaccauugguucacaauuaaaagugcuuuugccuccucaaagauaauuggcaaugucuggagacauuuuuggcugucacacugggugagagcuuagggggaggcuacuggaaucuuguggauagaggccagggauguugcuaaacaucuugcaaugcacaggacagcccccuacaaccaagaauuguccagcacaaaaugucguaauaccaagauugaggaauguuguuuuagguaguauauuuguagcaaauggugaaaagcauccgaacauuguauauaacauauaacaccaaaacauaagauauuaaaaacaguuauuucauuuuuucuccacucaggauaucuguuuuauucaacagaaggcuuuggaugacaucuauguaucaggaaauauagguuccagacauuucaaaggcauaagguucgaguucucaaagaguuugcauuauaaaaauagagaugauauauaaacaaaaaauuacaaaagaauaugccauguuuuaucauagagcuaaguaguaaauagcuuuguuggguuggucagagaaggcuugacagaagagaugaaguuugaguaguguguagaaauucugcucagacgucaacacucaggugcuagcugggaaaggacagcgcaagcagagggaacagcaugugugaaagccuggaagcuuguuaaacagcaagcauugauuguauguuguuuauuauguugagaugagucuggaguuuuagguagagaccugcuuuaggaggaccuugaauccaggauauuuggacuucauccugaggauagagauaugauaugacuaaucugcauuguacaaagaccauucugaugguuauaugcagaauggagaugagaaacacuuuacaguauuuuaacugacacaguaggaggucaugaaggucugagauaacauaggaaggucuaaugucaggauguaguaucucuugaaugguauaggaaaacaguagauaaaaaaauguaggauaacuuguauguuucacggauguuggaaccauuagccaggacagaaaauauaaaaucagaaaguaccugguggaacuaauuuuucuccaaagauguucuuuuugagguaucuguagaacguauguuuuuuggcccaggaguuuauugaauacuugcccaauuaugaguauuagcaauggcacaaaggaagcauggcagcuuaaggggcaaagaauuccacuucuaaauaugccagugauuguguuuaaggccuuggaaauauuacuuuuuuuuucaucuguaauguuuggaguguggugauggaaacauaccucuuaggggaguugauauaacugauacugagcuaaagaauaauaaauuaagacuaaauaauugacuauuauacagcauuugaaaaauuguaguaguuaaacauuuugggggccauagcaaccauuuaccaugauaaauguuuauacacuaaaguuagguuccuaagaucacucauuuugguagucuuugaguaacaucggcugaguugcauggauugccucuggugugcuuuagauaagcuuuuguucuuaguuuucuacuuuucauuacucauguauaacuuuuaccugcuuuugcauuagaaggaaaacuuugucuuacugguuauauccaaaccucuugugcuaaguauuuuuuauacuuucacugaaaaaaaaaaaaaaaacacauacuaccuucaaaauguuaacugaaaaugccuuagcuaaugaacaugaaaagaaaaacaguuguaaaauguuugcuguuacugcauuguuuuaauguucuucauugaggcuucucuguucaucaacccuuugagcaggaagcaguauaagguuucuuaugauuauuacuacuaacacauuguaaagaucuuuuuccuuuaauccauuuaguacaggaucuauuuaguacuggccuguguccuagaauaccaucagagauaaggcuauuauccuuucauugaguauuauccugggaaaguauuuauaaaauugaacuccauugcaccugcugaccuccuuuuuuaaaugaagaagggguggggauagagauuaugcuaacugaauucagaugaagcaguguauuugccagcacugacacaaagugcuuuaguuagggccuuuuguuuugugcaaaucgauuccaucuuggacucugaaagaaauaaguugacaauucagaucaggaaguugauaaucacauuggguccucugcacuuauuggcgcaguugcuauuuuucaugagcaauucuguacuaggacuccuagcuauuucaggauuagucuaaaauguuuguuugccauuauugucauguuuucugcaaaauugcuauaaauguaaucuaguggcauuauauucaaguaugaaagacaguacucuuagaagaguuaaauauuuaauauucaugcuuagcuuuuuaaaaaauagaucauuaaaauggaaaagaauagucaagcacaauuuuuaaaacuuaguuucuuauugagccuaccuuaagcuuaaaaagcuugaagaacagugccauguaacuuguaauuaucgcuuuaaaaauauuuugcauugucagauuacucagauuaucauuauauaaaauauaugcuacaugcacucauuucaguaugcuauuaaggcucacauauuuaaucacuuagguuuuuugcugguuuggggcagcauugcuaaauuaaauggugguuugugccuuucuaaaaauuauuuugauugauaggacaagauauaaaugaaauaaauuugcucccaauuuuguugugccauuaaaucaagcuauauucuuuuuucuauguucccuuccaguuccuucucauauggucacaugccuuuuccauaauuaacucaguguugcagucugcuguucacauuauauuuuaagauuuuuccauggugguacaauauaaaaguucaguaucuucauaauacaaaugcaaagcuauucuguuuauuuaauaauaaaguauuugaccaaauuaguaaucugguacgaaccucaguuaaucaaauauaaacaguuuaugugaugaaaugcagcaaaauuagaacuggagccugggucuccucacuuaacaauauauuauacaaugaaccuuccaguauucuaguugcuguauuuuaaaauuaacggaucaggaaaauaagauguauauuggauuuaguggacuuuauccaucucaauuaucuauacuaaggaaaucaauguauauaccagcuuuauagaguuauaguaaauuauauaacacauaaauguauuauguaaauuuuacauuguguacauuuuacauauauuagauauguguuggccauauaaucagaaaaauuaauuuuuuuuugcauagccaaucuaaaguugaauuuaagcugucuuaaacucugaaaacuaggaaucacuuuuaucaauuuaucaguuuuaucaauuuuuucaguuuauuuacaguuaggaauguuuccugcuuuuuaaauaaguaauguauuaucugaauuuacauguguuauaugcauuaauuguaagcauuuaguaauugaaagcauaggaaaaacaggcauaauguguagcugagcacaggcuuuguagugaaagagaugugguguuuaaucccaguucuacuccuacuagcucuguguucuuaggcaaguuauuuaccuuaucucuuagccucuauuuccuucucuuuaaaguaggcuuaauaauaccugccuuacagaauuauaguaaauuguauaaugcauaaaugucaucuugcagagaaccugacacucaauaaagguaguucuaguacuuauuguuauuaccuuuaauauuaauuaaaauuuguacaugaauuacauuaauaguaauuuuagagaagaaucaguuuuaaaugauugaggacuuauaauauggaucaaaucagauuuuuaugaauucuauaauguuuggaaaguugcauauguugaauaauacaaaauuaaaaugaauaguaagagaauuuuuucagacuguucugccaccuaacauaauuuuucuuucaacagguucagcccuauguagcuacaaccuaaagccuucugaauacacuacaucuccaaaaucuucuguucucugccccaaacuaccaguuccagcgagguaaauuuuauugcaaaguuguuaacuugugacuguuguuuuuguagguaaauuuuaaacaauauauguuauucugagaaaauagucauuugauaccuguuggccagguccaauacuuuuauuaaaaaaauuuuaaaguagcaauagaaaugacauuauauauuuaauauuuaaaaacaacacauaggcaaccaacuuuucuuguucugacauauuuuaaauuucauuucuuuuaggggcuugcuuuuuuuguuuuuauuuucaugccauaauuuuuaagugcacaaaaccacugaacugcuguaaaaucugcaacaaacuuagaaaccaagucucacaaucuccaaagaguuuuuuugauuuauccuaguaauauuuacugggauuguuuuaaauuuauuuuguaaauuuagaaagucugccagugauuauuccccauaguuucuuucagguuauauuuuuuagguaacauucucuguauuagguuguuugcuauaucuuauccaaggucuucuucaacaaacauuuauuauuaaguaccuacugugcaugauggauacaaagaugaaacaagaaauguucuuuggaaggaucucaaaguagugauaaguaaagcaacauuuaaaauuauaaauagauuuuuugaaaggaaaugaauuaucaagcauuguaaaauauaugcucagaauuagguagguauacguaucuguauauguguguauguauauuugugcacacacacacccccacauacuuuggaguguuggucagaucacaaccuuaguguauauugccaacuguguguaacaugagucaacuucuccaggaaaauguacuugaggccacuuuaauuguaucucaauauauuauaggaagcuguuguauaaaaaauuuugagacucaugucuacuuucuuuuggauuacuuauggguguaacuuggguuuuauuaacuugaauuugaauuuuucuguugaaaguagaaaaaagauauaucaguuaaauauauuuucagcucauuaaucuugucaaguugcuauugaaaaaucaaaauuuaaagccuguagacauaaaacuaaagggacuauuuuaaaagauaguaagagagacuuacaaauuauggccuuaaaccaacagcuacggagauuacauucauauaaauugagaauauuagggaggcugugggaguaaagaaaaggggauccuuugaauagucuuaggagaaaauuuauccauauaaaaauuagaaaagcucuauacccuuaucuauccaacugguaaagucuguuuuaaauauauucuuugaauauagaaucaugcucucaagauuaaaacauauuaugacaguauagccagaaagccugggugugagagggaggucucugcuccuguguaauaggggcaggaugucaggugggggcagcucagcucauccugcacauccuuccccgccucugaccucugaugccacuauguugaggacugccuguuccugguuauuuuggguuuuccaguuuuugguacacacaugcaucucacaauguccuagggguauucacuggaagacaaagaauaguauuaggggagaagauuuuagagauggacagaaauggcuucuaacaaggucaucaucugauaucucacuaaucuaaaaugcagugcugaaccuauaccaucugaaaacugacggcaugcuguguuuaugcuguguuuaaagauccuuauguuuuacuuauuuuagugcaucacagucuaaguauguuaucacuuuugucugaacuaagccaguuggaaaguaaaagagaagaacauuugauagaaagaaggcaaaucuuguaaauaccagagcuauauaguauuagauaaacaaacugaaaggaucugagaauaagaauaaauuuguuuuaauaaaaagacuugaggcaucaccccauuccacccaucguuguauuagauaccaagucuccaaagaugaguaagaccuagucucugucuuuaaacucauagucuaguagggacuauguuuuuggugacuuuuuuuaauggcaaaagaccagcaccaggcaaaacuaugaggcaggcaaguaccccucagcauccuucacaucucuuuugguguccuucuaggagcauacuacugggacggaaggaccugaacuuugagauaagucuggggugaauuccauauaauuacuuucuguuugucaccuugagcaagucucuuaaccucucuguaaaccaaguuuccucaugugugaagugggaauagucauacuccccucaaggauuuguaagaauuaaacaagauaauauacauuaaacaucugugugcuuggcacuugacuuaggagguauuucuuuaaacuucuagaaccucuuccuuuggcccaucuuucuuggguauccaggggccuucuacagcuaaaagcagcaccuguuuuagagaaaagcaauuguaaacuaauuuucaaugaagcauuagugacacauaauaaccagaugauuaccauuccuaaaagcuuuugaauuuuaaaaacaaaugccuagaaagaguuguauuuuauccaaauucauaacucucuauuggugaaaugccaaccaugguggcaauauggggaauagcuagccaguaugcuuacagugcuuuuagaaauagccagagagaacagcaauaguagaaacagauuacauaaauucaguuuauucaucauguauuugggcaccucuggaugccagaaagguuacuaggugcuggggaauuaaugauacaauaauguagagaugacaaauuaauagccaaaggccagaugcaguggcuuaugccuguaaucccagcacuuugggaggccaaggcagguggauugcucgaggccaagaguuugagaccagccuggccaacaugguggaaccucgucucuaccaaaaacacaaaaauuagcuggguaugguggugcaugccuguaaucccagcuacucagaaggcugagacaugagaaucgcuugaaccugggagguggaauuguagugagccaagauugugccacugcacuccagccugggcaacagagcaagacccugucugaaagaaagaaagaaagaaagaaagagagaaagagagaaagagagaaagagagaaagagagaaagagaaagaaagaaagaaagaaagaaagagagagaaagagaaagaaagaaagaaagaaagaaagaaagaaagaaagaaagaaccaagaaaaaaauguuaucuguucauauuuuucaauggaggauucaaggauaaauuaacauuuacaaaucaucuacuacaugccagcuaucccacaguaucucucauauauauuaucucauuuaaccuucacaaaaaucugucaagauauugcccccaauuuguagaugaggaaaaagaagaugagagagguuaucuaaagccacaccacuaauuguugcaaauuggaauuugaauccaggauguuguagucuauaccacagugaguguucaacaacaacaaagaguauaggagugaaagaaggccgggcacaguggcucaugccuguaauccuaacacuuugggagaccaaagugggaggaucgcuugagucuggaaguucaaaaccagccugagcaacauagcaagacccucucucucuauaaaacauaaauaaaugaauaauaaaaauguuuuaaaaagggugaaagaagagaaaaaagaaacaccacuccauguuuagacucguaauuccugccuuuacuguacuauagagauauugccagaauacuuuauuguuauacuuacuuaaauaaaacuuuggcuagaaaucauguguaauuguuuauuuauaaccugagguucuagaguaauuauaugagaugcagaccccugccuucuugugaaggcaaaugggcaagugguauuaggcacuguuugucaucauacuuuagggagcuuauuaacugugaugaucugaacuuaaagguaaauggacaguauguuugccaagguaagauauaauuuucauaugagggacuaauuaaaaauuuuuaaaagacucauuauaaguucauuuuguucuuguugacugcuucagcaaguaaaacagcaucacuuccuaaugugacuacaucgacuuauuaaagauucaauauuugguggaagguagaaaaacuuacuguauauagaauacuuuaugcuuguccuuuuaauuaagaagcacaaaaugugucauuuagguaagauacuaaaguagaaaugaucucguaauacuagcuccucaaaaguauuauuuucucagagguauaugaaaucggugaauucaccuccaccgaaauucauuaaaucacaugggauuuaaacgcuaaaauauaaaacaaaccauuucaaugacucgauuauuacuuaauuuuuuuugauaagaaaacaauugaaguaucaaaacccuguggcuggcagaguuguuuuuguuuggggaaaaguugagaaaaagaaugacaaauaaggaaaucuaguuuguuuagauuucaaacaagggaaucuagugcuuuuuacuuuaaagcuaaguauuucaucuuauuuuugaauaaugugccuauauauuauuucuucuuauguuugccuucuauuuuuguuauucauuaccacuaggaacagauuuugacuaucagcuagacaauguaguuaaucagcaugugcuaauuuuauaccuuuaaauuuagaguaucagguuguuguuuuuuuuuaacugacauagauugaauuuuggugcaaaggacuguuguuauuuugcuccaguucuuugaagaauacuuaugaaaguacucuuuccaauuggccaacuguuaauaaacaguguaaaaauguuugaaagguuaaguucagggcagauauuacccagcauuuccuccuaaauaaaaaugaaggauuuucauuuugagaguucuggucauucucuuuuaaaaucaucuauuaucauccuaaauuugaaaagaaaaaaaacacugaacauauugggcauccuguuccuguauaauuuuguaucaucgauuuaugggugcccucuuggauggugaugaugaugaucugaagagacuuacagagugcuuacuccuacucuuucagcuaaccaauggagaaaguaagagagagagauggaguuacaggcagggugcaagguuagaagaauuggggcuuuuauaguugccuagcaggaaaaagaaaacaggaaggcagggccgagaaaaauaguggguacugaaaacaagaaaaagacaucaguauccuuaagugaauauauuuuauguucaagguuggaggcaagugaguuaaacagagacuaaaucacacaugauaggguaauaaauaaagaggauggaguuauagauaaucaugaaacagagaggauuuuaguuuugaaggauagagaaccaggcuuuauuuuaaaaauaugguuagaagaguccuuaggcagagauauuaacuugcagagauggcauccagacaaccucagaaaagaggcuucaucaugacaaaguugucaguuuaaagguuucugucacacaucagcuucuauugacuuagaaauuuacaguuaauccuuuuuuuuuuuuuuuuuuuuuuuuuuuuugagacggagucucucucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccaguuaauccuuuuugauucucauaauauuuuuaacuaaaucuacuucacuuaaagguauucuauaauuuaauaucuuuuugcaucauuagugaagcacuuuuugguuaaaaaaacaauuauuugaauaccuguaauucaagcauuucuuagaaugcuguggcuuccugcgcuuucugauacaauaucaaaccuuuggcauuaacuuucacuaauaccauuuuggagguugacacaaauacacagggaugcaagaggcaauuuuaaaaaacaaauauucaugucauauuguuaugucaucauuuuuugauauauuugcuaaagcaagacuaaggcaaggcuagaucuuuaaaauuauauuauuuuaacguuccaccaaauaugacagcaugaaagauguuacuuuuucuuaccaucaauggugcucauuuacuaacauuuaagggaaacuaauacauagugugcuuauauucuuauuugaaaagaagcauuuuucgaggaaggaaacaaggauaguguuuugcuucaggucauacaaaguugcuuugcugagauuagaaaccuuguagugcccaaccauguaauuuuauccacucauuggaccaaaauauagugccaaccaagacugaggaacacauuuguaucauuccaguuaaaaauguaguuguagcugggacuuaaaguucugugaacauauuuucauggauaccauuuaaaaaaaguuguaagaacaauucuggaaaugugggauucacguuaacgauggcuaaauuuuaacauaaugcacauauaaguguguauuuaugcauggacauacauauggcucucauagaauccgaguaaaucacaaccaaaggcauauucguaguucuuugcuuaaaaucucuuauugauuaguguauacuguccucucagaaguugaaccauguuguaacaaaacagguuaaugucacaguuuacacauagcucuagucuuucacaaguaaaaguuucaguccauauaagccuaauauaaaugacuaaguaauugguuauuuuacaucuuuuuagacacagauaaucuuagauuaauaguaacugauaaaaagaaaauagcccagaauuaugugauccuaacaaguccaguauuuuucacuuguuaauuauuuucuguucucaugauuauguguaaucuuuuaugcagagauaucacauuagauauacuuuuccccuuauauuauuacauuauaagcauuuccauauauuaguacucaugguuacuguuuuaaauagcugccuauuaugcuguuuguugaugucucagcaugacuuuguuuauaugagagguauuaagcuuaugcuguaaacaccuuuauuaaucugagauuuuguaugcuguuuuguuagaggaaacauucuauuaaugguggcauauuucaaguaaaagcaugugcuuuuuauuuuuaaaucgcuuauggcaaaaauucauuuucaguucaauaaaguauguguuuguaagcuuugucaucugccccuugacugguagaugugcaggcuaaggaguuuuaaguguuugguuuugcuuuugguaguuguguguguguaugugugugugugugugugcguuucuuuucagaaggggcggguaaugucuucuguuggaacaugcacuccacccucuuugauaaggcuugugguaagauuugcaucacuacccaugacagucauccucauagcauuaagcacacagcucuuagcucccauaaugauguguggaggguggaguguauugcagccauauucaccuuucauuuguguguuugauguggcauuuauauuaaguaggaguaauuuuuuuucugauuuuuuuuucuugugucaccagugcaccuauuccauucuuccaucgcugugcuccugugaacauuuccugcuaugccaaguuugcagaggcccugaucaccuuugucagugacaauagugucuuacacaggcugauuaguggaguaaugaccagcaaagaaauuauauugggacuuugcuuguuaucacuagguaauuguuuuucucauuauuagcuauugcauaguauugcagaagaagacuguuuugucuuuuagccaaaauaugaauacaacuggggauacuuguaaaauguuuaacuucccauagccaaaaucauuguuucagauuauauauaguuaagaauauguacauauaaguauguauauauaucugaaacucauucccuucuuuuuuucuuucauuggagaaaacuaguguuuucccaaacguuguuuacuaagucuauagcuacuuuaauaugagagcaagaggcuucuuuuaaugaaucaacaacccucuguuuuuaguuaugauuccuaaaagguguauuuacuuauacaggaggcgacauauucucuuauauauucccauuuaagaacacagauuucugauagauuacuuuugaaguauguaauuuuuuuuucauugcuacagugcauaguaucaguguauugcuggaaaaauuaggaaaucuccaccuauuagccacugaguuuucuagucaauaaauagauaauaaaucaaacaaaaauguuauuuucaagauuaaaacucccuauauuauucuagaacuauauguaccuuaucagaauguauaggccuucuuaguugggagaaguaaacuaugguaggaaccaacagcuauuucauuauauaaguaaacuuaguauuuaugccuguuaacaauuauagccauugagaagauacaagcuguauuuccgucuuuccugucauuagagaguauuuucuuuuugcuuagguaguacuugacucaauugaaauaaugcuguccauaugaaaaucuauuucugugauauuugaaaggcucccaucuguuuuugguuccuguacauuuauugcaaaagugaguaccuuaauaauguuaccuagacacaaaucccaaccauuuauuuggcuuugcaaguggcccaaagaaacuuaacuguuagucuagcuuuauaucaaaauuauuugguuuuugaaauaguuaaaacuuuaaccaaaaacuaaagauccaauuaaaaaauagugccaauaaugcuaagccaucagaauucuauuuuuuauuagaaugauucucuuuugaggcuuaagaguguaauauaaucuuaaaaaaucuuuguucauuuguuuguggaaugggccuuuagauaauuaagaaauuuauaaauuauuauuucagaaacguauuucccaugcaaggguuaaaucuuuccuuucuucuuuaagauuuuuacucaggauuauagcacaucggauuuagcuuggggcagguagaagaacuggcuguauaacucaaacagcuuugcuccuuuuugaggaaggucuccucaccugggaccccugaccucaguugagaaauuagacagaggaaauucggccauaguaggcuucaggauguuauuccacagagucggaccauccuuuggaguucuagaggagaaacagccagaaaaggauaagaugccauuuagcuucuugacugacugucagagaaguuaguugcuccugaaauacauagauuacucaauaaagcguagcuccuaauuuaacugaucucugucuauguguaguaauuuuucuugucaccaacaugacaugucauucucuacacuuugugugcuggcauguauguuugcaugucugaugucuuccccguggugaauccacaacagucuugugcuguuuuugagucaccaugugcauuugcauguauuuuuuucuguaguuuauaaacccacaguuaggugacuuugguuucgagugaugcuauuuaagugguacagguagcagagucaaauacaacagcagcuaguuuccuuccuuaucuaaauuguggucaauagcaacagauuauuucccuggggaaaaaagcaaccauuuaaagcguuuuuauuuguauuuaccugcauuuucaaauaauauucuauauguucucuaucuucccugcaguucuauccaugauuuugauggugauaaucagguauauaucaagaguacuuguguggaucuuaacgauucuggucauacucgguucacuugguaagcuauuuauuucuuuguuuucuaccucagccucuuaacuacuuugguagaaaauagaaauauaaagaagaaaauaaauuauauuuucacaagcuauauccucaaggaagacuguuaauuuuugccuuaaaauuucuuauaauuauauuugccccuccccucauuucaucacuguuggcauuugaaguugagaccuuuuuucuaugcauauguauauaaacauaugcaguuaaauuuuaccagcugaauaugaaaccuuuuaguaauggaauuuguucucauuacauuuaucaucuucacugguauguuuggucuuacuguucucaucuguucugucuuucuugaaauucauucuuucuuguuuucucucuuugcuacacgaacuauguuuucuuugguuaucuucacccuuguuuugaugguauacguuacauuuucacuuccacaguuguuuucagaaaauauucuuuagacuacugugauuauuaaagucagaaauaagaugauauauguugaguucuucccugccucccuuaaauuuaacauaaacuuuccuuccuuucauccccuacucucuucugcucccucccacuuuucgcccuuguuaaauagucugagcuuuuguacucggguuauaauuaaaguuaaaauauugcuuucaccugcuguaucuuuuuaaaacucuuguuuaucuuugccuuaaaaacuuuuauaauuauauuuacauuuacguuuuccuggacuaguuuuaguaggaacuacugguccuuuuuccauaaaguaguacagaacugcuaguaaggaaaacuaaaucaguuauuuggaaauaaauuugaagaagucuuccugaauguaaaggaaaauuaccaaaaaaguaaacuguuaaguuagaagaugacagcagaagaauaaacaaugaccuuaggagaaaaaaaccaauggaacagaaacaauaaucaaauacagaaauaaaaaauuuuagaauugaaaaagauucccccaaaagaucauaggcaaauuuaauuaagauucagaauuagacaaaacuuuaaaacucuagauaugaauaguguuauaaugauuaaauuagaucacaucuauaaaggacuuagcacaguuccuaauacaaauuuaaauuuuaauaauaaauacugucuaccauggcuauugugaacagcuuccuccuugacaucauuauuucaauuucauucuauuuuuuuaacuucagcuuuucuccuauaauucauuucuguauguaggaaacauauuuucuuccauuuucugaauauauuaaacauuuuuccagacaauuuucuugugccugcaagacuucaaaauggaaacauucccuugcucuaaaauguuuuucaccaauuucugguaguuuugauuuguuuccuccucuucaacagauggaaaauuuguacuugguauuugccaacaaauagguaauggaauuugccuuugaucucauuaacucuugagugcagauguugauguacaucgacuuugcuucaguuuuuuauaucccagacauuuaucauaucagccacacacacacaugucucuacucugaaucauccauuuuuucacugugaccuacaaggccuuacaguguggucugguccgcagcuaccucucugcccacaucucuaccacuuuccgcauugcucauugcaguagccacaauggucuucuuucucucauacuaggcaugguucuaccucagucucuuugaacuuugccugggacacucuuuccuuagauagugucauagauugcucucugucuuugauuccauugcucagauaucaucuuacuaauaccagugaggccuugcuuacccaucuuauauaaaauugcaaagcuuucccuacccagacacucuauauccuucuuaccaggagaucauuuuuucuuuagacuuaauauacuguauuuuuccuuguuuucuuauuuuuuuguuucccuauuauuauauaaguuccaugaacagcaagaguaagaacuuggcuuuguuuacuguucuaucuccagcuagaacaauaggugcuguagcauucaaaaugcugaauggguugaaaguagguauauaagucagcucucauauguggagguagguuugucucccucuucagucugguucuuugaaucucucaaccgguguuggagauuuaaaaaugcuuaucccuagcacccaccacuaucagagauuuccucuuuguuccucccuuuggugggaacuguucuuuugauuugcauuuauucauuguacaaauacuuaaucaacugcauuacugugucagugcaagucacagagguaucugugaugaguacaacagagaagauccuugcccucuuuaagcuucauugauguuuucugugaugcuuauuuccuuccuccagccuccucagcuuaaaugcugaggcucuuucuuuguggucaauuccugucagggguguauguuucuacuggcucgcucuuagcuucauagucaauaauaaauacauuugaaggaagcuuauuugauacacugaaggauuuauaaaugcuuaauguggaggaugauaauagagcaauggacacuuucuuuaugcuggcaaaaaguuauagcuauguacuucccagccaaauggauugucacugcauuagucccaugaugaucuguaggaagggucaagaaaauugagaauuuauguuacacauuuucuuauccuaauuauugcauuaacaguugggucuuuugucuccaggaggcacagguguacuaugguggcuguaugcaaagcaaagaaggucucccaaagaaacuguuacuccugagcagcuucagauagcugaagacaaucuucgggcccuccucauuuaugccauuucagcuacaguguucacagugaguuuaggcuuuggcgugucuuucgguuuuguguuuuuguuugcaggagaucauuaauggagcagaaacucaaaucuagcuuuugcauuccuaacccugaucuccaguagauaauaucucugugccauaguguaugaaacacuaaaaagucucuugaaggcuucccucauggaugagugcuauuugaugaaacauuuuuucuacccugucugcuuuuugagagaggauuuucaccuagaauauuuacauuaccauuugcuuacaagaacauauuucuuauugucauaagauaauuacuuuuuaaaaaugguucccuuuacuguagaaaaguauguuaaaaaauauaucauuccauuuacuuguuugcuaauuaucuucccauuugucuuucaaacuuuucauuuaacuuuauggcguuauuucaaaaauauagguguggucagguacaguggcuuaugccuauaaugcaagcacuuugggagacugaagugggaggaucacuugagcccacgaguucuagaccaaccugggcaagauagugagacccugucuucacaaaaaauuaaaaucagcugagcaugcuggugugcaccuguggucccagcuacucgggaggcagaggugggagggucaccugagccaugauugugucacugcauuacagccuaggcaacugagugagaccuugucuccaaaauauauauguguguuugugugugcgugugugugcgcgcgcgcgcgugugugugugugugugugagauuugcugcuuagguauuaagcaauaaaauuaccaauuaacaugugguuaaauaauuuauauguauaccuuugguucaucaucgucuucucucugaaaaaagaaaaaaaaucagucuacuucuaagagcaaucccaagcuuuuuauugagcaucagaaacaaaaaauaaagccaucauaaaaccauuggugccaaaagauauuuguuaguuauuguuauacagauauuacaacaaaauaugaaugaaaucucauuuuagguacaauuugcugugccagcugcugaagaugggaugugggggugggaggaggcaaagggugaaucugacacagaucccacuuuuaaggagcuguuggucuaauaaggaagauacaaauaaaaaccucguuuuugugguguaucuguuuaaauaaauaaagagucucauccugacugacaguauguuuugguucauaaugaguggcaaagggaaaaggaaaaaaauucuagaauguauuaauaaguugagaaauccuuuuauguuuugcuuuaaaggucacuugguaaccauaauauaaaauugacaauaaauauugcaagagagauacuuacugauaaaguauuauugaaauucaaagaaugcuaccuccagguuuggggcugaaggguuauguuaaaaauuucuacuauuuucgguuucuguuuucacuacuuauaauaauaacugaaaccauucucuccauacaggugaucuuauuccugauaauguugguuaugcgcaaacguguugcucuuaccaucgccuuguuccacguagcuggcaaggucuucauucacuugccacugcuagucuuccaacccuucuggacuuucuuugcucuugucuuguuuuggguguacuggaucaugacacuucuuuuucuuggcacuaccgguaagaagauaagcuucuuucucuuagugacaaacgugauuugcauuccaguauuuuagaacaucagagagagguaauucuucagacauuuguugaugaagguccaauagccaucagaacuuguagugguuauggcuccucaacaaccuacuucauauucgucuuuuuuuuuugagacagagucuugcucugucacccaggcuggagugaaguggugcucucuuggcucacugcaaccuccgccucccggguucaagugauucuucugccucagccuccugaguagcugggacuacaggcacaugccaccaugccuggcuaauuuuuguauuuuuaguagagacaggguuucaccauauuggccaggcuggucucgaacuccugaccucaugaucaggucaggacgccugccuuggccucccaaaguguugggauuauaggcgugagccaccgcaccuggccuuuuauuuuuuuugagacagagugucucucugucacacaaacuggagugcaguggugugaucucagcucacugcaaccucagccucccagguuuaagcgauucuccugccucagccucccgagcagcuggcacuacagguaugcaccaccaugccuggcuaauuuuuguaucuuuaguagagacaggguuucuccauguugcccaggcugcucuccaacuccuggccucaugugauccauccaccucggccucccaaagugcugggauuacaggcgugagccagcgugcccagcccauauucaugauuuuuuagaacauccuagcaauguaagucuagaucagggaaggccugaaauugcacucuaauuuugaaaugaucaugaauuugaaguaaguuccaauacugacucagacauuuagauucauucuaagaugaaccagugaaugcaaugucacucaggaguuaccucaaaucccagguauagccaaggaucuacuuacuuccuugggauuuucugguuucgaaaugaucugacccuagcuagagcuccaacugaugauauaguucauaguuagacacucagacuuucuuacagccguacugaguaucaaagguuaagcuuaaauggaacuaauuguaaagaguaucauaaggauaguaaacuuuuauguaacuauguaacuuaucuguccauucagcacacacacuuagcaacugaauauaauaauaauuucuguacuuugcuaagaaaucuguaaugauuggauaaauaauaggccuugaaaaaaacugaaguguuugaaaauucaugcuuaaauaauugauaauauaagaagaguuuuauuaaauauaacaacuuuuaaaagcuuuauaugaugccuuugaggacaucaaaaugcauaauaguacaauucuuaauuucacaacuuuucaagugauaguuauuuuugucccuuuaugaaauaccacacagaucagaagguuuguggcuugggguagggaccuauugccuucuacuuaacugccguauuucuggauuuguacuuuaugugcuucuucuuuccuuccuugauauuuuccuaggcaguccuguucagaaugagcaaggcuuuguggaguucaaaauuucugggccucugcaguacauguggugguaccauguggugggccugauuuggaucagugaauuuauucuagcaugucagcagaugacaguggcaggagcugugguaacauacuauuuuacuagguaagaauauguuguuauuagaaaacucgaguucaucuaagggaugguguccgcaggcuggaggggaagggaaucagacuggggcuggcaggaguuucauuucuuuaacaaaagaauuagaaaugaauaugacagaguguuauauauaguugauaauucugggagguggucaaaugagagauuguuguuuuauucuuuauacuuuucugcaguugucucauaaaauuuauugcgaugucacaaauuguauuuagcagaagaauaaaucuuauaguggugccauauguacuuuugcuuuauauaaaaguccaucaaaggacaacaagucuuuuuaguuuguuuagaccggaacaagugugaguucccuuugcuaacuuuagagccaaauaugaaagcuuuaggucucauaauuuucuauuauaauuagaugccaagucuaaauuuaacaucuuuuuaaauucuguuuucugaugaccccauaaguauucacuaauaaaagcuuucagagcacaguuuuauuuaacuugaaguauuagagcaucagaaccccaugaaacuaccauagagcaaugacauuaauuuuauauagcaugucuguagcauuuguaauaguuauauaucacuuggccauuuugucauaaagcuaaaauaagaaugaugagcugauuuuuuuuuucacugcguuggacucuaaaccauaccuguguuuccauccugaucuaggcuuuguuuuaauugucuuuuuggucauuuuuuaaauagggauaaaaggaauuugccauuuacaccuauuuuggcaucaguaaaucgccuuauucguuaccaccuagguacgguggcaaaaggaucuuucauuaucacauuagucaaaauuccgcgaaugauccuuauguauauucacagucagcucaaaggaaagguaaggggaaaaugcauuucuguacuuucugugggcacauuccagaccucaguucugcauguaguaaagcacccaauaauguuaaauacaaaguuguguuuucuucaaagucuuuacaaggcaaaauccagcccuucucccuugucucccacucaugcacuccauaugcucuggcaaaauucauccagucacuaguaacuaaaaguauccugugcugcucuuccucucuguugacucacauaccuuccuccuuagaacuucuucccuuccuugacugugggaauaacaugcacuucaacuaguuuagcucaaauucuacuccuuuguagaaaccuuuccugauuccucccaucucccaaacaaugcugucucuuuguucuccacucucauaacacuuaguaucuauacuauauucugauucuaaccuuuuuuguguuugguauuuuuuuucuccuacuagauuguaaguuccuugcagguguuauaaacuucacuguauaugcaguagagacuaaauaaauauuuaauugaacuuauuaaaaauaauucagucauuauguuuuaaggagaaaguggacaaguauggaggcuuugaagcauaaauugugauuuuuaaauuuuuauuuauuuuucuaacguuugaagucuucuaugugacaguuugauucuuugguuuuuuuauuauuuccauuuuucccccauccaggaaaaugcuugugcacgaugugugcugaaaucuugcauuuguugccuuuggugucuugaaaagugccuaaauuauuuaaaucagguaaaauauuuuaaaaauaaaucuaauauuuacuuucaaagauagguucauuguuucuucucccaagauaaacuuaauugaaagauguuauguuuuucuugugguauuguacauugugccuugauaaaguaugucuauuucaaucauauucuuauuuuuuaaauuaauguauaugcuuaccaaggcucauuauuauuuuaauuuuuuccaacuuuuagguuuagggaguacauguacagauuuguuacauauguuauuauuuuuauuuuaauaaauagauaaaacaucacucugguucgucuuucaggaaaaacauuuaucucucaucccuuaauucacauuccuucauuuuuuaaguuuuuccuaagaaucugacuacuguggcuaugauuacccuuucauuuuuaaaaauguuguuugaaaacuucaguguaaagcuguugugacacuuuaucccucuuugcaacuagcuacuaucauucgaacuagugugcucucuaugcugauacuuuuuuuuuuuuugacccaacugcuaaacacuaugauauuggccugggaaauauuaucaaaggaaguacuacuuaauaagguugaauggaagaauugauauuuauaggauaaaagggccuaggugaauggguuaguccucuaucuuucuauaucugaggaucugggagucucuguggggcacuccuuccuucuuuucuuuauuuuuuuaaguuacuuuuccauucccuaaaaaucaauucuaauguauuaaugcccucaucuaauaggccagagauaaaauugacuuucucaccauuuacugcuaagugauugaagaguagcauugcacuuuccauucacuccaagauagucacagguugauaguucuaugcccaugguauugagcaugccuggacuuugcuuuauuggguucuaugguuaauaugagaaaguagguaugauguuucauuagcaaaauacauucuuauaggucauaauauucccuauggauguacaaguguuuggaagcucauucuuaaaauaauuuguaaggccauaacaaccugaaaaauuguguucuuuaaaauugguuugaggccaagucaucuuuaucagaaagguaauggauacacuaaagaugaucauaauugcauuuuuauacccaucacuaaauagcuuauccucggagagaugugcuaagcccagaucucuagucucaauccuacugccguacccccaggcaccuuuugcuuuugcaguuuuccaaaugugccuggaaucugacuaguuccuacugaaccuuaaugauucugccugagcgucaccuccaagaagccaucccucuucaccccagccccucugcugagcuucuaacucagcagaguuagaagcugaggucauaccuuaguauucaaauacuaacaacacuauaucgaaguuaucuguuaacuuuaccuuuaaacuucuagcuccuuuaaaguucuucuuuuucuuggucuccucagaagcuagcacagugcccaguauacaauaggugguccuuaaguguuuucugaaugaacuguuaauuauauuagugaauauuuagacucaaaaagacuaacagggugauacaaaacuauaaaaauccugaaaaggagaugugcaguuauacugaaggaagaaaacaagucauaugauaucaagauagucgauaaaagguuaacaaauggaagguuuucagcauaucccaagcuaaacauuagucagugauuuaguaccaacaacccugagauguuggucuuuuuuuuuuuuuacagauuuuguccauuuuggaucagcauuucguaggcacgauguuugaaguuuuaaguggaacauuaaaauaguaguaaaucaaacaugugaggaaaggcuuagggagagguguucugaacucauacuuuguaguucuauuugggaauacaaagugcuacaauguggggacugaucaccugcagagcuucaugucuccugggcucauaggaaaugccacacuugaaauguggucaacacaacucuguaaggcuagcauuauuuucucaucuguuucauagaugagaaaauugagacuggcaucuuguggcaaaucacgagaccuaaagguggaagaaguuuucaaaucauuuugccuugcucuuuccaguauaucacacugcugccauuauaucacacuuauauacauauaaauauauauacauuucugagugguguaagcaaacaaaaauaugguuuauuauagaaaauacgcacacaucucaaauuguaaugauucauucuguaaacuacgacaauuauguuuuuaaagaaaaucuauugaggucaggcacgguggcucacgccuguaaucccaacacuuuuggaggccgaggcagguggaucauuugaggucaggaguucgagaccaucuuggccaacauggugaaaccccaucucuacuaaaaauacaaaaauuagccaggugugcuggcucgugccuguagucccagcuacuccggaggccgaggcaggagaaucgcuugaaccugggagguggagguuguagugagccgagauugagccauugcauuccagccugggcaacagagugagacucuuucaagaaaaaagaaagaaagccuguugaaauuaagauuugcaacacacuuguaauuuuuaugaccuugaaaaagucuaagaauuuagaacaaaauuagauaaagccuacaguauggguuugacuuugugcccugucuuaaucuguucaggcuucuauaacaaaauaccauacacuagguggcuucuaaacaacagaaauuuauuuuucauaguuauguaguugaugagaacuauuccaauaguucuagaggcugggaaauccaagaacaaggcaccagcaaauucagugguuugugcgggccuguuuccugguucagagauggugcuuucuugcugugacuucacaugguggaagagacaaaacagcucuuugggguauuuuuuuaaauaagggcacuaauccauucaugagaguagagcccucaugaccuaaucaccuccugaagacccuaccuacuaauaccauuaccuugcugacuauguuucaacauaccaacuuugagaagacacaaacauucagaccauagcauuccccuucucuccuuugccucaaauaagaaaggaauaauuguaauuacccuuucauuucuuuaauuuauacgaauccacacagaacugcacauacccuauauucccuuagcauuauuguguagcuugccccuauuaagugagucauuaugugaauauuuuaaacuuuaagagaauuucuggguccuucacuagagaaaggaaagaagaugugaaaaugaagaaguuguauucugggacagauggccacacaggccuguuccaugcauggugacccucugcccuaacauauuuucuuucacaugaucaguacuuuuuaacuauaucccaucacacaaaaguacaaccagggauugcguaggcuaacaggcauccuuuaaaaagauuccuggaugguggucauccuucaccuugcuccuggggguugaauauucucaagcuuguguccugcccaagcaaauguugagcgugggcuaaauguuaaucagugaugucugucugugggcaguuuaacuccagauaaggaaggcugucugagaagguggguggacucuaaaaaucucaaccaagaagucugaagaaagcucagagaauaguuaucagggaaagccacaaaggacuccgaaauucuuaagaacuuaagcaagaauuauuuuagacuaggaaguauagaaaaggagggaauuuucauuugccugcugugaucugcagcacauuuuucuuccugaagaggucaucuugaccuuuguguauccaguucaucuuccuaccuugggagugagugaaagagcuugcaaaauauccaccuacuuuuuuucaguuggguugaauacaaaggaauugcauagauccauagaaauauugccuuuuaaaaggcuaaauuucuggacauucgacccucacagaaauuucucagagggguggagaaaagaaauuauugcugcuuaucuaccaacaaauagacuucugcccuaaaagcagauggaauggggcaggguggggugauaagaaagaagcaaaagaggaauaauaauaauucucaaaugaaaugaagcuucuaaaaacuaaugagggaaacaaaaaaagcuuuuauaguuuaguuuggaaguguugggcauucuccucguguaagcuggucugaugauaacagaggagagagaauggagacguguggguccuuucuugcuuccgucucaaggaaauucaugguaaacuggaaagggcagaacacuuuaguuaagagugaguuguucccauugagggcgggagugaacauaagcuaguaccuaguugauuuaaauggguuguccaauuuccuugauucuagacauuaugaagcuauuuaguaucaggauguaucucauaaucaauauguguauuuaauaugguaggauauuuucucccaaaaacuuguuaugaauaacuggcucauuagucucuugauuauaucuuagaaugugggaaauaagguauuucucuucaaaggaguuauaucccagaucacugaagaccuuugucaauuaaauuguugaacugaagaauuacagugaaagaugcugaaagauuggaaguuguggaggaaguuacuaaaacuugaaaugagcaaaugugguuuguauuuccaguaagaggguggguuccacauacaguagaugagugaguagaugagguugauauuaauccuuggcaguacucuagaacaggaggucagcaagcuuucucugugagggaccagagaguaaauauuuuuggcuuugugggccauacaggaucuuucacgacggcacaguuccaucaccguagcaugaaagcagccauagacaauauguaaacaaugagcacaguuaugugccaguaaaacuuuauuuacaaaaguaauuggcaggccaggugcgguggcucacgccuguaaucccagcacuuugggaggccaaggaggccuuguggaucacaaggccaggagaucgagaccauccuagcuaacacggugaaaccccgucucuacuaaaaauacaaaaaauuagccgggugccuguagucccagcuacucgggaggcugaggcaggagaauggugugaacccgggaggcagagcuugcagugagcugagaucgugccucugcacuucagccugggcgacagagugagacuccaucucacaaaaaaaaaaaaaaaaaaaaaguaauuggcaggccagauauggccugcaggugguagguugaccaccccugcuauagaauaaauuguuaacuggguguuuugugaguacuuagggaacuggugugaacugggaaccaaucuguguucuuucagaauagaacuggcuggggcaguucuucuucauuguuuuucagcaagguuaauguuacacaagaucaaaaguguaguuuauuuuuacuucauugaggcacuuggcagaguauuucaaaagaagcuuuuguagaagauggaaaaaaaacacuuggaccacugcaguuagguaguuaacuguguggugccugcuaucuuuuaucugauaagaagcacugacagaugacaauauaagggagcaagaagcagguggaugcuaacagaaacacuuaguaugauuucuuuaagauguucuguauuuuaguuuuugagauaaaaagacuugcaaacauaauauaguaauaauauucugaugauaacaaacuuccccaauuuguaugauggaauucuauauaucaaaaucauacuguauuucuguuuuguuuuucuuuuuuuggagauggagucucacucuguggcccaggcuggagugcaguggcacgaucucagcucacugcaaccuccaccucccugguucacgcaauucuccugccucagccuccgaguagccgggauuacaggcgcaugccagcacgcccggcuaauuuuuuuguauuuucaguugagacgggguuucaccauguuggccacacuggucucaaacuccugaccucaggcaauccaccugccucgaccucccaaagugcugggauuacaagcgugagccaccacacccgucuucauacuguguuucuuaaagagcaccauaauuuauuuccuauugccccauuacugaaaaaagcuuaagaaccacagguaggccgggcgcgguggcucacgccuguaaucccagcacuuugggaggccaaggcgggcggaucacgaggucaggagaucgagaccaucccagcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaagaaccacagguagugaccugcucaguacaauacucucuuuggcucugaaauguucugcauuuuuaaucagugaauuuaaucauauaauggcaaguuaaauuuuugguaauucaaaccucaucuucauuacagacuccuaauaacuaacaagcuuauaauuagaauauucguaaauuguagacuaucucuccugggcucagugguuaaagcuuuauagacaacacaguauaaaguaagcccuuuaucuccaacaguuucccagcaaucucaacauuugggaccuagaaacaauuuaagucagcacuaaacccaaauuccucaggaccaaaaguuuuagucacaaaguucauauacuuuuccuuccuaagacucaaacauauuugauguuauaauacuuuuucacauuucccagaaaacaucaaugcuguucuagaauguaacauaaaaaagaauggaaaaaaaaaucagucugugacuaguaggucaaagagcacauggggcagcagaagcagguauaauugaaugaaaacgugucagcuagaacucaguauuuuaaggaacagaaggcucagcucaaucugaccugaacaagggagagggaggggaauguggagcagggaagagcugggauucuuagcaauuuauuagcuucuauaacugaaaaguucagaaaucuggcaaguucccaaugucccaacugucaccagguugaaguaccugguucucccugcucugacuucaugguguuggccucacccucaguuuuacacugugaccuucagcagcucuucucauuauguuagcgaaacagcuauagccauucaaacccucacaccuucaagagaaccuauggaagagaaagaaagccuuuuuuucccagaagccccagggaacaucacuuuugcuuucauuggcucugauugguuuauucaccaauucugaaccaaucauuguggccaguagguauaguaugcuaauuggcuuaugucaaucaagacccauccccagagcuggagguagugacagucucacugggauugagacagggaaugggguaagacuguuuucucaaaaaagauuuaggguucugcucccaggaagaguagugguauaaaaugccagccaucaaagagcuauguacuacaagagcugugagaagugagaggauagaagaaagccaccaaggaggagauaguggauaguccagauaaaacaccauagcaaucugaugcucacaccugccucuucagcuuuuaaagcaucaccuaaaugauuacagugcacugcugauguucacagucacaacccugagacaucuaggaaagauuaaauuauguuugauuuacuaaaacagggaagaaguuaagggguguuagaaagguuuguguauguuuuaauaaauaacaauguuuuuaaaagaaccaaaacuaagccaaauggaaaguuauuuuuaccauaugaggcuuuaaaucuuauauuuucuuguacucagucucgaucuguaccucauuaaagggugccauguguuugacugaaauauuuuuaaaagcuauguuuuagcuaugcucaguuucuaucuuaacaaaggaaguuucaauuguugacgaaaauguuguuuuugcuuuuguccagaaugcauacacagccacagcuaucaacagcaccaacuucugcaccucagcaaaggaugccuuugucauucugguggagaaugcuuugcgaguggcuaccaucaacacaguaggagauuuuauguuauuccuuggcaagguaaaaccaaguauuuuuucugcaacauacaguaaaauuuugcauauauuuauuugcucuuuuauuuuaaaaauauucaggccaccaaaaaacuaaaaguaauauauagcgaguacuuagaaagcccuuacuguguguccagcauugugauaaguacuugacauauauugugcucauuuaauccucacaauaaauuuuuaagguaaguuccauuauuauccucauuuuacagagagggaaacugaggcauggaaaggcuaggucaugugccuauguuucucuuucuguguuguuuuuuuguuguuguuuguuuguuuguuuuugaaacggaguuucgcucuugucgcccaggcuggaauacaauggugcuaucucagcucacugcaaccuccgccuccuggguucaagcaauucucccgcuucagccucccgaguagcugggauuacaggcgugccaccacgcccggcuaauuuuuguauuauuaguagagacaggguuuccccaugucggccaggcuggucucuaacuccugagcucaggugauccaaccgccuucgccucccaaagugcugggauuacaggcaugagccacugcacccggcccucuuuacguguuuugaacuguaaagaauuaggaaauagucuuccuccagguuagugguacugcaacuggagccugacugccuggauuucaguucugacucuaucacugauaguugugugaccugggcagguuagauaagggaaucacucugugccucaguuugcucaucuguaaaauuggaauauaauagugccaaacuccuagggucaugagauuaaugcauuguuaauacauguaggguaucuaggagagugcuugacacauuuuaaguucucagugaauguuaguugucaucauuauuauuacaguauuauauauaagccccuucaaaauagagcuguuagagaacgagacuuauacuuuccuuagaagugucgaacaagaggcauuuuauucuauacuauuaaaauacugcaaaauauucaauaacauaauuagauuucauuguaucugaguauuaaaccauaaaaugcucagaaaauuuuuuaaauugaggaaagagaaaggcuuauacuaccaccacuauaacuaaauaacuuauuucuauauaauucuucccauuuuuuuuuaucggcuuguauuucuauaguauaacaaucauagcauacguaccuguuugucccgcccauuucucuuuacauuacaucauauacauuuuccaucuuguuuugauaaucuucacaauuauucauuauuaccaugguaaauauccaccaaauacuauuuguaaacauucucuuacuauugaacccuuagguugcucuagccaacuguauuuuuuaaguguuuuuguaaagaaaauauguuuggcauggagaaguauauauagcauugugugugaugaagugggucgggucucuacagcugauucagaauucaccaucuuuauuuuuguuuuuguuuacguauuuauaauuuaucccuacagcuaagaaagauaugaagcaacuuagaauaaaaguauauauauguauacacacacacacacacacacacacacacacacacacuacacacacacacuacacacacugcuuuuuuuuuuuuuuccagauggaguuucacucuuauugcccaggcuggagugcaauggcacaauuucggcucacugcaaccuccgcguccuggguuuaagcgauucuccugccuuagccucccaaguagcugggacuacaggcaugcaccaccaugcccaucuaauuuuuguauuuuuaguagagacaggguuucuccauguuggucaggcuggucucaaacucccgaccucaggugaucugcccaccucggccucccaaagugcugggauuacaggcaugagccacugcccacggcguuuuuuacaaagggaaauaagaagccauuuagaggaauaagggagauacuaaaaguggcaauauuugaugacgaugauuuuaguaaacucugauuaagauacuuuggguaccaggcaaugagugaagggcuuuuguuaaguguuacauuugguccuccccuguaaggugagcuacuaguauuaucuuugguuuucucuacucuaaaguuuagagaaaaauuaaauuggccaaauuuagagaacuagaauguggccguucaaacucaggucugucugacuucuaaguuauuaaucacugugugcuauaauugccucagcugacauuaaauuuguccuugggccuuuuuaaaaauuuuuuuaaaagccuuuugacucaguaauucugagucaaugauaagccacuccugguaauaguaacugcaacaaauacagcauuauuuauauagugaccaauuguaaacaaucugaugccuaacaauagagaaaugguugggaauaauagucaauagacuguuauucaccuacuaagccauguuuuuuauuaagaguuuacaauaugaagaaaugcauauaauguaauaaaugaaaaagcugaguaaaacuacugggcuuuaguaguguuuaaaaauguuuauaagaaaaagaauggaaaugaauaucucaagauguuaacaaugauugcuuuuggauauugaaaauauagauaauuccaaaccccuaccccacuuuauuguaguaagaugauguucucuauauugaguaugcauuauuuuuuuaaugaaaaauaaaaagaugaguugggcgcgguggcucaugccuauaaucccagcacuuugggaggccaaggcgggcagaucaccugaggucaguaguucaagaccagccuggccaacaauguggugaaaccucaucucuacuaaaaaauacaaaaaaaaaaaaauuagccgggcgugguggcgaguggcuguagucccagcuacuugggaggcugaggcggagaaucgcuugaacccaggaggcagagguugcacugagccgagauugcaccaccgcacuccagccuaggcgacagagcaagacucugucuuaaaaaaaaaaaagagaagaauauaaagaugauaaaacacaauguucuaaaauuggcuuuuuuuagcagccuagugaccuguuaaaacuuuuuauuauaucuuuuuauucaugucuuuauagagugucuacuaguaaugugguaaggacuguuacagguccugguuauauacugaucaauacauagaauuuaaaaucuaguagagggccgggcacgguggcucacgcccauaaucccaacacuuugggaggcuaagguggguggaucacuugaggucaggaguucgagaccagccuggccaacauggggaaaccccgucuccacugaaaauacaaaaauuagccaggcauauagugguacaugccuguaaucccagcuacuuggaagcugaggcaugagaauugguugaaucugggagguggagguugcagugagcugagauagcgccacugcacugcagcccggacgacaaagcgggacucugucucaaaaacaaaaacaaaagaaaccuaguagagaaggcaguuuuguauaccucuuuucacuugguguuacauuaugagcauuucuuguuuucuuaacacuuuucuaacuaugguuauacaacuguugugucauuuauuuaaucaauccucagguuuucuguuuuuuacaguugagcugugcucaauuuuuuacuaaccuaaagcuuguauuuguguguaaaucuugcccacaucaaucuuuauuuccugagaccagaauccuagaauuagaauuaauuaggguucuugaugugcauugccagauugcuuuccagaaagauauauuuuuaauaauguaauauuuauaauauuucaaaugacuuuaaaaaccauaaaagauaaauacauuuuuuuaauugagaaauucagaaaagagaaaaauaagaggaagagaaaucuucuggguuucuaacauuuuaauauaaauguucuuuaguuuuucuuuccuaaaaauauaguucuggucauagaauacaguaaaucuuuugaaaagaguuuuucauuacaauucaauggcugcuagcaugcagaauuuguuucuaaucagguaguucaacuaauagaucauaauaaacauuauaaaacaugaugccagaaaugaauuguucauauacauaucaacuugaaugaaucuugagggaauuaugcugagcgaaaaaaucuaaucccagaagauuaauuccauuuauauaauagaaaugacaacagggcugggcucuguggcucacgccuguaaucccaacacuuugggaggccaaggaggguggaucgcuugagcccaggaguccaagaccagcuugaacaacauggcgaaaccccaucucugcaaaaaaauacaaaaauuuuccuggcaugguggggugcgucuguauucccagcuacucgggaggcugaggugggagaaucgcuucagcccagaggcagaggcuucagugagccgugaucacaccgcugcauuccagucugggugacagagcaagacucucaaaaagaaaaaaaguaaaaugacaagaguauggaaauggagaauggauuugugguuagagaucggguugaggaggaggggaaauagcuguaaaauaacaaagugaaggguuccagugaugauggauauauucugcaucuucacaguaucaaugucaauaucaugguugugauaucaguaugcuauaguuuuacaagauguuaucauugaaggaaguuggguaaaggguacguggaaccguucuacuauuucuuacaacugcaugugaauucacaauuaccucuaaauuuuaaauucaauuuuaaaacugugaauuuaaaaauaaaaaaaagacaucauuauggguuccauuucuaugguacucuaauaguuuuuauggaaugugaauuagauuuguaagggaccuuagcucuucuaguuuagugacuuguaacauauggucacuggccaauaggguccuaaagguaagaauagagguuuauaauccaguuuaaauauuuuuaaguauugauauuuguccuaauaaagcuaucccaaaaccccucaaucucaaauuccuuugcuucugugugaaauuacuuuacuuccauuugguaauaucuuuucucacacuaauuauaucuucuaguugacaauuuauuugacuuggguuaauaaaaauugagaauaugaauuauuacuuauaaaugcuauuuuauuuguaaauaauaucuuucaaaauguagguucucuagagaaagagcaucauaaauguugcacuuaugauggcaagaaaagaaaggaagggagagagggagaaacauugccaggcauugcauuaaauacuuuuagaaugcuuauuuuaacaaucgugggauguauguauuguuaugucucuuuuaaagauggaaaaacaggcucagaaugguuaaaugaacuugcuuagaguuacaaaacuaaguacuaauuccguaauucaaaucuacaucuuucugacuccaaaacuaguuuccuuuccuuccugcuucccacauccuaccuaaagcaugaaucucuucuacugcauuccaauaauuuauccucuagaacaggaacgucuauuuuuuuuucuuuuuuuugagauggaaucugguuuugugcccaggcuggucuugaaguccugggcucaagcaguccuccugccucagccuccugaguagcugggacuguaggugugagcugccaugcccagcuagggaucucuuaacuucuaaagucaugcgcccuauuaagaaaaaaguuugaucacaguuguucaauauauuuacauuuauuuaucaaauauuuaucaaauaaauguaaauauuuauauauauauagcuguuacuaauauaugucuuauaaagcauacgaaagaagacauuuuaaauguaugagaaauauaauagaagucccaggugauccuguuaaauacucccuaggacguggguaucuccauccauguggaucuccauccaccauggagaucacugauauagaccaguacuucuugagacauagucuuuaucagcaccugggauacuuuuuaaaugcaaacuacugggcuuuaucauggauccaaccaaccagacucugggauuagggcccaggaaucugcauucuuagccuuucuacaguuugagaaccauuaauguaucuguuugaauaagugcauaacacucuuucauuauauuugggaauaacuacuacauuuuuuuggcuaaacaucacuaauuguugaaguuaccuccugcaugagaauaucuaaacuuccaucucaccagcuuuuugucucagcgucuaguuuguuugagccauaccuuuuuucuauaacuaacuuuaccauuucaaagggguuuaacuuuuaauggcauggugagagcaugaagaaccucagcccuccaagagggugaaugugcaagauuuggagaguauaggaaauaacucacucuaaaauugaaaccaggagaguggaagaaaauugaaguaaugaccaggcgcgguggcucacaccuguaaucccagcacuuugggaggcccuggcgggcggaucaccugaggucaggagaucgagaccagccuggccaacauggugaaacccugucucuacuaaaaaauacaaaaaaaaaaaaauuagccagguguggugacgagcaccuguagucccagcuacuugggaggcugaggcgaagaauugcuugaacccaggagguggagguugcagugagccaagaucaugccacugcacuccagccugggcaacagagcaagacucugucucgaaaaaaaaaaagaagaaaaagaaaagaaaauagaaguaauuaaccaucuauggaaauaaccccagaaaaugagaaagaaaaaaaauggaaguaauuaaccaucuauggaaauaaccccagaaaauaagucacuauaagagaagauucauaaguguguugcuacaaaaaugguggggagucuuccaaagcuugggcagacccagauuugcucccuagaagcaucugagagagggaucaauuuauagcuuaaccaauguaucaucuaaugcauuuuaacuccgaguuaagauaauggugaaugagaaaugccuugauguugauaaauauuggagaaaaugccaaagaagaauucauggucugccuauuauucuuaaugcuagacaagaagaggcugccaugauucuaggggucucuuuuuucccuuuacuuaaagccuuauacaagacaaaauaaagagcugggaaagagugugucuagaauucaguagaauccauuacugcuguggaucaauauccaaauauuucugaguuuuuaucugaaaagagcacuggaguugacaucauaagaccauuauuugaguaggaucuguucuuuuuuccuacuuuuaugaccuugaccuuggaucuacucuuuuuuuucuacucaggucggguggcaucuguaaguguguuuccaaggcuauaaaaugggaugauaauauuugccauaaaccauucauaggguuauugaaaagcuggaauaaaauguauuuuaaaaaccacaaaaaauuuaaaaugcugcaugugaaauaagcaucagagugggugguucuugacaauaacuaaauuggcuauuucuuuuauucuuuuagcauggauguuuuuggcaaccucuuucuucacagagaguccaaauauacacuucauggcaaauuauauuuaccacauauucuaugugaaauaaaauacgaaacacagaaaaaguucuaagacuauacauguuuguugcagcauuauuuauaucugaaaacaauauaaaucucuaacaguaagagaaugguuacauguauuuuaaaucacucauaaaaugaaauuauguagcugaguaaauaugaagcauuuauaaugauacuucuauguauauuaaugaaaagcuuauagugauuuguuuauauaauacuauuucauauaugugaaaaugcuuagaaaaaauacauaccauuacacugaaauaucacuuuuuuucugagugcuaagaguuuguaaauuuuuucuaaaauaugcauacauuuaucuuaaaaauugccacagauucuaaauagauuaaguuuuagggugcagcauagcauuuggaaaacuuaauuauguuuaaaccagaaucauuuaaaguaugauuuuaaaauuuauauuauaugauaagcauguauaacucuggguguauaugagaauauguggauuauauuuccucauuugagauggaauggccucaugcaaccaucauuuauaaauaguagaauuuuaagucugcaaauggugaaaaaagaguggcuuucuucaguaggauauuaaauaugaucuuuguucucucugcuucaggugcugauagucugcagcacagguuuagcugggauuaugcugcucaacuaccagcaggacuacacaguaugggugcugccucugaucaucgucugccucuuugcuuuccuagucgcucauugcuuccugucuauuuaugaaaugguaguggauguauuauucuuguguuuugccauugauacaaaauacaaugaugggagcccuggcagagaauucuauauggauaaagugcugaugguaaguacuucaaaugccguuuccuauuuuagggauaaaaauaccaauaaaaauauuuuguaaaacauucucuauauuuaauucacacuauaugcaacugaguaauuuagaauuaaccccauagcacugacucauaaaugagguuaaucuaggguaagucagggaggacggcuucuuggcauggacaagaucauuucagauccaccuagcuagagcaguacugguuaauaguccuaaguucacccuauucuugcugccccucucucuguaguuagauagauuugaauugacuuuuuaaacuagcuucuagccuuuuccugaaauggggcucaaagacaaaauauccuguuucccagguccuagugccuaccugucuuucucuauccaccacugccccaaacauuacugcugucaacccugguuaaaacucauuaucuuaaauaugguaggccaaauugaaagcauuuugugaugaauaccgauaacagacccaugacugguagaguguauaguuauuuauuagucaagaucugaaccuuuacacagauauaugcagauuuuucauauuagaaccucaauuaaauuucuuuaaaauuuugaaaaccuuauuaaaugguuuaaguacuguuauaaucaguguuaaauguuaccaaaguaaagaugcuuucuaaauaauaguaguuugcuauuaagcugugaaauauuucuaucucaaaauggguaauauugaauacuaagcauuauacauugaaauaacaagucauuuuccaggagcauauuuuauccaguuaaaucuaaaauaaguguauuaauaaauaagcuagauuuuuuuuuuuuucuuuuugagacggagucuugcuuugucacccagacugcagugcaguggcauggucuuggcucugcaaccucuaccucccagguucaagcaguucucccucagccucccaaauagcugggauuacaugcaugugccaccacuccuggcuaauuuuuguauuuuuaguagagaugggguuuuaccauguuggccaggccggucuugaacuccuguccucaggugaucugccugccucggccuuccaaaaugcugggauuacaggugugagccuccaugcccagccuagauuuuuuuuuucuuuucaauagcaagaauuccaaaugauuuagcugaccuauuuggcacugauuuucucuuuuucuggcaacaucagcuaaauucuggacauuuucuuaaugucuaaacuaauucuaacugguuauuuucuuaauggaauuugaucaugauuauuguaucucuuuugugacuaaagcauuuagaagaguguuacuguuuuuuaagucacugaucaaaagcagaguaaaaaauaacuguuuuccacccuucaguuuucucuguaggaauggugaggauauuuaaugaagaaguuccccguaaacguugacagaauagaaauguucccuuugggcacauucccauuucgacuacuacuaaccauagguucugguugauacacccugucuuccugcuucaugaaguaaugucauggucagauugacacuuuuuuuaaaaagaguaguuuguuuaugguuugguuaagaaaaaaagcauuaugugcuuagcaguaucaauguguucuuuuaccuucuaugguuauuuaaaaguggaggcuuauggaguaacguguucuuguuguuucauuuaaccuugauauagaaaaaaacaacaacaacaaauaaaaugauauucugaguaugagaaaauagccucuuaaaaauguuagguauuuucucuuccagguagaacuaacauuaucucuuggagccuuaguaagauugucacaaugaauggauggaaagaagauuuuuuuaaucagcgaauugcagaguccauuucuacaaauuuagcaacucucaugugugauacuaaacauuauuuauugcuauguuuuuaagccauccauuuaccaagauugagucaaaaauguagauguucuuuagaauucaucuacuaacaaaucugaaaggacccaagaauuuauucaauaugguccauauuuugcaggaguuuguggaaaacaguaggaaagcaaugaaagaagcugguaagggaggcgucgcugauuccagagagcuaaagccgaugguagguggagaugaggagguggccgcccuccaagaauuucacuuucacuuccucucucucucugucuucacugacugcacuucuucaggagaagcuuuuguuaucuguaucacgcaggacaugcugcucuuucuguuugugugcuuacccaucacuuggauggcagaauucuugucacaacugagaccaccuucuauaaaaguaagcugaaaggaacagcauccucgucagugcucggcaggggcggguaggggaugaugguuuuuucccuaagguaaaacugcuguugcucuuguuuccuuuuuaacugucaguguuuggcuuucaucagacugaacauuuugguguacacuugaacugacgguuugauuuuuaucauuuuggaaggugaucauagcaauuccuuucaacuugcuaaaauucauacucccccuuuuaaaaguaugguucugcuuacauugcuguccuuuucccuuggcugacuuuuucuucuguugccuagguuguacuuucuuuguuucuuaagcuauuuuucaguagcaaacaaggcuguuuucaucaauacccacauucccacucaguaagacaaucuagucuucucccaguuuaauugugagauggauaaauuauuucugguaguugauauuauauauguauauguacacaaauauaucucucuacuccacuuuuauuugaaaaaagcagcuuaaugaguguaagagaaccuugagcugcuuuucacauggauauugucacuauagcauagaaacagaugccucuaucauauauuggucuaauuacuuccuaauuuaaacacguauuuuuuuaaauagcauguuuauuuucaaauauuauauaauugucugcauccuuaaauaauuuuaaacaauguguccccugacugcauauaauguucaaaagugugagguaaggacuuuccuuucugucuucuuuacacuuuaguaaaugauuugauuuauagcaaguuuguccaacuugcugccugugggccgcauauggcuuaggaaggcuuucaacacaaauucguaaacuuuauuaaaacaugagauuuuuugccuuuuuuuuuuuaagcccaucagcuauccuuaauguauuuuauauguggcccaagacaauucuucuuccaggauggccuggggaagccaaaagauuggauaccccugauuuguagguuuucaacuuuaaaauauaugcuauaaaauaaguucauuuaaguaggcuaggcaugguggcucaugucuguaauccuagcacuuugggaggccgaggcagguggauugccugagcucagcaguuugagaccagccugggcaaaacggugaaacccugucucuacuaaaauaccaaaaaaaaaaaaaaaaaaaaauuagcugggcauggcggcgugugccuauaauccgaguuacuugggaggcugaagcaggagaauugcuugaaccugggaggcagagguugcagugagccaagauggcgccauugcauuccagccugggcgacagagcgagacuccaucucaaaaaaaaaaaaaaaaaaaaaaauauauauauauaugauauaaaauaagcucauuuaauuaagaguaaaggaaauagguuuauuuuuggagggaggcagggaggcuauauguauauucaaacuaaucgcauauucaaccuaaguuaaagccucaauaaaauauuuagauauaaaaccuuuccucuguaacccuuuccagugccuauuuugguguuacucuuacuuaauagcaugaauaauuauaaaaucaaauuuaaauguuuagaaucccagagcacagaucacucuaguacccacauagcucugaauuuuaaguuugcaucaccuagacaugauugcuugggcagauggaggcacaccaguaaucuucccaucagguuccaugccugcccuccacaccuuucuguaucccucuuauuucacaaaagcugaggagggcagcaguggagauucugccaacccuauggcaacauggagaaaugaggaaggcuuccuuccuucuacugcuuggagguccuaauuguucagcaaaucgauucuaagcccaaaacuuaacaagacauaugaaaucuuaaaauauaaaccaagcuuuucccccuuuucugucuuucuagugauugaagcuuucauuacaucauucaguaauaagcauuuaaagaaagggagaaauauuucgagguugaagacuagguaauguggccaugaguuggcacagauuucuauaguauucuuuaaugaaugguagaugaauuguaguagaucagaaugcaaguauacuuuccuuaccuaaacuccuaauuuauagguaauaauccugggagaauugcccagguuauguggcauucuaccagaugccaaauauuuuagaaagaguuguuuccuauuaguauuuucaguuuugaaauagugucccuuacuucaaacaaugcauuaaaaucuuuauuuaauuuuugcuuucauuuuaugcuguucaucaguucauugcuugcagauuaauggcaaaaacccucugcugcaucccaaaauacaucuucuaugugcauuguucuggugcuuuggacauuguagcauugggucccuaagaaugauguuuuaaaugguuaaaaaguucccagaagacaagugugaaaugcugcucacagaguaguuuuauuuuuucagcaccuuaguaccuucuuuauuucucuuccauaguaugcaugauuagaguuggccccuacuaacaccauuccuuugcauguguuucuaaaaaaguauuucagaaauuucuacugaaaguuuggggauugauagaauuuaggauugcuuauuuguauuugcuugauauaauucacauauuguugcuguagaugaaaguucuauaaaagagcaucaugccuauuuugcauuagcucuagaaacauugcugcuguuugaauucacuaucuuccucccuccucaaugagauauuuuaauuuaggcuucauuuuuagccuauaaaauaauguucaguaaaaugagguuuuauauuuuccuuuugacagcagaucauugaacuaaacaugagaacuuccgguuuuguucuugaacuuuucccugagagaggcucgcuaguuaaggaaacuuuaaagauuuaugaauuuuuuuaugauucucugaaagugauuuuggaaaaauguaccaaaagugaugaagagguuuaggaaagagauuuucugacugucugcuugcuaucauauaggaaagaacuuaaagagaaaagggaggaaaaauccuagacacuguaggaacaugggccagagaaguaugcucuguguaucucagagaugauccuggauaaagugugacuuucaacauucauaagaauuucagcuccaggaauucaggggagaaggauucucaguccauuuugcugucuugcuguuugugaccauguguauauuuguaacaucauucaugaucuccuuuuaaugguaauugucuaagauuauacucuguaugacuuuguuuucuaggcuucgggagcaaguucugcuugaaccuagccgacgguuauggaaacccauugacauuccaaaacaauauauacacauaacuauguauuuguguguguggguguguguauauauguauauguauguguguauauauguauauguauauacacacacacacauaaaucagccaaaaucagagaaaaggaacagggauuuaauaccuuuuuuaugcuuauuuuugucaaacauguacuccuuucauacggguggcuuuuacaaggcaacuuccgucauuuaauguuuucaacuguaauugucuuaauggaaauguuaaaauucauaucugauuaacauuuuuaauaacuuagaggagauuuuaacuuuauuuaaaaauagguaaaauuauuguaccuaauuaugucuaaaguuuauucagggguaauuucccugaugucuguauaaaaucaagaucuuauuuuacugaugcauaaguccuagugggucaagacuaggcauaugcuuucagauaaauaaggaauuacuccaaucaguuuuccccaaucaaagaagccaugucauuuuacuuuuagaaacauacaauugggcccaauaugggaauuuucauaauaguucauacauuugucagccaacauuaaaagguaaccaacuccucagguauuuguaguuuacccuaacgcuucuuuaaaagaaaguagguaaaaaaagaaaaggguagauaaucuuucguaugcaaacuuuucccuuauauuuugucuuucuuuccuuuuugacuuuaguagcauccuccacacauuugugugccugauuugaaaggaagcuggggcacccagcgaguuuagccuuuaaguuucuguguauugauuugcagauuaaguaaugcugggaggaauaaagaagggacagaaacauggaacauaaagcauugaaaauuccggugcuugggcuucggcuucagaguaacgucaguggcuuaggguuaaacggccauuuuauucaaaugcuugcuauacaaucugaaaacacacuggcaggugcuccucuccuuggcaauucauugaguauccagaguucuacgauguuuaacugaagaauuggcuaauguuuugauccuccagugugacuguuguuuuuguuuggggguggguuugggguuuuuugcuuuuuuauuccugaagcuuaccagauaugaauggcuaauacuccauuguucugcuuguuguaauggugaaugcuuuaagaaaaaaaaguguaauuugcuaagaauaauucaugaucuguuuaugcgauaacuccuuuuuguuacaauuuuuuuaaaaaaagcuauuuuuguuaauguaaaguaaauauuucagagcaaauuuuuuaaacuuauugcacuaaauacaggcucuguacaaaaaaaaaaaaaaaaaaaaagccucagcauuuuaucauuccauggaaggagaaucuuuugaaagaaagcauugccuccuaccagaacuagacagugaauuagaucgguauuauggaaaugcauacaaguaaugucacuagggcuuaauaagcagccguuugcuaaugugcuuccuuucaaaggguuggaccuuuaaauugcugcaaaagguaaauuguauuuuuuuuuaaguauugguguucuuuacucuagcuaggcuaaaauuugcuaaaugccuugguuucuuuuaaaaguucauguaauauuucugauuuuucagaauauuugcaauaagagucuggauuuuaaaaaacacaugcauacacacaauuaagagcucaugucuuagcaagaucugggaaaccaacauugcgagaguagcuauuuugaaagaauaauucuccagaaguuaacaucuaauaucuaguaucaccaaacaguaucgcuguucucuuuuauucauuugaaaugaauauaauuauauaacuaacaauuguccaaauagaugagagagcaaaucaugugagaaaauucagaauaccaucuguuucauagccgcacagauuuuggacuuucacaaacauugggaacuaaauuuagaauuggcaaaagucuagaagauggguaucaaaacagaagacauuccaggagcuagcaauuuuaagaggugucccuccaaagugaccugauggaaguccugaacuuggaaauuagguucuacucacuuggacaucccugcaucauggacuguugcugcucccuguuccauaugcucgcaaucucagcuauuuggaagcuaccaggaaugcuuucuaauuaucauuugcaacuagaacuguaaucagaaagaaauuuuguauuuuuguauaacuugauugugugccauuuuauauaacagguccuguuuuacaaauaaauuuuguuuuacuaacauuguguuuagaaauuauaaucuauguguaaccaugucauuugaguugcaaauuaauugccaggcuguuuuccuuaaguaaauucaugugccguguagaaauaugcagauaugcauuacacaggcacacacagagagauauuuaauauguggaauaucacucuuucaugagcuuuauuccuugauuaauuugauaaagccucacagaggauuuuaagcaauauuuaaauguguugagguuauguuuggauauuccugcugccucuuuucauucauuucaagucauucuucagcuagcuaugggcugccuuauugcuauucgcucacugcuuccaucuucugcccaagugagaagaauagaugaagaacagaaauuucucugugaaauguggauacccgaauaauuucauaaaucauugauucuauguggugguuuuugucuucuucuguggugaaucuucaaaacuguauucaggacucauauuucuagaguuuuaauugggguccucuauugucaauuguaguagugaccagaguaucgugguuuuugccaucagauaauuaaggcucuggugcauaauuuagacuuucuaagcuccugccugaagaauaaggucuuccauaauauggaagagaaaaguuauauuucaguguaaauccaagagacccaucuucuaugagaggcuuaccagugcauuaguaauaaaacauuagcaauuuagcuagagcacugagauuguauaauccuugcauggaugagcagagcucaaagccaguuguuccuuuaaagcauuuaaugcaauggcuaauguuuaggauuaaaguuuuuauuuuauccuauaagauaauuaaguccuaagucacuacaacuuaaguagcuuaacuguauguugguacccaaacuuuuucuauaaugguuaaggaggaggcacuuacugaguuuauuuuaaaguuaugcuagaaauguuuuucuuuuguagagaugcucucucucucucucucuuuuuuuuuuuuuuuuuuuuuuuuuuuccgugagggcauuaggcugcugauuguaaguuauuuccaauaccacugaucuugguaucugccaagggcuuccuugccuucccugggcaguuuuaggauuucacccuaguaggggguaugaggcacugaccccuuuauucuggacccaaacugcuuuagagcagaguuaauaccucucccucccucuucaaaacagcuacaggaacugcaggcaccacauaugugugaggccacaucacugccccugaggcuucaacuauuuccaccaugcacuauuacuagcuacuaacagccauuuuaagagaucuccuagccugcaagguagaauucugggaucaguuccaaaaccagaacugccaguaauggugacuugaauauuuuauuugauuuuuggucaguaaccuugucauuuaaauuggacuuuccaauagccuuaacauggccucugagaaguuuccuccagaaaggucuuuaagcuuucgcuuuucaauaaguaaguucuuuacugcuuuucuacugcuacuuuaaaaaaaaaacaacaacaacaaauaaaacucucagagucuggaggcuuaucagugcaccugccacaguuaauuucuguauucuuuucauacauuccaucugacacauacgagugcacuauaauggcuugccuagaacugguaagaaguggucugugaauguauauugaaaaaauguggguucauaaguaaaagcguaacgcagauauuuguguauucuguauucacagcguaggcugccuuuugcuuuaaaugcauauucauguaucuuugugugcuaagaaugcauguuagcccuuuugaaaaguaggcacuauucauacacaguagcuucuuggaauuaacucaucuuuguuaacuuaguggcacauaguccaaauuuuuaaaaagcaagacccuugaauaugccaagagaaaaucuaaagcuagcaaacuuaaaaaacaaaacaaaaauuacacgucguguacaguuaugaauuuagaauagcacacuuuuuccauucagauuucauacauuugagccaaauucuuauacuccauguuuuaauuuuaaaaggauaauuuuaauccaagauuuaaaucuuugaaaauaucuuucuuauagaaaacuuuaaugcaguuuuuaaacuuacugauuucuguggaaaaccuuucuuuucuauagaaauacuguagugcccuuucuucccaucuugauuuuguacauguaaagacaaaugaugauucaguuucaauauugcaugaacaauugccacuuuguaaauuauauggacagaauguguucuaaggaaauucguuaguaaauuugugaaaaacaugugagauuguucgagaccuauuaggcuauucuucaguuuugaugcucaguuuuacaacuuaaaugauuuucuccaggacacggagcucagaauaauaaagcuuuuauuaauggucuagugaagaucuaguugaacauggaaacauuguaauuuacaaaugucucagaaauuucucacuuuuauuugcuaagaccugaauuuaauauuugauauucaaaaacaaguuauuuugaagagacaaugggucucuuugagcuuaagaaagcuauggacuaucuuuccuucaaaugcacaucacaugucugugaacacucaaaaugcucauagaauuucagggcccucagacggccagcuuccaccccuguacccccucaggggcuaaugaacccaagucaaaaggcugcucuaaaguuguucugauaauguguuuugaaaugaggaagugauuaggccuccacuagagauacuuuugagaugaugcuuaccaccuucugaccuggaaucauuuuuauaacuuaaagacuuuauguaauuuaguagcagguuagggaauagaaaccacacuaaucugaaggaauaacaagaugaucaacacugaaucuucaugacaguaagauuuucuuuccuuggagguaugaggguguguauguguguguguguguguguguguuuguguguguguguguguguccuggcgguuauuugggggcaagguaccagauuauuugcagugagccaaaaaaaaaaaaauauccaagaagaaauaaauagggaauccuuguaauuaauccaucuaccaaaacacuugauucuuuuuauuguagcucagcuaugacauuaugacauuauguggcuuaguguuaucaguauacuacugucuuaaaauauauuugucaacauguccaguuccaacaacaguugaagaugaugauaaauuagcaaacucaaggguaguccauaguuggcaaaaaauaaauuugguagaaaguuggaggagcagaugcugaagguagaaaugcaaaagauguuuuuucuuccugcauaaaucacggagguguguucuguuuuaguguuuuccagucacccacuagagcagcuucagauuccucugccaauagaacuccacccccagucccuuaccuacucuaucuucuuuagggaagcauguggauuucuucacaucugcaccuuacuauuagguaagggugcugcaucuacauggaaggcucccugggcccuugaaaaagcaggcagaaacucaucaagggguuugaaguucuugugaaauuugaucccaguggcucaugacuuauagucaggcaucaaaccauuuccuacuuuuucaggcugaagaaaguggaaauauaacuggcuggugaagaaaggagaaaagucagcccccuaccccaccccacacuccuagaaaaguuuggggguuuuuuuuguuuguuuuugguguuuuuuugagacggagucucgcucuaucgccagcuuagagugcaguggcucaaucuuagcucacugcaaccuccaccucccagguucaagugauucuccugcaucagccuccugaguagcugggaccacaggcaugugccaccacacccagcuaauuuuuguauuuuuaguagagacgggguuucaccacguuggccaggccaaucucgaacuccugaccucaggugauccacccgccucagccucccaaagugcugggauuacaggcaugagccaccgcgcccggccuagaagaguuuuaaugaaccuuccacaguaguaaaugcagagaccacugguggaaauucccauguuggauagaaaagggcguaaguccagucuaaguaucuaaaugugauaugcccuuuugucacagaaguguaagacuuaaagggaauauucugaccuucguguaugaaucugauccacccauccugucagcuaggauuauaauuugaacugucguuucaggagcauguguuaaaucauaugaguaaaaaaaaaguagacauugaaaagaagacuugggaauaauugggcagauagaauggguuccauggaucauucuaguugccacuagaaaaugugagcuccuucuucauuuaccauguugauaauccgguggugacuuuuuuuuuuuuuuuguaaauuguauuagauaccccacaggaaugugacaauaauaggauagcuuugggggcuggugauuugaaacagggacuauuaaguagauuuucccccauccucuagguuccuguagucugugcucagaacuugguuuuuggccccuauuguuuuugccuauuuugauuuucagagaugaucacauggggacaguuaacuuuucuucugcuguguugccuuaaugcuacuagauuguguuguguuguuggaguuuucugacuucuucccuauaaaaagauacugagagcuccauaaugaaagaaguuguuauacuuucucagaauauucuggaccacugaaugcacuucuaauagagcuuuaaucuaaagaaguuaguucagugguuauuaacugauuuuauuacaggagaaaaaaacuuuaacaaaaaggcagggagaaaagugugaagggcaucaagcaaaaugacaggggcuucaaaaaacaaccaaagacaaaacccuaucuucugaagaccaaagguccaacuuuacuuacuggcuggcacagccuuucugaacuccuugaguuuagaauagagcuccuagaauaauaaggcggccaaauuuaaagaucagucaauacaguagggaccugcuauugaucucucaggcacugagucuucacauccagugucaagcccagcccagcauauggggugauaugagcagaaaacacacaucggugugucuugauuucucgcagcuguguaauguggcaugagaaguauguuuuggugccacauauuucucaaucugaugccuuuuugucuuuuuuuuuuuuugccauuugcauccuauuucauagugccaaaaugaauuuuuguaucuugucuugucuuuguccauuauaaacuggaggaucacaguuaagccuuccaugaauucauaguuuggaaucauuuaccuuaccauuauuuuggauuuuuuucuuauuacagugucacuacacuguauucaugugggggaacaaacauguaggugcuugaacaugccccacagacacaguuguagcccuaguauuugugacggucauuauugacacagugcagacuuugcagauggagcauuaugcucucagaggacuuuaaaaauauguauauuaagcaauuaacuuucuggaguuggaguuaucaaaucuugcugggaaauuaacuuccaagagcucugaauuggauggaauuccaucuggcuucagagaacaaucagccuauaugaaacggagcuuugaaauguuuuucuugugcagaaauacgaacuagaaagaaaagugcugaucuaaugcuaaguuuucucuguguacugacucaguugccagaauuauaaugaaaacuguauuuuagucuaacaaauguauagaauuuuuuauguaauaaauaaaauuuuauaggaaagaauguuauugucuacuguguuguaacacuuccccaugcccaggguggugacugauaaaaucaugggcaacaucuucguuucaaauuaggucaguaugcugcaagggugccccagaauuucccagcuguuccuuucugucucucgcagcauguucugggggcuucggaauagcaacuauaaauguaccuaaaccaauuucugaaguacaaaguucauccacugccaggccaggcuucauagcuggagucugaguugccgcgugaaugcuaagauugcaacugaacucaaucaucaggcagaguagaaaagccuccacugggccgggcgugguggcucacgccuguaaucccagcacuuugggaggccgaggcggacagaucacaagaugaggagaucgagaccauccuggcuaacacggugaaaccccgucucuacuaaaaaaaauacaaaaaaauaagccgggcgugguggcgggcgccuguagucccagcuacucgggagacugaggcaggagaauggccugaacccgggaggcggagcuugcagugagccaagaucgcaucaccgcacuccagccugggggucauagcgagacucggucucagaaaaaaaaaaaaaagaaaaaaagaaaagaaaagccuccgcuggacaguguccaucauggaagacauucauugugccugguucagugcccugcacgugaauuggagccuggaucuguaaugaguuuagugcguuugugaaacuguguggugugccaucauuuaggcaguagcugugccccauuuaaaguuuagaaaaaucaagcuuuuuaaaaaccaauaauuuuagguaauguuagggacgaaggaagggauguucuucuuaaguggaagaccuuuuggaauaccguaaaccucuccuaauuuguuuuguuauuuuggauuuuucuugagaggcugcacuguaaacugccuuuuauuagcaaaugugagcugaugauaguccugguuguuuacaccauccugccaaaaagaguuguuacagaauaaucgugaggagucuuaaacacuggaggaauuugagauucuguagaauauuaaccgaucuggacuguucuuucuuuuuuugagugguucugaugcagauuuacguaauuucuauuauauagaccaccuaaugauuaaagagccugugaaaagccucacaucugaaagguaccugaaagucuuuucuuucuguuugacuauggaaagcguacucuguauuuaaccucaaauugaaggaaauaaaaaucuagaggauucuuucaggaggcacaaaacuuacacacccuaucuuaauauguaaguagugauuaaaauuuuagcugcuuuaaauagcuguacagcucaaaacucuuacacauguugaaggguucagaaagaagccaguaccucgagaggcucuuuggccucauaucuuugaucagaugcuguggaacuaacccagugaguuucugccucuaccagggguguccaaucuuuuggcuuuccugggccacacuggaagaggaagaauugucuugggccgcacauaaaauacgcuaacacuaaccauagcugauaagcuaagaaaaaaaaaucgcacacacaaaaaaucuuuuuaaaaaguuuacgaauuugugucaggcugcauucaaagcuguccugggcugcaugcgucucgcgggccguggguuggacaagcuugcucuacacauuguuuuuucacuuguggcaaguaguagugaaaauaagaaaugcuuuaugcuuuuaauuugaugugccucauuuacugucccaauuccaagaaaaauaauuuuagcagauucaccuagguuaaauuuaggauuccagaaaaaguaaagcuaagcuauuagaccauuucaugggcuuaucagcaauuucaauagaaaacuuaaagcacucuagguacuuacaagcucccuggccaggacugucagacuagagaggcaacaguaaggaacugccuucgaggcaaaacaaagcggcuuucagucaaucucagguugcauccuguaaccucacauugggagacaggcuauuagguauuuaagguuggucaacucacuccaucuuccagaaaggauucucacagcuuacaacaaaauaaaacaauuuuaacacacacacacacaaguuguguaauaagcaaauugaaaaaaaauugagaaaaggagauuagcuauguaagaaucccaggcuaggcauaugacuaaauuccaagcuuccuguuaguccugucaaagaggaaaucaagaaagguacauauuuaauguuaaauuuuaaaaagcauaaauaaaaguucaauaggaaggacugggcaggcauucacaauaauguaaauaauauuuaauacauuggauuaauguuuauaauagugaagaaagcaggggcucaagcaaugcaugaucucauuuauaugaaauaaauuuucuuagacaucuuaaaauauaguaggugcucucucaguccuguaggcacugguaguuaacugguuaauugaaaaacuggguuaaggaggagaaucauugaaaaugaaaauuuuuggccaggugcaguggcucaugccuguaaucccagcauuuuggguggccgacauggguggaucaccugagguaagguguuugagaccagccugaccaacauggagaaaccccgucucuaccaaaaauacagaauuauccgggcacggugucaccugccuguaaucccagcuacucaggaggcugaggcaggagaauugcuugaacccgggaggcauacguugcggugagccgagaucgugccauugcacugcagcccgggcagcaagagugaaacuccgucucaaaagaaaaagaaggcugggcgcgguggcucaugccuguaaucccagcacuuugggaggcugaggcagguggaucaccagaucaaaagaucgagaccguccuggccaacauggugaaaccccgucucuacuaaaaauacaaaaauuagcugagugugguggcgcaugccuguagucccagcuacucgggaggcugaggcaggagaaucgcuugaaccagcgagguggagguugcagugagccgagauugugccacugcacuccagccuggugacagagcaagacgccaucucaaaaaaagaaaaagaaaaagaaaauuguuuuaaacuacaacaugucaauguuuauuggccaauuguugacauagguauauucuucuuucugacuccugacucuucugaaguugucuacugucuuugacauuaaagacaccaauaauguaaccucccgaaagugcaauaauaugaaauauugauuuauuaaaauggauuaaaaaauuuagaaaugcuuacaaagcccacugaauauagguucccagguuuuuuauaguuuuuauaauuucuuugcaauguuuguauuucucaccuacacauaacuugagaguaguaguuuuagcacuuaccuuuauugaaccuuugcaagguauucaacuuuucaaaggguuaauuuuuauagaaacuacucuuuucauauucauuguuuuuaucaauauacguaauauuuaaauaauccuggcaguaguguaaccacuacaccuggcauaacauguugaaauauacacaccugacccuuguuagcacaaccuccugaugcugagaaugagaacacagaacacaggccucugaguggaagccccucuccaggagcauucagcauacgacagucaucagccaguacauucuacagaagcuuggaaaagaucgguuuauuuggcaaaaugguuaagugaaagccagcugugaaagccaucuauuuacauaaaaaugaugauuaugguuaucucuguuuugugggacuaugaguaauuuuagcuuuuccuuugcuuauuuguauauuuaaaauauuccucuauaguuuuuaacaggaaaaaauuauauuaaacacaaauagcuggguaagauaauaaaaugauaguaacuaaaccagugugauaauaggccaguggaauagaagagaaaguuuccaaaacaaaucguauuauuuauaagggauuauacuuaaaauagaauauaccuaaaaugaauaaggaaggaaagaguccauuuaauaaauuguaauuuaggacaaugggcuuucaauuugaaaacaaaucuaagucaaaucuaaauggauuuaggauuuuuuuauuauuauuagaccagggaaaggucaggaggaggaguggagaggaucugauaaaauuagaaagauuagaagaaauaauagaaaugauagacuugaaauaauaggaugauggaaaugauagguggggauuagggagaugcacgucucacauuuccuggaaauugugaugugugaggcccauuucagaugcauuuccuaagcaugcucacagcagcgugcuaaauguauccacuuucauucaacaagcauuuccugagaccucuucuggucagccagaguuauauucugggagcucaguucuaaauacucccugaucuuaaguagcucacagccuaaugagggacgcagagagcagugauaguagagagugcuuuggagcacacaggaagguguugaggucauuaggagaaacugucucagcugagucuugaaggauaagcagggauuagccagaugaugaaggggugggagggugauucuacccagaauagaagcacuuuggcacucauauagcaacaugaggaacagaagucauucaggauguccagagcaaagaagaugugcguuugcaccaagaggugacccuggagaggauacaggacucuuacauguguguucagaccuaaaguguguguuguggggagccugugacagguuguaagcagaggagcaaucuagccauauggagacugcguugagaguggaaaucuagaagagaaagacuugggaggaaggaagccugagccggggccuaagaggaggacuggaaaagagcaggauuccagcgagaaauccaacaggcuuggugacuaaugaaauuggagggaaagggaaaauaaaucaugaaggccuauacucaggaugacgugugccaucucuucauuuagagaugggggcuuuugccagauggucaaauucaucuaagcucugauucucuacuucauugaauauuggaaauauuuaccuuuucuguuccaugcuaacuguuguaaaaucucuguagugauaggaaggaguccauuagaguuagagguccugaaaauauuuaucugugccagcaaaaaauguuuuccacucccugauaaugauuucugguuuucagcuccccacauaacaaaggcgugugucgcuuagguaguuguagacaaaccucucaaugacuccaacucuacucuucuacauugucaugcuaaccauuggugugcuucuaugcuaacaagaaauaacaugcaauauguuuuuagugucuguuuauauauuuaugcugcuuuuguuuuccaagaaggcauauauacaaaaagauuuuuuuuaaccccaggcuggagugcagugaucccaucauagcucacugcagccucaaacuccauagcucaagcgauccucccaccucagccucuagaauagcugagacuacaggcaugcaccuucacacccagcuuuuuuuuuuuuuuuuuuuuuuuuuggaaaggcagggucucgcuuuguugcccaggcuggucuccaacuccuggauucaagcaaucuucccaacucagacucccaaagugcugagauuacaggugugagccaccaugcccagcccgaaaagauuauuaaacuaaaaauauaaaagcaaagacauaaacaggaagaaacaaauaugcuggacucugggacuaauauggucacagugcauugaagccuuaaauucuuucagcuuucuuagcaaccugauaggaaaggaaaacacaaagaucgauagaauuuuauucucugguagaagaagguuuaugcauucuucaguuuacuguggaagcaaaaauaacccacauauggcucuuaaauugggauuuggggaugcuaagcuggggaagucccagcauguaauuuccugaugcuuucacugaaguuguuaccucauaccuuauuuagaucuguuucuacuaugaguuacacgacaugguucuuggguguaaauaaaacagaaagauaagucuucauuuauuucggauacauucacugaguucuacauuagcuaagaauaccagaauaagagacccagccucugcucucugaaaacucacaccauauuuaggaagcaaaggaguaagcagaugauuguaaucuagugugccagccacucuaacagaguuaacucaggaguagcagggagacccaccugaaggugggagggccagggagguggggcuguaauaagcaaauaagccuuuggggaaagggaaguagagaguguuccaaggaggaauagcgugugugaagaaaugaugaugugucugugaaucuguacugaaguguagguguggggacaugaaauuggagcggucaguagggaucagaucucgagggucuugcaggccacccuaacggucuugauuuuaugcugcagaaaaugaggacuugcugaaagauuuuaaccaaaggaauguuuggagauauuugccuuucaggggaaaaauuacccugacaacaguggggaguauggcauggggugaguugcuucugggccaggaaaacaaagugaagagaccauuguaaauauaccaugugauucagaaugagaauuccaacuagggcacuagcaauaagaauggagagaaaaggcaggagaaucgcuugaaccugggaggcggagguugcagugagcuaagauugugccacugcacuccagccugggugacagagcaggacucaucucaaaaaaaaaaaaaaaaaaaaaagaauggagagaaagggauauauuuaaaagcuaauggagggauagaaucaucaaaaacggaugauugguugguguaaggggccaagugaaagaaagacaggagugaagcgugaaucuccagguccugguuugcaugcaaugcugcauuggaaaauaauuuacuuuucaccuggaaagaaccacuuuaagaugaagccguauuuacuuucauaaagagacaagauaaaauaacagaaaaagcacugauguaggauuuggaguauuugaauuuauugccagugccuccaguccagucauggguuguuuguccucucugccuauuuucuugacuauaaaauguuauaugcucagccugugcuguaggacuacgaugauaaauaaaugaacuuaggggauaggaauaugcuucgaaagcaguuaaauacaacagaguuguuaucuccuuauuuucugaugccuaaaggagacagcaucguauaaggaagagaacaaagguuuggcacuauggauauagauuugaaucugucucugccucuugcuguagaagcuggguaaccugcgaaagccacaaaagcuuuuugaggcucaggaucuuccuuuguaaaaugggaauagucauguuuuauagggauuguguaagacaaugauaauuuuuucauuucacucauucauuagcuaacagauauuuaaugaguaccuacuacguguuagaagccaagaauauaaaagugaacagaacaagcuagagucuccacgcuaguuuuauguauaaaagcuaaugguggcuaggcgcgguggcucacaucuguaauccuaggacuuugggaggccaaggcggguggaucacuugaggugaggaguuugaaaccagccugggcaacauggugaaacuacaucucuacuaaaaauacaaaaaauuagcugggugugauggcgggcaccugcaaucccagcuacucgggaggcugaggcaggagaaucucuugaaucggggaggcggagguugcagugagccgagaaugugccacugcacuccagccugggcgacagagcaagacuccauuuaaaaaaaaaaaaaaagcuaauggugggaugauaugauugaaauggcagagcaggaaauuccaaaacuccaucauuccacaaaaacgaugaucaaauugacaaaaacuguccaaucaauuuuuaccaaauucuagaaucuaauaaagaacuuacacaccuaggcaaaugcuaaauaaagacauuucaguaagagcauugaggcauguuaacuuaucugcauaccaucuccacucaccagcuuagcagcaucugugaaagugguggcucauguuucugauguggcuugccaaugcccaaguaagcaaugugugguuagaccuuguucucaaaaaaaaaauugugguuguguguuuugaauugucugguggcucccugaaugaucaacucagggguuuaucuuugugucacaugccucagaagcuucuuaggguugaagugaucucccaagugacauuugucaauggcacuuaaaggcuuauauacuagcugcagcaaccuguggugaagaauaacagaugcggcaaacggcagacagauggaagccugggaaagaagaggcuagaaaaggacauacacggaggaauaacagcuuucaaaagcuccugcauauacuaggaaauguccaaggccacacacaugcccagggcuugacacaggaaggaccugagaagaccacaaacguucgcuucuggcuaaccuuucgaugcaagcaggaaguaaaggcuagagcagaguuguaaacagucuugcuaaggguuaagcagugcccccauaaagaaugaaugugcaaagacuggaaggugaucucuuuuuuuuuguggcuccagguauuuaaggaaaacucugucaaaucacuagcugaccauaaacuaacaaaacagagacuucaguggccacacacacacacaccaaagaauacagucucuacaauacauaguucagaaaagucauuaaacaaauaaacaacgauaacccacaauaagccagcaacuacaaacccuagggaggaggaagaaucugauuuccagaguugccacauuauaauaugcaaaauguccaguuuucaacaacaagaaauuacaagguacacaaagaaauaagaaaguacagccuauuaacaguagaaauuaacagaaacuggccagacgugguggcucacaccuauaaucucaauaccuugggaggcugaggcaggaggauugcuugaggccaggaguucaagaccagccugggcaacauagugagaccccaugucuaccaaaaaauagaaaaaguagccgaacaugguggcgugcaucuguagucccaccuacucaggaggcugaggugggaggcuuccuugagcccacgaguucaaggccgcagugagcugagauugagccacugcacuccagcccgggugacagagcaagacuucaucucuuuaaaaaaaauuuuuuuaaaaagaaacugucuuugaagaagcccagauauuugacuuacuaaacagagacuuucaaucaacugucuuaaauaugcucaaagacacaaagaaagugaaggacaaagaacuaaagaaaaucaagagaacaauguuuuaccuaauagaagacaucaauaaaaauauagaaaugauaaaaaagggaaccaaauagaaaaccuggaguugaaaauaacugauaucaaaaauucacuaagagggguucaguagcagauuugagcaggcagaagaaagaaucaccaaauuugaagauagaucaacugagauuauucagucuaaggagcagaaaaagaaaagagugaagaaaacugaacagagccuaggagaccugugggauacccucaagcauaccaacauacacagaaugggagucccagaaagagaagagagaaagaaaggagcagaaagaauauuugaagaaauauugucuuauaaggucugggcuauaaagaaaaaaauacuugaagaaauaaugguugaaaacuccucaaaagugauaaagacaugaaugcacaucuaagaagcucgacaaacuccacauaaaauaaaccuaaagagauccacacucaaacagauuauaaccaaauuguugacaaagaaacauagaaaauauugagugcagcaagagggaagcagcucacuacauauaagugauccuuaauaagauuauucccugauuuaucagaaugagggaugauguauaguaacccugaaagaaaaacaauuguuaaucaagaauccuguauucaauaaaauucuccaccaaaacugaaagaaggccaggcacaguggcucacaccuguaaucccacuguaaucucagcacuuugggaggcugaggcaggcggauuaccugaggucaggaguucaagaccagccuggccaacaugaggaagccuugucuauacuaaaaauacaaaaauuagcugggcgugauggcacaugucuguaaucccagcuacuugggaggcugaagcaggagaaucacuugaaccugggagguggagauuacagugagcugagaucaugccacugcacuccagccuggacaacagaccaagacucugucucaaaaaauaaaaauaaggccaggcacgauggcucacaccuguaaucccagcacuuugagaggccgaggcagguggaucaccugaggucaggaguuggagaccagccuggccaacauggugaaacccugucuauacuaaagauacaaaaauuagcuggcauagugguaggcgccuguaaucccagcucaggcaggagaauugcuugaaccugggaggcggaggcugcugugagccgagaucucgccacugcacuccagccugggcgacagacugagauuccgucucaaaaaauaaaauaaaauaaaaacaaaaaacugaaagaaaucaagacauucucauacaaacaaaaguugaggaaguuugcuucuaguagaccugcccuaugagaaaugcuaagggaaauuauucaggaagaaaugaaagaacacaaguaacucuagcuauacaaaaaaauaaaaaauaaaaacaucaguaaggaaacuacauagguaaacauaaaagcuaguauuauuguauuuuuuguuugucacucauuuguuguuguuguuguuguuguauuugagacggagucuugcucuguugcucaggcugaguguaguggcaugaucucagcucacugcaaccuccaccuccuggguucaagugauucuccugccucagccuccugaguagcugggacuacaggugcaugccaccacaucuggcuaauuuuugucuuuuuuaguagagacagaguuuuaccauguugcccaggcuggucucgaacuccugaccucaggugauccacccaccucggcuucccaaagugcugggauuacaggcgugagccaccgcacccggccugucacucacuuuuuuucuacaugauuuaaaaggcaaaugcauaaaacaauaauuauaaauguaucugaaugaacacacaauguauaaagauauaauguaugacaauaacaacauaaagggagaagguggagcuacauaggaacacaguguuuguacauuauuuaagcuaaauugguauuaauucaaacuaaauuauuauaaauuuaggauguuaauuauaacccccaagguaacauuaacaaaauaacuaaaaauauacauucauaaaaggaaaugagaaucaaaauaauacacuagaaaaaucaauuaaacauaagagaagacacagauaugauauaaaggaaauaaacaacaaaauggcagaagcaaggccuuacuuaccaguuuuuuaaaauguaaauggauuaaacucuucaguuaaaaggcagaguuaguggcauagauuaaaaaacagacuccaacuauauaauaucugcaagagacucaauuuacguccaaagacacaaauaggaugaaagugaaaagauggaaaaagauauuccaugcaaauagucaucaaaagagaacuggaguagcuauagaaauaucagacaaaacagccaguaagacaaaaauuguuacuagagaggacauuuuauagucauaaaaggaacaaugcaucaauaacauauagcaauuauaaacauaugugggccaagugcaguggcucacccuuguaaucccaacacuuugggaggccaaaaugggagggucacuugagccuagguguucgagaccagccucagcaacaaaacaagacccugucucuacaaaaaguuuuaaaauuagucggguguaguggcgugugcugguaguucuagcuacucaggaggcuaaggugggaagaucccuugagcccaggaggucgagguugcagugagcuaugaucacgccacugcacuccagccuuggugacaaaauaaaaaauaagcauaugugcaucuaauaagagaauccacaguacacgaaacagaaacuaacagaauuaaauggagaaauagacaaaucaacaauaauaguugagacuucaauauuucauuuucaaaauggauagaauaacuagacagaagaucaagaagaaaauagaagacuugaagagcaucauacaccaacuagacauaauagacaucuguagagcacuuuauucaacacuauucuucugaagugcacauggaucauucucaaggcuaaaccauguuaggccacaaaacaaaucacaguaaauuuuaaaagauuuaaaucauauaaaguauauucuaggucaaaauagaaugaaauuagaaauaaauaacaaggaaauugacucaaaauguuaugaaaauaacaaguaaauuaccucaaaauagaccuaaauauaagagcuaaaacccuaaaccucuuagaagaacucauaggaguaaaucuucaugaccuuggauugggccauuguuucuuggcuaugaaaccaaaaacacaagcaaugaaagaaaaauagauaaauuggacuucaucaaaauuggaaaauuuuugccucaagggacauaaucaaaaguacaaaaagacaacccacaaaaugggagaaaauauuugcaaaucauguaucugauaaaggucuacuguccagaauaugugaacaacucuuacuacuuaacaacaaaaaaauaaacaacccauaacgagcaaaggacuugaagagcuauuucuucaaagaaguuuaaaaauggccaugaagcacauaaagagaugcucaaugucauuagggaauugcaaaucaaaaccacaaggagauaccacuucaaacccacuagaaugacuauacucaaacaaauagacaauaagaaguguugacgagaacacucauacauugcuggugagaauguaaaauggugccaccacuuggaaaacaguuuggcaguuucucgauaaguuaaacauagaauuaccaugggaugcagguauauaucccaaaugauugaaaacagguguucaaagaaaaacuugcucacaaauguucauaguagcauuauucacgauaaccaaaaaguagaaauaacuaauguccaucagcugaugaaugauaagcaaaauguuguauauccauacaacaaaauacuacucagcuguaaaaagaaaugagguacucauacaugcaacaacauggaugaaccuugaaaacaugaugcuaaggggaaaaagccagacacaaauggccacauauuguaugauuccauguauaugaaauaucuaaaauaggcaaaauccauagaaacagaaagcacauucaugcuuaucaggcacuggggaaauugggaauuacugcuuauuggaaauacgguuuccuuuuuggguaaugaaaauauucuggaacuguauaguggugaugggugcaaaacuuuguggaugaacuaaauaccacugaauuguacacuuuaaaaugguuaaaaugguaaauuuuauguuauauauauuuuaccagaauaaaaauaaagacauacagaaaaguuagaagaauaguucaaagaauuuuuauauauacccuucaucuacauucccuaaauguuaguauuuuaaugcauuugcuuuuucuccucauuuccacuccucuauccuucuucccuucuccuuccccuuccccugcuucccuuuuccuaccucucccucccucucucuugcucugucuccauuucucucugucuccaucucucuuggucucucucuguguaugugugugugugugugugugugugugugugcgugugcauuuuacagaccuucuuuaaauuuuaacaguugucccacuaauguucuuuauggaaaaaagcuuuuuuuuuuucuggucaacaauccaaucuaggaucacacauugcauuucauuuucaugucucuuuaaucucuuuuaacuuggagcaauugcacagucuuuuguugucauucaugaccuugauguauuugaagagucaggccauuuauuuucuagaaugaccuucaauuucgguuugucuaaagcuuccucaugauuagauccaagguaugccuuuuuggcaggaauaccacagaaggcauaacuguguccuucucagugcaucauaucaggaggcacaugaucucguuugucccauuacugugugcuaacuuugaucauuuggcuaagguggaucuuccuggucucuccaauguaaauguacuguuucucccuuuguaauuaauaaguaucuuguggagacauauuuugagacuauguaaaaguccuauuucucaucaacuuuucacauuaucuauucacauucuucucugaaacagcuauuacugguguuuucauauaaugaugauuuucuaauuucaucauucuuccuauauuuauuagcugguguucuacuguaaggaaaaucucuucucacccacuuaguuuuucaucaaauaaauauuuauucaucaaauaauauauauguuaaauaacguuuuaauuagucaucaaauacauauuuauuuguugaauaaauauugauuauucaucaaauaaauaaauaucaaaucccagauuguuacuuuuuucuguuauccucauuuauuuuuaugcccacauugucucagauuuagccaaugggagcccauucaagcuggcuccuguacuuuugaucuguccccaucauucuuugaguacuuccuuauucacugacgcaaccagauguuccaagcucaucuuaugcuuuccugguuucaacucuguaaucagccaagucuucaagugagcccuaguuccuuuuaauggaaacugguauuuggaaaccaaggucugggcacaauaugugcuuuugugguagcuauuugauaauagcgaccacaugauauacagcaggagaaaggaaaugacugcauuacuuuuuuuuuuugagauggagucucacucugucacccaggcuggagugcaguggcgccaucucagcucacugcaaccuccgcccccuggguucuagcgauucuccugccucagccucccgaguagcuaggauuacagacaccugccaccacgcccggcuaauuuuuuuguauuuuuaguagagaccgguuuucaccauguuggccaggcugaucucgaacuccugccucagaugauccacccgccucggccucccaaaguucuaggauuacaggcaugagucaccacgcccugccuacucugcauuacuuuuuauaggucaauccacaccuggaauauaaaugaaugagaguguuuucagagacaagccuagagaagauaucuacugggaaaagagacaucuugggguagagaaagggaaaagcaaugauuacuauauucaaauaucuaaagggauguuguagaaaaaauggugucuauagucauguccugagccccuaaaggguucuaaugguuggaaaaagagacuucuguuucaucagucaauuaacauauguuaaucaccuauuacuaucaggcuguggcagugagugcugauugcccugcuauugcucuucugcccaucuuuuucaugaauauaacccagauaucauucugguuagcaaaaugccuuacuaaaauacucaccuuuccauacuucccugaagcuugaaguggucguaugacauaguucugcccaaugagauauaagcugaagaauacuggcaauuuccaagaaaauuucgccuucccaauauaggugccgcccaucuuccugguuuuccccuucucuggccugucuggaaugcagaugugauccuacuugaaagaacaaaagacauauuacaaacaccaacagaaccacagaccaaagauggcagaaccaaaagauagaaggagccugguucccagaaagcauucuugccugauuucuccacaguugggcuugaugucuucugggcuuacuguuacaugagaagaaugaaucccuuucuuguuuaagccacuauaauagguuucuguuaaaugcagcugagaugcaguccuaauccaggcacuaugcuaaguccuaggaggggaaaggccaccuaguggagucacuggcuuuuccugccuaucagacagaaugugaggaagacuuccuaaaaacuggaacacuaccaagauggacuuaaccccaggagaagacgugaucccccugacuacgaaggaauguguguagaggcugggugguacuuuugcagcugggauguuguaaagcaguauugagcacagagugaaaggcuaauucaaugaccuuuaaagucuauuccagugcaaacauuuuucuaagagucagaaaguuaaaaaaaaaaauagauggacucagggcaugcuaagcuuucgcuggacaguuaguguuugguuuuuuuuuuuuuuguauuuuuguuuuuuugagacagagucuugcucugucgcccaggcuggagugcaguggcacgaucuuggcucacugcaaccucugccucccggguucgagcaauuuuccugccucagccucccaaguagcugggauuacaggcacgcccaccaugccuggcuaauuuuuuguaguagagaugggguuucacuguguuagccaggauggucucuaucuccugaucucgugauccgcccgccucggccucccaaagugcugggauuauaggcgugagccaccacgcccagccgacaguuaguguuuuuuagcuguagucugcauuuggaucgaugauuuucauuaaaguuccuaagaaugcaugcucccucagcacccccuggguaaacauguuauagcaauuuuaaguuucuaaugaaauuuuuguuguaauuuauuuguagcaaucuaauuuaucccuuuuuuuacgacuagaauuuuuauuuaucuuggauuuacaaaguuaauauugccguaaaacauagcagcauuuuaauuuuuagauaguaauagauuuauuauuuuuaucuguguuuaaaaucauaguagucugggcaccguggugcacaacugcagugccagcuacucaaaaggcuaaggcaggaagaucucuugagcccaggaguucuaggcuguaguacgugaugaacacaccugugaauagccacugcacuccagccugggcaacauggcgagacccugcuagaacaaaaaagaaaaaaaaaccauaggaauaagaugcauuuucaccacuuuggaauguuuaugucccauaaacuaaccauuagggaucuguuuauuggcagaguuucuguaaauauaugaaugcucuugaugagaaaaggagauuuuuuuuuccucucagaguggaagccagguucuuuggugggauacucacccaucaaacauaagaaaggaaaggucaagacuuuacuggguucuaugguugaucccaagccugagauaggaggaugagcugcacaacuuugugaagguagccaaggguaacugggaaguuauuaagggcacaauagagguuuauugagugaaucaacaaaugaauccuuuggcagccugauuguuucugaguaggugauuuugaacagcccacaguucaaagauuucucaaagcccacaguuuugagaaaucaguguuucucaaaaggcaucacaauagggggugcaaggaagguaaaaaaggcagcguuuaaaacagaaauuacucagggucucacuucuaccugcugaaucagaaucucugcagccagcagacagaaaucugcauuuuaacaaaccccaacccaguccagaggauucugcuguauaauaaacuuugcuaacuauggacacgcaugcuguuccagcugaaguuuccacggagggacggaaccuuagagggaggcaggaguuccagcuggagcaggauuuugggguggucguccuugagagggcagccauaguacaugugcuugucucuagcgacaccugcugguugagagugacaauuaacaaccccugaaacuacacagguguuuucucuaauggggccuccaauacuaaaggcauuuaguguuugcauucuaacagcgguaauuaacauaccaaaagccccagauaugggacacuaacuuuuauauguguauccucuuuucacuagcuuucagguagaaacaauauauacuugaagaauauuguccuucgauuaucuuacauguuucuuagaaugaauguucccguuuuacguucauuugaaaaaagaucaacuuuuggauauucucugaaaggauugacugaauuuuuuuuuuuuuuuuuuuuuuugagauaguaucuugcucugucgcccagguugaagugcaguggcgugaugucggcucgcugcaaccuccaccucccggguuccagcgauucuccuacgucagccucccaaguagcugagacuauaggugcccaccaccaugcccagcuaguuuuuauauuuuuaguagagguuucaccauguuggccaggcuggucuagaacuccugaccucaaaagauccacccaucuuggccucccaaagugccgggauuacaggcaugagccaccgcacccagccuacugaacuuuuugacuagggaauuuguucucuguuauuguuuuauggaaauaagaagaagcuaauucuuaucugacaucaaagacuccaggcaagauaaaaaaaaaaaaaaguaccaugauaucuuagagaaaaauugguucuucuacuuuccugagcaccuacuauaugccaguauuccucucagggaggcucacaguugagggauggagaggggauagguguggucaguguagcaauagaaguguguauaaugugucacaguaguugggggugggggcaacaauucauuccauuggggugggucaaggaauaaauugaggccuaggggaaaagugugaucuuccaaauccuccacagacaucgccagaucugaaguucccagaaaagagacuggugugugcuaaggcauaaaggugugaaauagcauuugcggcauaugcacuuggaaagcaguaaccuccaaauaauauguucuuauaaagugugaggcuggaaaugauaagagaugaggccaaggagucaggccacgucucacccaccugccaagaagguuagauuuuauccuguagguggugaauaaccacagaauaguuuaaauuuaagauuugcuuuuuaucagguuguuugucccacuugacuauccaugcacaaaguauagaaccuccuauuuaucugacaguggucaaaacugagucaaaaggccuaagauuauaucuauuaauugagaauuucaugcagauuaaacacaaaaagucccagucccuuuggaaaguaacuuagcauucugguaauuacauuugaccugugugcuguaaaagguuuugguuuugguuuuaguuuuaauguagauauuuaacagagcugaauuucugugccuuuuaugugugagcugcugcacugccuccucuccuuguccuaacagggacucacacacagcauuccccucacacagaccccagaaaaucccaucgguguccuuacuggggccaaacacugagcacugguuccuagaaccugaggcaugaaauaaaccaauucauuguuuucugcauaauuucacaugcuuuuaaaauaauaagugauaauggauacauuaccauguugccuuucacaacaggguaagaugcucacuuuguggucguacacaugaucaggaccuucccucauggaagaaggauaaagaaaccuuguuucacccuccucccuccugcuuggucuucagccauaccaugcaugucuuuaugcacuuaucauggucugguggaaaagcauggaauuuggaaucugauggacuugaguuuggaucuugcccaccccaucaccuugccaaguuccuuaacuucucuuucuuuaccuggcaaaaggagcuaauaaugccuucucuugaagacugagugaaaagugugauuauauccugaaaccagugcccaacacacagcagauucuuaauaaaugcuaguccuuuccauucuuuuucuaucuugcccuugauaucagugagccaucagaaggccaggaagcagccaggcaugguggcuuauaccuguaaucccagcuacucaggaggcugaagcuggaggaucauuuguagucaggaguuugagaccagccugggcaacauagcaagaucucaucccuacaaaaaaaaaaaaaaaaaaaacaauuuaauuagccagguaugguggcaugugccuauagucccagcuacucagaggacugaggcaggaguuuugcuugagcccaggaguuugaggcuacagugaacuaugauuguaccacuacaguccagucuagccaacagaaugagacucugucucuaaaaauaaugauaauaggcugggugcgguggcucacgccuguaaucccaguacucugggaggccgaggcgggcggaucaccugaggucaggaguucaagaccagccuggccauggugaaacuccaucucuacuaaaaauacaaaaaauuagucggguguaguggugcaugccuguaaucccagcuacucuggaggcugaggcaggagaaucucuugaaccugggaagcggagguugcagcgagccgagauugcgccauugcacuccagccugggcaacaagagcaaaacuccgucucaaaaaaaaaaaaaaaaaaaaagaaagaaagaaaaagauaauuagaaguaaauaauuuuuaaaagaccaggaagcucacagccuucaguucacacugcaacaguaguaauuggccauuagaucaugcuguucaguguuguccuauggggcuuaccucuggaacagguuaauuaaauaaaaucacacuucuuagcuuacagauuuucugucuugaugucuuuguaaagauuuugagcuguuuuggguauggagucugacagucauuaacuagcccccacccuucccacuccccuguuguuccaagaggaccccaguucugucaauauuugcucaccacuagaugugggccacaacccugaaaugauucccaaagccaggccuuccuggccuauggguuaagcugccccaguugcacagauaagcagcuugugccugacuggccugcccccaaaucaggagagaaucucuuagccacucgugcugaaaugugacuuucuuauuagcagauauugucuaacagacuguggauucuugcucauuggccaagucaacagccuaaaggaccuuacucucaaaaauuuagguaaaaguuaaucuuugacuuagagggacaacauuuuuggggacagucuucauugcauguaguuugcucuguuugcacucaucuacucuuaauguaacauccuggaaaugccaagauguuggcagauuguaacugaacaaaauuuggcagugaacuugacaaucaaaauagagccaagugacaaaaguuugaaaagacacaaaagaaaaagauuuacaagcugaagaacgcuagaguuagcauagagacauaugguuauagaaaaaaaugcgaguuugcaaagcuguagcacagaacagcacuaauauaaaugccugcucaaauguggcugcaagacaaagcuggugccugauauggggagauaaugaugauccugaaauauuacccugcuguauuuguacuugaaggauuuuaaaguauguucaaaguaaauuuuaucuguguuuaauaagcucacaggauaagaaaggagauugugccuucauuguaguuuuauaaagagaguaucuuucaagacauacacaagacaggaaaaggaaaaccagucuuuggaaagaccauauguugcaaucugagaauuagaagguuugaacaucuauauuccgagaagccucuuauuugcuuuggaacucccaacuuacagguauagccaacuguuaauuauuaauacaaauuaauuuaguaauuucuaccuucuaccuaguucagaaguucucuuagaaggccauguauuucuagcugggcgcgguggcccacgccuguaauaauaccacuuugggaggccgagguggguggaucaccugaggucaggaguucgagaccagccugaccaauaugaugaaaccucaucucuacuaaaaauacaaaaauuagccgggcaugguggcaugugccuguaauccagcuacucuggaggcugagacaggagaaucacuugaacccgggagucagagguagcagugagccgagguugcaccauugcacuccagccugggccauaauagugaaacucugucucaaaaaaaaaaaaaaaaaaaaaaagaaggcaauauguuuccaugcugccugcucugagaguugagagcaaaaucuguugcuuccuaccucccaugcagugcuccuugcccugucuucuggaacagcaagugccuaugccguucagcaguucuucgagcauuugauuagaggaagcauuugauuagaguucucuuuugucugccauuauucagaacaaaugcauggucuccaagcccuccccauccaggauccccgacccugacccuagcagaaugcgcccuauugccuugcaucaccccaagguuuuggcaggaacagaggaaagaggccaaauguccuauuuuacuucuuguuagaguucuagaaagaccaaggcagugaaaacacuugauuaaauaaaagucaggaaaauuggugacuuuuuuuauuuacaaaaugucggcguucucuugggcaugggaaauuaaaguuacaaacacucuuuccuuugucccggagacaugugcauggugagguaaaagggagaguuacaaagacucuuuucuuucacugagaaucaugcaucccuuuuuaauauaucucuuucuuuucuuucaaauuaaaaaugugccagaaaguugagcugauuaugagucagugccaagcuuauccaaaauggauguucuaggccggguaugguggcucacgccuguaaucucagcacuuucggaggcugaaaugggcagaucaccugagguugggaguucaagaccagccugaccaacaggcagaaacccccucucuacuaaaaauacaaaauuagccgggcguggugacacaugccuguaaucacagcuacucgggaggcuaaggcaggagaaucacuugaacccgggaggcggagguugcagugagcugagaucgcaccauugcacuccagccugggcaacaagagugaaacuccaucucaaaaaaaaaaaaaaaaaaaaaaaaaaaaggauggucuagauagacgugcuguuguguugcuuugauguccuacugaguuaagcacugcaagaguccauucagaaagacacagauauauagcauaauuuugauaaauaaaaacaauucagaaaauguugaauaaaguaacaaauauccagaguuccauagguuuaaccguaucauauauuuuuaaaaggcagguguuaagcguuuuaaaaacuauuucaccuuaaaauuauuuauuuuccuuauaaaacaauaccuggaagugguuccucugguuuucaaauauaugaugugauaaauggaaugcauuaauauuuuaugaauuagaugugcuggaauggcauacauugcuccuggaacagcuaucauuuacugaacacuuuuucuccuuuugccuaguaagcaaaagccacugugcuaagggcuuucuaggcauuaucuuuaaauccuuguaagaaucaugagacagagagugguucccauuuuaaaguugagaucacaaugacucagaaacuuaaguuauauuacuagaggucagagagccucuggcaaguuauucaacuaagcauuagagccaccgucauuaaaagaguucuggauuacaggaguuuauauaguaacccacauucagagaauagagcagcgacacucauaauccaaucuugcauuagguucacaagacuucagaaaucucuuuuuuuuuuuuuuuuuuuugagacagaguuuccaucugucgcccagguaggcagagugcaguggcgcgaucucggcucacugcaagcuccgcuuccuggguucacgccauucuccugccucagccucccgaguagcugggacuacaggugccuaccacggcgcccggcuaauuuuuuguauuuuuaguagaggcgggguuucaccguguuagccaggauagucucaaucuccugaccucuugauccacccgccucggccucccaaagugcugggauuacaggcgugagccaccgcgcccagccaggaaucugcuuugaauuccuucagcacacuggugcauugucaguauuuuucagucuugcacaggccuaacuuuuccaguaaguucggaccucugguagaagugacuacaguacugagcauacucaaguguuucacugagugccaguugagagaggugacagcguuagguuggacucuccuaccugagugaugacaauaaggaaguccaccaacuuccuuuuuauccucaaggucagaguuacaucuagcaacuuagguacucaagccaaguaguuagaaauuuccccuuaaaucagcaggguggaagcuggucccucuguacugcacagaaaggggcccucaugaucucaugaugcaggacuccugcccugaccuugggccuccugcuccauccuuuuuuuuuuuuuuuuuuuuuuuuuugagacagagucuuacucuguagccaggcuggagugaaguggcaccaucucggcucacugcaaccucugcaucccggguucaagcaauucuccugccucagccuccugaguagcuggaacuacaggcgcgugccaccacaccuagcuaauuuuuguauuuuuaguagagacgggguuucaccauguuggccaggauggucuugaucucuuaaacuggugaucugucccuucagccucccaaagugcugggauuacaggugugagccacugugcccagccccauccuuuaucagcggccaugagacagaucccuggauaggacagaccuaccucauaugcuggagaauugcuguggccauuuggcuaauuagagggccaaauuugcauuguaaaaugguacccacuaaauuauaauucccugggggcaaagccuauuuucaguguccuacuucugguuugcgugaaguugaacauuuuuucuuacaaacucucaguggcaccaccaauuuaaauaaagagggaauuuuagcuuaucuugucugguguccagaaucaaacaaguuuguggguagaauauccaagucacucauguuaaaaacucuagaguucuccauuacacuuccuucuccccgaucaucuccuaaccccuagcaaggagcaaaguuagauuuaugucaggcccugugugggacauaguagguacuuauugaaugaacaaaggaaaacugggacggaaggaaagagggagggagacagaauuugaguguuugaaaucuacucuuauguuaacagugugaggaaacagcucuuuugaaagucauuuggaaacguguauuaaaaaucucaagaaugggccaggcgugguggcucacgccuguaaucucaacacuuugggaggccagggugggcggaucaccugaggucgggugggcggaucaccugaggucaggaguucgagaucagccugaccaacauggugaaacccugucucuacuaaaaauacaaaaauuaggcggguaugguggcacaugucuguaaucccagcugguccaggaggcugaggcagggagaaucacuuaaacccaggagaugaagguugcagugagccgagauugccccauugcacuccagccugggcaacagagcgaggcucggucucauaaaauaaaauaaaauaaaaucucaagaaugugcacauuuuuauccagcaauucuguguuuagaaauuaaggacaugugaaaagauuuugcugcaaaucagacuauuguuccuuguuauaaaauauugcagccaaccugaauacccaacaauagagaaucaggugaaugaauuauaauacaucuaaaccgcuucuuccucuaaccuuucauaucucaguaaauaguaacacuguuaaaccaguuguucaagcugguaaccuagaaucauuaaauuucccuuucuuucaacuugucauuuugagucuugccauuuuccaaaauauacaaggagucaucuuauagauguauuaacuuaugagagcaauagaugucaucaagccuaaaagccaaucuaucaagaaaaucugaaugcuuuuaaggguuuacucaccauggauauagaaggaaacauuguucaaguaaccagguaaguggguguugauuccaacaucauggaagaugaaauuaaauuaauugagagccauagggaaauauggacaaggaaaaauuaaaaauaauaauauagggcugcauacauaaaacacauauguacaguauuguacuuuauggaugauuuaagagauuuuucagaguuaauuuugauuagaugcaaucaguacaaucuuuagauccugaacaccaggcucccugcucuugcccuccucucucugguccucuuccauggggcaaggaguccaccaugggauuaaggggacaggcccacccuaagccuaauaccacucuccagaauccuaguacccuagaacucccucccaagacaaggccuguaugaguuucuucuccagauacuucuuccuaaggauggauacuggcugugauuguagcaggagauguggcuggagcuugcccuugugggcucagguguccacagguaagcgugagcagccccuccuagugugggcuggggcgaggagugggaagagaaugggagcagagucuuccauuuguccucuugccucagaccucacuaauguuaguagucauccugaaugcaauguuuacugcuaacuagucauacuaacuaacuuucucagucccauauaggauaugaucccauuagaucucaacuucaacuauuauaucaacaauggugauaaauaauuaguauuuuaaaagauaagcaaaaauaagaaaauugguuggguacagugucucacgccuguaaucccagcacuuugggaggccaaggcaggcggaucacuugaggucgggaguucaagaccagccuggccaacaaggugaaaccccaucucuaccaaaaguacaaaaauuagccaggcgugauggugcacaccuguagucucagauacuugggaggcugaggcaggagaauugcuugaacccaagagguggagguugcagugagccgaggucagaccauugcacacuccagccugggcaacagaguaagacuccaucucaaaaaaaaaaaaaagaaaagaaagaaagaaagaaaacuaacuacacucacauuuuguuaacuuaaauaaccaugguaacaccucacagauuuuuaaacacauauauuuggaauauaugguaaauauguauguaguauauauucauauuuuaaaaacaaaaaugauuguauuaccauaaaaccuacuuuuuucacuuaaaguuauaucauguacaacauucuaugucaguaauacccaucgaacacacuauuuuuggugacuaaauggcauuccauuauauagauuccuuaaugcacacauacuauuguacuacacaguacuaagcuuugacauauacauuguuaaacauggugcauacaguuugaagggggaaacagguauuaaccaaacaggaaaaaauaccugagcauaauuugugaugaaaugucguaaaggaaaagaacaaaauacuaugagagaaaauaauagagguacauaauguaguugcggaaagaucuguuugagggaaauaaguuuggucuugaaggaugacgaauuuggcauguaaaaagcugaggaagaacauucuaggcagagagaacuguauauuuggggccagguguaguggcucacgccuguaaucucagcacuuugggaggucgaggcgggcagaucaccugaggucaggaguucgaaaccaaccuggccaacauggugaaaccccgucucuacuaaaaauacaaaaauuagccgggcgugauggcgggugccuguaaucccagcuacuugggaggcugaggcaagagaaucgcuugaaccuggguggcagagguugcagugagccgagaucaugccacugcacuccagccugggcggcagagcaagacucugucaaaaaacaaacaaacaaacaaaaaacccuguauauuugggagccuugaggcagaaaauucuuacuggaaagauggucacugggacucguaaucagcaaggcugggacagaugaagcuggagagcuuccacgccaugcaagguguuuugcauuuucaaucuguguaaguaacaugaucugauuuauaucuuagaaagcuuacucugccuguucuguguaggagaauggguuggggcucugauguaagaugaaagacuaguuagaugaguauuucaguaguccaaaggagaugauggggacauauaggagaauauuuguguaauuuggccuuucuauauaaaccauuuaauacuucaaaauaaaaucucaaauuuucugggcuauauaaugcauuacuaauuccacuagguggcaauggcauaguugugaagcaacacuggagaauguccugggguuacucagugcacugcauuauuucuaagguuauauuuuuucaauguuugacccuugauuuacauugacauuuacauucccuuuaaguuccaaaaauguaauauauuuuacaguucuuguuuuaaaauuauaauuucaauaacucccuugacugggagaaugugaaggucuuugcccacacauuuuugguuccccacuauuucuuugcaucuacuuaaaaaauaacaauaaugaaauaauaucaauugcuauuucuugagcagcuuuuaggagugaguuaucaugcugaguauuuauauacauuaccucauuuacucaugcagaguagauguauuucuucucauuuauagacaagaaaacagagacuagggaagauugguaauuugcccaaauauuaucugccagaaccugaauucaagcccagucucuauaaacaaauuauuaaguggauaaauugguaaauaagcaaauaaaugaguaaguaaacaggaugauuauacacaggugaauugaauaaauugcucauuauagauaaaauauuaguuacaaccaaguaaaaaauauaacccaaaauaugcaagcaugacaaaauaauauucucaugacccaaagguaaagacaagauacauauuaaauaauuccuaucuucuguuuuuccuuuuccuuuuuuuuuuuuuccucgagacaaaaucuugcuuuguugcccaggcuggaguacaguggugcgaucauggcucccuccaaccuccgccuccuaggcucaagcaguucucccaucucagccucuggaguagcugggacuacaggcccaccgcgcucagcuaauuuuuuguauuuuuuaguagaggcaguguuucaccauguuagccaggcuagucuugaacuccugagcucaagcgaucuacucgccuuggccucccaaagugcugagauuaaaggcgugagccacugcaccuggccuaucuucucuuucccuuaacauauuagaauuucccaaugguguuaaaacuuccuugaaagcaggaccaaguuauaauauucuuucauuugaauguacuauauucuauucaauaauucuccuauaauugaauucagcaauuuccucucaaaauuaagggauuauuaauaaugcuauaaugaucaucuuuguauagaaauaugaugucuuuaacuuauuuuuuuauagagacagaggucucacuacguugcucaggcuggucucaaacuccugggcucaagcaagucuccugccucagccucccaaaaugccaggauucaggggugagccacugcacccggccucagaaauaugauuuuuaauaguggaaguauauucccuuuuauuaaacuuuuauuuauaaucuuuuuauuauagagauaucuuugccacccugcuaauucuuuccuuuagauagacuucuggaaagggaauuacuacaucaaguggugaaggcacucuaugaauguugauacauauugccaaauugcucuccagaaaggcucuaccaauccuuuguacuaaagucuaugaaugucaccauuuuccacauccggcagauacucauaucaucauucuuaucacccuuaauaauaacggcaaaagaugacagcccuuuguuauuuuaauuuguauuuuuuaguaauuuauuaguccuuuauguuuccucuuccguaaauucuguauucauguccuuugccauuuuguuauugagaugucaccauuuuuccuacuguugaauaaaagauuuuuauguauuagggauacuaguacuuuuucggucauauuaguagcaaaucuuuuuccuucuuuguaguuugucuuuuaauuuugcuggugauaauuuuaccuauaaucuauacgauguaaauuuuugauaauuuccuuaagcccccaaaucaguaaauuuauugauaauucccuuacgcccccaaaucaguuaaauaguuaccuauauuuucuauuuuuaaaaaauuauuuucuuuuauaaauuaagauacaauuuauauucuauuuuuaaugguuuccuuucacuuuuuauacuuauuaauagcuagaaauaauuuugugauauaauauggagucaggcccauuuguuaugcaauuuauuccuucccccaucaacuuguguggauauuuugucacauggaguagaucuaugauauucuaagaaguauaguuguucagaguuuagacucugugaucaaccacaucuggguucagauccuagcucugccaucuuuuugguccugggcaaguuacuuagcccaucuaauucucaguuuccccaucuguaaaagacugauuguugggaggauuccauuauccugaguaugcagaacagucagcaugggcugugcuaccuaggaaacauuuaguacaguaugcauucacuacuagaauuaugacuaugauaucgaugaaguuauucauaacuuuuuuuuuugagauggagucucguucccauugcgcaggcuggagggcaguggcgcaaucucggcgcccuacagccuccgccuccuggguuuaagcgauucuccugccucacccucuggaguuguaguagcugggacuacaggcacgcgccaccacgcccagcuaauuuuuguauuuuuaguagagucaggguuucaccauguuggccaggauggucucgaucuccugaccucgugauccgccugccuuagccucccagagugcugggauuacaggcaugagccaccacacccggccgguuauucauaacuuuaauaaauucggauauucuugaauggugcaggaauacucacuucaaacuuuuaaugaguuacugggcauauggucaaaaaauaaaacaaagcugcauucacaucuccacaguggcuguuuccuugucucacucacagguaagugauacgcuuccacauccacagggcacacaauucguaucuugccuuaaaaggaagaacugaaaggauauaaaaccagauuaucucaaagguuagagugauuuaggaguagggcuuuucuguauuacuuuaaucuuuuugguuuguuuucguuuuuguuuugagacgaggucuggcucugucauccaggcuggagugcaguggcacgaucacagcucaccgcaaccuccgccuucuuggcucaagccauccucccaccucagccucccgaguagcugggacuacaaguaugugccaccgugccuggcuaauuuuugaauuuucuguagagacaagguuuugccauguugugcaggcugcucucaaacuccugggcucaagcuauccuccugcguugaccucucaaagugcugagauuauaggcaugcaccacaacaccuggcccuucuguauuaccuuaauuuuugacaguaauuaugccuacugaggggaaaacaauaaagauguacccuuggaaaaagugcuuaccucaaugaaguuacagauuaaucaucauccaagauuuagaauuuauugcaaauaguaaaaacauuaacacuuaaaucuucaaauacggagaagccuuuuaggaaccauuucaagguaugcagaaauuuggugugaucucaauuuuauuuaaaucuucuuucauauuucuuuaugcauguguauaccuuaauuauagguuguaaaauuacaaguauauauauauauuuugagacagggucucauuuuguugcucaggcuggagugcaguggcaugauuacagcucaccacagcuuugacccuuccaggcuccuccugccucagugauccuccugccucagcccccugaguagcugggacuacaggcaugugccgccaaugcccggcgaauuuuuaaauuuuuuguagagacauggucccucuaugucuccagcuccuuggcucaagcaauccucuucccuuggcuuccccgugccugaauuacaggcaugagccaccacgccuggccuaauuauaguucuuaugauguggagcucaaucaucuauuacuaaauuauuucauaguuauuuucuuucucuuuuuuaaaaaauuaagauaucauuaacauaucauaacacugaccauuuuaaaguguuuacuucaugguuuuuggcaaaugcacaaagcugugcaacuaagaccaccacgugacucuagaacauuucauuggcccaaagagaaacuccaugccuuuuagcauucagugccuauuccccucacccagccccuggaaaccacuauucuacuuuauuuugcuguggauuugccuauuuuggauucacgugaaagaaauuauacaauauguagaauuauuuuugucagcuuuucacuuagcauguuuucaaguuucaauaauguuguagcauauaccaauauuucaucucuuuuuauggcugaauaauguucugaugugugauauauuauauuucguucauuuauucaucaguuaauggauacuuagguuggauuugcaccuuuucgcuauucugaauaaugcugcuaugagcauucguacacaaguuuuugugcggacauacguuuucaauuuuuuugguuauauacauaggaguggaauuccuaggucauaugguaauccuguauuuaacuuuuugaggaaugccaaauugauuuacacagcagcugccccauuuuacauucccaccagcaauguaugaggguuccaauuuuucuacauccucgacaaguguaaguuuccaucuuuuugauuauagacauccagugagugugaaguuguaucucagugugguuuuguuuugcauuuuccuuaugacuaaugauguuaagcaccuuuucauacauucauaugaugaagucaaauuaucugucuuuuccuugguugcuuguucuuuugcuaucaugacccagaaaucauuguuuaauccaaggucauacauauuuagccuuaaguuuaucuucugagaguuguauaguuuuagcucauacauuuaggucauugaucuauuuugaauuaauuuuuuauaugucauauauggaguauauguagguguauauguaugauauauuuguagauguccaacuuucuucuuuugcauguggauauccaguugucccauuuggacaacaacuauuuuuuuccaaaugaauggucuugauaucgugucaauguccaaaucaauuggccauagauauguagguuuauuucuagauuugcaauucuauuccauuggucuauaggucuuaguugagcucuugauaaacacuggcaugagaugaguauauuucauucucuaacaagugccuggaguauagcugaacacuaacuggcccaugcugcuuaccugucagcugacgugaguaagagauugacagccuccucugagacaugaggaucauaaaaagggcaugcgccugaaaauaguuuguaccucugaucagcuccaagagucuccauagagacaaaaagacaaauaagguccaaauuccaguccauauagcuuggcuaaaauaaucugaagccuaguaauuuuuaggcggguauaacucauacacccaucucagcacccucaaaaucaccugauaaauauuuauggagucccuguucugugcuguguacaacaaagcagcuuuaauuugaggauuuuauuuccuggcauucuuccaacaaacuacuugcagcaaaguugccaaagacaguaagcugauuguaugaagguaucauuauuuauuuauucauugagacagggucucacucuguugcccaggcuuuagugcaguggcgcaaucuuggcucacugcaaccucugcuuccuggguucagcaauucuugugccucagcuuccugaguaacugggauuacaggcaugcgccagcacuccuggcuaauuuuuuuauuuuuaguagagacggaguuucaccauuuuggccaggcucgucucgagcuccugaccucaagugaucugcccaccucaggcucucaaaccguugggauuacaggggugagccacagcaucuggccugaaguuaccauuguuauaggccaaaaacaguugaaugguggcucuuauuuuugaaaaguugauuuauagcccuucucuuugucaauaauuagccaguaggccaauugucucuucaagccacuccuugcuaaagguaauacaaccuuaucauuuguguauaacggaauguuugguccuucuguuuugcuuuguugaagguaggaguggcaagauaucugcaggauugcauuaaauuuauccaaaaugauauuagguuaacaugcaaguuguaaagaagggaagcagagacaauuauucccugggccuggaagcuucauccuucugccuuuagggaccaaagcuuuguugccauauggucugccauaacaauccaagauugaucccuuucuuccuguuuacuggugccagagauccuagaauagcaagguauaguuugugucugguaauguuuaaucuugaugacagcuggcacaagaaacauaacccugaaccuuggaacaaagaugguuuucugcucagugcaaguacuauugcagcguuauuacagcaagcucagaaagacagccagacuucugaauuacauuauuccuuuuuaaguugcuaaaauugaggcugaggcaggagaguuguuugaggcuuccauuugacacuguaaaaaauaagaacuucaguucaucaaaagacaccauuaaaagagagaaaaggcaagccacagacuaaaaaaggauauuugcaaaguacauauuugguaaaggacuccaaacuaaaauuuauaaaaacuuuuacaaaucgccgggcgugguggcuuacuccuguaauccuagcacuuugggaggccgaagcgggguggaucaccugaggccaggaguucaagaccagccuggccaacauggagaaacccugucucuacuaaaaauacaaaaauuagccggguaugguagugugcgccuguaaucccagcuacucgggaggcugaggaaggagaauugcuugaacccaggagguggagguugcagugagccaagaucgcaccacugcacuccagucugcgcgaugggagcgagacuccaucucaaacaaacaaacaaacaaacaaaaaacuuucgcaaaucaguaagaaaaaggcaucccaaauggaugaaagauuuaaauggguaccccacaaaaggggauagccaaaaggauagagcauaugaaaugaugcuuaacaucuucagacaccauccccuacucuguacagucaggcaacugccuuuuuucaugcucagcagacagaaagguauucucugaagaaguuaagacagaucuuaagggaggagcauccaaaacagagguaucauauuaagucagggggauuaagauaccgcacucccucccacugccccugccaccccacucccccgccgccccugcuucaccccuccacugcccaacccaucuccuagaauucucacaaccaggccuuuacccaccaagcaggaaacugaaaaauauucuccagggaaucugaccagcccaaaggaaaaugccuaaagaugcucacacaggggguucucuagcuagaaaguccaaucaagucauuauacaaugaagcauuucaaugacaagaucuacccacgaauaaaaacuuccaauuaauuuuagugcugcuuucuuaaauaagaauuaccagacccuuggggaaagucucuaccaugaaagacagacaucaaaacaaagagaaagacaacaacaaagcaacuuagaggaaacagacuauaagguagaagaaaacuguaaauuacuaaacucagauaauagagaggauuguaauaaaaaaacuaguuugcuauuuaggcuggucgguggcucaugccuguaaucccagcacuuugggaggccaaggcggacggaacauuugaguuuaggaguuugagaccaguuuagccaacauugugaaaccccgucucuguuaaauaaauacaaaaauuagcugggcauggucaugcaugcccguaaucccagcuacuugggaggcugagggaggagagucauuugaaccccuggagacagagguugcagugagccgagacugcaccacugcacuccagccugggugacagagcgagacuccaucucaaaaaaaaaggaaauaaaauaguuugcaauuuaaaagaggaagauucagagaacaaaaaaauuuaaaauagaaaaaaguguaaaauucauagaaggguugaaagaugaauuugaggaagacucuuagaaaguagggcaaaaauaagauggaaaagauaaaaguagagauucauuccgggggauucaauauccauauaauaauuccuuuacaccauacauuuauagaaggaaaacuuguuuggaccaguuaauuagauguagucuuggacuuuaagauggagaaggauguucugggcucccaagggaucugacacaaacagaagauucaggaagcuuugaacugaaucuuccagucacucauuggaugagcuagauuaugccgugaguuuucauguucaaggauaguaggaaagacacagcauccaaguguaaugaaaucacauuuaucagacuguauacuuuagucuuaaggguugcauuuagcuuuuuaaauaauauuuuaaaauuuaaaaauaggaagagauccaggcacaauggcucaugccuauaaucccagcauuuugggaugccaagauaggcggauugcuugagcccaggaguuuaagaccagccuaggcaaccugguguaaucccaucucuacaaaaaauacaaaaaauguaaccaggugugguggcacgggccuguagccccagcuacucagaaggcugaggugggaggauccauugagccugggaggucaaggcugcaaugagcuguuaucaugcaacugcacugcagccuaggcaacaaagcaggagucuguuucaaaaaacaaaacaaaacaaaaaaaaaaaaggaggaaagcugaauauaauauagucuccuggauaggauuguggaacugaaaaggacaucagagaaaauuaaugaaaucugaauaaaguauguguuaugucugugccuaauugaagagacuacccaaacaggcuaagugugagcagcaaggcuguugcaacaaggcugggugcaagugggcugaguccgagaaaggagucagcaaagaguguugggaguggaacugguuuuauagguuugggguagguaauggaaaguuacaguuaggggcuguuuuuuggacaggggaagaaugucacaaggugcauagucaugagguggggggaggucacaaggcacgauaucacaaggucgacugauuaguuagggcagggcaggaacauaucacaaugguggaaugcugcaaaguugguuaaucaguuaaggcaggaacuagcuguuucuuuuucuuuagugguucuccuguugcuccaggcuuugugacuccaggaggccuguaugugugggucagaggggucacaauggcucgaccaugguguagccuguugagaggaccuuacaguauggaguuuagcuaauagcaguguaccaguguugguucacuaguugugacaaauauaucauaguaauguaagauguuagcaauaggggaaacuaggcaugagguagaugggaacucuauauuaucuuugcaacuuuucuguaaaccuaaaacuauucuaaaauuaaaaaguuuauuuggcugggcgugguggcucacgccuguaaucucaacacuucgggaggccaaggccugcggaccaccugaggucaggaguuugugaccagccuggccaauauggcaaaaccccaucucuacugaaaauacaaaaauuggccuggcaugguggugugcgccuguaaucccagcuacccaggaggcugaggcagaagaaucgcuggaacccaggcggcagaggcugcagugagcugagauugugccacugcaccccauccugggugagaaagcaagacucuaucucaaaaacagaaaacaaaaaaaaguuuauuaaauagaaaaauaggaggaaagaacuuuuaucuuaacaucagacaaaucacaacuuuggcauaagccuagugacuaggccacaugaucauaaccaagcaacaaucagucagaugucagucuaaucauagguccuguuauuuucaguaaaggggaaaaaaucaugaaaguugaaacugcaagucaaaguauguaaaaucauaaaaauggaguagcguguggcauggagcuucuauagucccagcuaccgaggaggcugaagugggaggauugcuugagcccaggaguuugagguuacagugagcuaugaucaugccacugcacuccguucggggugacagaggaagaccuugucucaaauaaauaaauaaauaaaaugaaacugguaagacagcaaaguuuaggugagguguuguggaaaauaggaagccauugcuaauuucuugagugaggaacuaauguggcgaaagcaacaauuuagggauuuauucuaucagcagccugccaaauggauugaaguugggaaaaaucugaggccgggggaucagcaauaaguggcacguacuaaaaucucaagaauaaaacccuaaaaugaaacuuuugguaaggguuucaagcaacguuauucuuagugccacaugugaccuguuuuaagcaccuggagacaagcagagccucuuguggagacagauguaucagaucuucaccugacuucauuugauaucugaaucauagaacuauuucauacccccuucuuccaaguccaagcucuccuggcaucuugugguuaggacuguaucucguuacuucugcuuauccugcaguggcucugggcuuguuugauaaucaaacugagccggcccuuauuuuuaauuuuuaacccauccuaauggggcuuuuuuauuuggaaaugauuuuaaacuuauagaaaugcugcaagaauaagaaugguacauagaacaccaugcuacauauuguuacaccucuguuaaacauguauuuuaccccauaugcucauccauucucucucuauaucuaucuagaucucgauaucuaucuauagauauaucuauaucuauauguauagauagauaucuagauauaucuagcuauugagaucuagaucuagauauagaugucuauagauauagauauaacuagcuauugagaucuagauagauaguugucuagauaaguaucuagacagauugauauagauauauacagagaauauuagguccauacucucucucucucuauauauauacacacacauaucuauuagguauauaguauauaccuaauacuuuuggaucacuugagaauaauguauauacgucauugcccuuuaguccuaaauacuucaauguguauuuccuaggaauaagaauauccauuuaaaagaaucauguuauacuucuuaucuucaguucauuuacuuagucacuauuucuugaauugaaccaaacuauuagaacacccauuauccuggucugaucugacccacugcuaacggaauuacaggagugaaaaauucaaaguuucauuugcauuucagguuuuggucuuugagaguaccauagaaucaaguuuugcaaaucagcuuugaauuugacucaccauggguuuguuugauucaguucaacuguucuaaaaaccucuuugucaaagaacaauacuaaugccaacaguggcaaacacuaaucuagccuuccuugauaugugucagacaguguuuuaaguacuuuguauuuaccaaugcauuuaauccuuacaacaaccuuaaggaaaccauaauuaucucaauuuuauacauugggaaauguaggcacagauuuuaaauaacuugugcaugaauacacaguugauaaggggaucucccagauaucuuuuuaaauuuguuaaucuguguguguguguguguguguguagccuucuuacauuucauaauguuuucuuuaaagacgaucccacacuauuucuaguuauugauuacuucucauugugucauguuccccuaggacagaagcauucauuuucuugauguguuuuuucagcugaagaaaaggugacuggucucaugagcccugaagaaugaacucagaggagguuguuuacaugagguucucccacucaccagcuguugagagucugcgauuaugaagagcaggaucuuauuacuucaaugaaagcauguaacaaguuucucaaaccaccaacagccaaguggauuugguacagugcggcugucuaauaaauaaucaaaagcauuugauagaaaucugucuugcagcacugucuucacauuuaauguugcuuucucuucuagucucggguauguuuaaaugauucccuuuucucacucuagcgccaauacuggccugaaggcuagauccccagcgaaauucuuguucaggcugggucugucgacuuugacucugcuauuuauagagccaauguggguuaauaacuacuauuuauugagugcccguuccaugccaagcauuaggcugggugcuuuacauaaguuuaauccucacaauagcccuguaagguugcaccuauuaucuccacuuugaccacgaagaaacggagacucagagaguuuguauccuauguguaagaucacacaguugucagagucaggauucaaaucuaguucuaacuccaaagcucuccacacuaacauuguuuugcuuauuauugcuccaaagauaauuaccccaacaccuuaucaaugcuauacuuccucucauaauggcaguguagguaugugggaagugucugagauggaggaccagggagucuuuagaggcgcaaaagaaucacagaauuaucuucuaaaaaaaaacacaauauucuuugagaucaggaguugauaaaauauggcccccagcuauuuuuguaaauaaagguuuauugggaacacagccacacccaau

SEQ ID NO: 13968 - RNA, 36473 nt, Homo sapiens
cggacggguggggccgggcggugccggugcgggcuggggcagugcagugaguagcggucuuggggugugcgaucucgcugagccuccucacacgguucgucgucucggguucgagcccagugggcuuagccacucgccauggacucccagaaaguaagcgggggaggggagcccggggcuaccgagacaagccgggccggcacagggugggcggggcgccugggcccgugggcugugggugcgcggggugggccuggccgggcguccgggcugcugcugcggagggcaaggccgcccggccgcucucugggcgggagcuaagaggcgcccacacggaugcggggaccgcgcccggugacucgggcuggccucugcucugcgcgcuguccggggcccugacucuggaggagaaacggagccaucccccuuuuaaaaucagccacucugcagcgcuuuaggccgguuuucaugccugcagacugcgagcgugcugguggggguguaucccuccucagcaggugaggaaaccgaggcacagccuuuuuggugucucccugcugacgccgaaagcuggggcuuucuccucgaccaagucucgucucagcaccacgcucuuuaggucagggaccgaaucuccuuuguaccgcccaccgcuccccuucccaugacuuuuccuaaguagaucuuaguguuuaguguucguugaauggagggaaaagacuucaauuguuagggcagccuucccacucucugaccaguugguguugcugggcacaguuacuuaggggucguuguggaauguuuuauacuuuccgaacaguugaggaaagguuauauaaucguaaagguucaauucagaaguauuuggagaacaaagccaaugucuugaauacaguuagaagugaauuauucagucauaaucuccauaugaaaauaaccacccuguucucuuuguuagacuauaacguaauugaaauauaguacaggguaggaaagaaaaaacaaggaguauuaauaauguagcagggaaaacaaagacauaucuaagagacuauucuuuucuauuauuagaaagcacgggaaagacuuagaacaacguuuucuacaauuuugucuacauucaccuucuugaggaucacuucacugagggcaugagagaauaaugauguguugagcauugacuauuacaguauuuaacaaauaugcauaugauuucauuguauguguuggucuugaaacucaccuuggaaugcaugacuauucuuaaggcauuuuuuaaaaauuagauuuuguguauuuugaguauguauagguuuaaaauauugucucugccuaaauuuguaaaacaucucucagcuuauuagauaaaagaaaugauauuugaauggacauuagcagaggucaagugaaggagcaaaguccggagacauggguuccaggaugcuauuuacuagcucugugauaaggagcaagucacuuaacugugauuaaucuguuuccucaucuaugcaguagaaguaagaguauuuuauagugucauaguaaaaaucugauaaaauaguuuguucugaaaacacagcauuuuaaaguuuacaaaguaugaccacuaaaauacugugucccauaaaauacaaaaaaauguguuuuaauauugaucaucauacuuuaucagggaugcauuauuccuuacuuuaaugaguugugacuccuggaaggucaugcuacuagcccuaaggcuaagauuugaaccuauuuguucucauuucgaaugauguguuaggguaccuacagguuaccacgugcaguuuccugagagguagcaaagaauuagcuucucuuucuuaguaguaguaguaauguaucuuauuugugauaucuuugagaaucaacuucucaauauuagaaaauauguugaauuucauuggugguaccaaaucuuucuaaugaaaaaacaaacacccuuugguuuauagcuguaaaaagaauguccgggauuaauguguauaaccaguucagugcucugaaccugagcuuccuuuucucguaugaauuccugcagaaucacaagccucaaauaguaaugaucuaagcuggauauuguucucuuuaaauaagacaguaguacaccccagacaugauuuuuagauacuauuuucuguuauggaauguacauugaaaauaguaguagggguaguaccucagucaguagaguauaagaaaaauagguacugcaaagugugaggaaggccugaauauauaccugaauguuuguuaggcauugggauuugggcuuuacauuaguaagaggauggcucuggagccaagucuccaguucuacuauuuauaagcuguaugagcugggauaguuugcucugucuccauuucuucaucuguaaaacagagauaacaauaauuguaauucucucacaagauuauugugaggauuguguucuuuuuuuuuuuuuuuugagacggaguuuugcucuugucgcccaggcuggagugcaacggugcaaucuuggcuuacugcaaccuccgccuccuggguugaagagauucuccugccucagccuccugaguagcugggauuacaggcgccugccaccaccccuggcuaauuuuuguauuuuuaguagagacgggguuuuaccaugauggccagcuggucucaaacuccugaccucacucaggugauccgccagccuuggccucacaaagcgcugcgauuacaggcuugagccacugugcccggucuugcauucauuuuuaaaacccacuaaacagugccuagcauacaaaaauacuguuagcuacuguuauuaauuuaauaauccuaacuucaaaguaacuuucuccuuuuaaaauuaaguguagacauuuuuccuuuuuuuugagacgaagucucgcucuguggcccaggcuggaguagugcaguggcgcgaucuuggcucacugcaagcuccaccucccagguucacgccauucuccugccucagccucccgaguagcugggacuacaggcucccgccaccacgccuggcuaauuuuuuguauuuuuaguagagacgggguuucaucauguuagccaggauggucucuaucuucugaccccgugauccgcccgccucggccucccaaagugcugggauuacaggcgugggccaccgcgcccggcccgacauuuuuacuuuuaaagcaucuuuucugcuauuauaucuguaagaaacgauucacauggugguuccagagaagaguuguuacauucuaauagaaagagguuuggaaguucugagucaugcagucugacaguagagguuaacuuaacuaggcagucuuacagaagcuucaugguggcuagucaacaaauggauuagcuugaccagcugcuuuuuuguuugugaaaauaacuuggacuucaguguuaauguuagcagcagaugcucuguuugaguagaggaagaaaacguaauaaccccggguauguaggcauacuguuggauacagaaaaccacaguauuaacuccuggaaauaaacagagggauuuuguuuauaucgaguuucugggacgcuuucgugaacaggauguguuauggauagguggcuuuuguuugauacucaaaccuuuugauuaugccuuuaaacggcuuuaagauaaaaucccaaagguuucuuuaccggaugaaaugugcacguucaaagaaaacguugaaacaaauaagacauuuguaccuuuuuagaaucuuggagcuuggaauuuuauaguuuaacuuuuuguacagauuauucacauacauagggaucacucuuucuaagaaagguacuuacuguaggaauaagaaaggguggagaggaagggagaugagagcucagaggaaggaagucaccaagagcauauauugucacuuguuugcuuuuccccauuauuuuuccugcauauucuuccuacuuggaaagggguagugagugacaggugaggcuugacuggacaaaacuagauuggggagauugaacugagcaggaguuuuaaacaugacaaccugcaacaaguagcagaucuacacuuggcuuccuuaucccaguuuccugcuccaagcuaugugcuauucuuugccuucauauuguaccuuacuaguucugagaaccccaccacauccauaaccaaccaacuguuccauguuccaaaauuacgccucaguuaaaaaaaauuguuuccugaggaaagaggaaugaaauuugauuacuguucugcauccaguauugugucggacugucacaacaguucuuauuccuguugcacuguuagggaaaaugaagcccagagagguuaagugucuuguucacagucacacagcuagcaaauaguagucuggauucaagucaaguuuuucuuuacaacccauaguuuuuucauuaccacgcuucuugccugaauucuuugcauuucaauggugguaugauuaaaguaauugaaacuuaaaauguaacagggauaagccccuauaaagcaggguucccucccucccucccuccugugggcgcucgcucgccugccugccugccugccugccugccugccugccugccugccuuccuuccuuccuuccuuccuuccuuccuuccuuccuuccuuccuucuuuccuucuuuccuccucuccucuccucucuuuuucuuuucuuuuuucuuucucagagucuugcugucuugcucaggcugauggcucaccauggcaaccucugcuuucugugcucaagcuauccucccagcucagccuccugagcagcugggacuacaggugcaugccaccauauacuuggcuaauuuuuguguuuuuuguagagacaggguuuugccauguuguccaggcuagccuugaacucuugggcucaaacgauugacccgccuuggccuccuaaagugcugggauuauagguaugagccaucacgucugaccuaaaguuguuuuuuuuuuuuuuuuuuuuuuguuaagcuaguuaaguguagugaaaauaguugauagaugauaaagaacaugauuuagguaaaaaccuggaauuuggucucucuuguugccccaaauaaaaaucacuauuuuaauuuuaauuuuaauuuuuuuugagacagagucuugcucugccacccaggcuagagugcagcgguaugaucuuggcucacugcaaccucugcuuccuggguugaagagauucuugugucuucgccucccucguagcugggauuauaggcgcccgccaccacacucagcuaauuuuuuaaauuuuuaguggagaugggguuuugccauguuggccaggguagucuugaacuccugccugaccucagaugauccucccaaagugcugagauuacaggcaggagacacugcgccuggccuaaaauuacuauuuuuauuuugugugugugugugugugcgugugugugcaugucugucugcauguaucuuuccccuuuuuucaacucuuuugagggaaugucuuagcuuucuauaguagaacugugagcaagaaaguagaaaugaauaccauauugacauacuuaugaccacuauauauaauacagauacauucauuuuucaauugaacuuggcaguuuuuaaaaauuagaaagauagugaagcagaccuuuuuuuaaaaaaauuuuaacauagugcuuguuugcaaugcguggcugaauguaagcaggauuauuuauacaguaaacacauauugaauguuugcuguagugcuagauauucuacucuuaggguggaaaauauuuuaaaguugguggauuuuaucuccagacuuuuaaaaauauguuuuucacucuuuguuggcacuucuucccagccacaagguucugauagaaucugguuucaguuauugaugcuuguugauugcuguuaauugaauuuugaacuaauuuauuaaaaaaguauuaacguagccagcuuuugcauuucuauugcauuauaaauauagguaauacaaguuuauuguaggaaaauaagaauauaaauaaagugaaaauaaaauaaaaaccacucaauucugccacccagagauaaccucuucaacauuuaugucaccaucuaguuuuuugguaugcauauaaaaacuuuucuaaaauuaugguaucaugcuauauaugcugcucuauaauuugcauuucacauaauaaauuauggauauuuuuccauauuaaucauucuacaauacuuuuaaugauucaacagaauucuuuuguaugcauguuuuacaguacccuuuuguuguaucuuuuuguugaucccaaccuuuuaauguuauaaauaucacagauaagcauccuuguagccaagucucugcuuacacccuuaauuauucacuuacaauaaauuagaaauggaauuacugagucaauguauaucuauuucaaaaauuuuauuugauacauauugucaaguugcccuugagaaggguuguuaguuuauacuaauacucgcaucuccacuccaaugccaccuucuuucauuaaaugguaggaccucugguuucuuuggccgacuaugagccuccuugacuuuacuggguaaaacagccaguucaaaggccacugcacaugguuaaggcuucuuuauccucuggugugcuuuauuuuccucaaauccuagaugggagauuaccuccucauaugcugugauaucuuaaacuggguucagggcagaaaggcagcauuccccagccaguucuuuuacuagcauuuagacuuuuucucagcugguaagcuagacaaucagaauugauuguaggcugucucaguuacaucuguguacagguaguguucucaacuguuucacuguuagagaggguguagccuuccaucauuuagguauauuaugauuagauuccugaauuucccaguucucuuuuuuucaccuucuugcaucacaucugagcaugauacuuuuguuaaaauaacuggugagauucugauuaucuagcuaacagcuggauagcgcuuucuugauuccgcucuuuaucacuguaugguaaaccuaccuaacagcaguaguuuaagcauacuauuagaaugauccuguauggcagacucaccugaaugugucuucugagcuucacugggcuguguaguuaccuuguccagcccacugccacuggaccuuuucuguauauaaggcaguucuccugcucagccugccaccacuggacucucucccuuguauguaaucccuuaauaaaauaccaugccucauuugguggcucuggguuucuucagccucuugaaccuggugccauccccacuggagucgauggagggguucagcaugaagucaccuaauucaaaggacaggucuaugugugggaugaugcaaguggcaucauuucugguggcauuauugggcauuuuccaggaauguuacaugcugauuugaucaaucccuuuccucugguugcaggaacccuaugauuauuucauacaauccccaacaguuuaggcagccuaggguacaggcucuggaggcaaccuccuggauuugaaaagcagagguucuggggacaaccuccugaauuugaaucaugacugccaguugauagcugugugaccuaaaacaaguuucuuaacaucuugaaucuuuccuuuuuccaaccauaaaaugugaagacucauacuacuuuuuuaucagauuugaugauuaaaaaguuacuccauauuagcagcacagugccuggcacauagaaggugcuuaaugaaauacuaacuaaauuggcuauaauaauaguuugacccccuuaaauuauagaucuauuugugguauuugcaggggcucuagauuuuuguaucuugauuuuuuggaauacuacuguagaauuugacucagaagucuucuccuccucugagaagaugcuggugggaaacccauaugucagcauuucucuaauuaugaccacauggaugcugaugcccucugauuugggguuauaaccuguugaucaguuccagguuuccagauuguugaucaguuccagauuucuaaucuugaaguaaaaucuuaguccuuuggaugccuuuagccguucugaccuuuucaugaaccucugaucucuguuuuauuagguaguacaguguaguccuuuaagagcauagacuuaggaaucaaacugucuuaauuugaauccuggcugugugacauauuagcuuugauauucuaggcaagcugcuuaacuucuccaugcgucagcuuccucauuggaaaaugaggauaauaauaguaacuuacuucauaggauucuugaaaggauuaaaugaauuaauaauauguauagagcuuaagauaguacuuggcacuuaagaguaccaaagugcucuuuugcucagucuauugauuauccuuuuacuugauugauaaugauuauaaacauaacuuuaagcugugcugcguugaagagaguaacuuauaucuuguacaucuuagauuacuuugauucauuccauaacagugguugcaguugugcuuggcuaggguguauaugaugcuuuuucuuguugguguagcaguugccuuagucuaaauccauagucacaucauuguauuuuuuuguuguuguuaugagggccugguaauugugcuacaucaccaaaagacauuugcugagauugccugugcagacuuccuauggagacuuaucucauauauuuuacuaugaucuagcagaauuggcauuugucaaaacaugucuucagaccugugucaccuagaacuuuuaguugucaccacaugaaucuuauaaaauauaauuuucuagauaagcuucagauaauuuauauugccuuuauucaucucuguuuaucuauuuauccaucaguguuuguaagguaacgggaggcuugagaucugauauaaaaaucugagaccuucguaggcauccuuuaagguugauagaaucccauggggcagaugaaaguugucuuugcccuucuuuacccauaaggcuuugauuagaaaaaaaaaugaaaugacuauauguaacaugggcucauucuauaaguacauuuuuggaauuuguuuuaucaguacauuguguauauguuuuaggacagagguuauagguagagaaacugauaagugagagggcuccuagguagaaagcaagucagauuagauaaauucauagcaggcuaugcagcuggaguguaacaagggagaggaagucuggggagaugaagcaggugagguaggcaguggacagaucauuugagaucuuauaggucauguuaaagauuuucaguuuuauccaagguacaaugggaagcuauugaagaauacugaucaggaagagugaugcuaucauuacccuagcugaaguauauagagaacugauuacuggggagaaagauuguuaccagagucugauuaagaaaaauuuugcuacagugaagguugagauauagguugagauaugauaguaacuuuuacuaagauaguaguaauaauucuaaugucacaggauacuuuggauguuucuuaaccagcuagaaaccucuguagcuggcagugucucuccuugaguuucacucaugccggcugggcuuguucugcccacuuggccuggcaggcugugcuuagcucaugcugcuggccuggaucccacaccugccgagggcgagccaggcauggagcagugaggggugugugagcgagcgagugaguuugggguccggccacugugcacagccuagcaugcuggcugcuguggccauacgggcagcuccgggcacuggcacagucacuggcuccaugcgaggcugcagcuggaccaagcauacugcaaguggcuuccucugugggugccugcgucuggaugaagugaacacaguggugccugaaaacucagagaugccaguaacugcagagccccaaggggucgggggcaggggugcuacaccucucuuguuccugccaccugcagcuuggccagugggaguggcagggcauguuucagccuguucaguccugccaccuugcuugggcccguggcucccaggcuggcccaaucccguugucacuugcugucauguggggcagccgccugaugcugguggaaguugggagggcuauaguguuacagcucuggcucagggaaucccgaggucuaggcccuuagaaguguugcuacucuucacuccugcaguucaugucacugucugcagcuuggugagcuggccaggaacauguuacagccccuuuugcuccugucugcagcuuggcaagugggccaggaaaguguuacagcccuuucugcgccugccuuuuggcgguuccugaguucuuguccugcguccaggaagaaugagguugcauggacaacuggauggugagcaaggcaguggagaguuuuacugagugacagaacagcucucaguggagaggaguccugaaauggguaguccugauagauggcugaguccaggguuuuuaugggcucaaaguggggaagugcaugcugauugguccaugggcaggaggaaguaugugcugauugguccaugggugggcguggaaaaagcaccauuuguuugacugaaaggcauaaaggaaauucuuauucaggguuguggauuccaucaggaacuggcagcccaguuuucaggcuucagacugucuuuggccugaaggucagguuucaccagggacccaccccuaucugccuaggacuacgucugccuccugcugcuaucacuagaaccauuaagggguaaaaucuauagaacuuugugacuucacguagagcacaaauuagaggagaggagauagugaugauggccuagcuuucugucuucgcucuugauuaaauuuggagguccuggagggauagacugggguagaaaacucguugaauuaugauauauuuuagaucuuuucugcucucuuucucugcccuggcauauugccuaccauaucuagaaaacacuuuuuaaaaacugcuggauuugaugccuguucagccagucuccccuuguauaccuccuagauuaggcacauacuauccuuauauacaccuuuuacuugacuccuaccaccauagagaaaauuuuagcuuuaugucacauaugcaagcuagggucaaguuucagaacucagcacauguaauccuguuucuuuaguuuucauauguuuuggugcuguggugguaguuuugucuuaaauauucugauuccuuguaacuuguuuuccaguucuacugagcaccaaguuccuuagugcuuuuuaucuuuaugccauuuccacuuaguuccagccaguccccauucuugugagggucagaaagguugaagccuuggcccucucccugauaaacuuacuauuuuagaaugcuaaauaugagccuuggauuacagucuuuuucauuugcucauccucucuacagcaguugcagauuaaagggcaaguggaucagagcuucuggagccuuugucucaguagucugcccuuggggaacuuugcgaauauuuccuuccuccuuuaagcuuagaaaagcuuagcagagaggcagcauuuuaucuguauuagcuaacaaggucacauugguugcuaugacuuucucuuuaugaucugaaugguugcuuuuucugcagccagguuuacuaauguauucgguagcuuugaaaauauagaugaucuuaaaugcugggguuccagaguccucuacagcuggcuuguccauucugauagcaucucagugguguauuguagccaaggcucugaagcccuccucaucuaaagauugcagugcguccucugaaaauaaucuaggccuuuagucuuugcaguuuuggcauuaggguaaagcaacuuuucucagaauguggacccuuuaucuagguguguauuacagacucucaugcuguacuggaacuccuuguuaaauucaagagcuguagagugcucucucuucaaagaaugagacuguguuucucagaaauacuauaucagccuuuaaagaccuuucuuucucauccacuuucuggggaaguacaguauuuuuacagccuuaggcaauucauauaggauaucauuccccuaaaggcuuuaacacagauuguagaguuucuuuccagaaguauggcuauuaauacaucuuaggccaauacaguugaaaagggucuuucaucugugguaauagaauuuugaaugaauuuaagaggaaugguaaagauaagauuaacuguaaucgcugggagugguggcucaucccuguaauccuugcacuugggaagccgaagugggugaaucacaaggucaggaguucgagaccagccuggccagcauggugaaaccccaucucuaccaaaaaauacaaaaaauuagccaggcacgguagcuugcaccuguaaucccagcuacucgagaggcugaggcaggagaauugcuugaacccaggaggcagagguugcagugagccgagauugcaccacugcacucuagccugggugacagagugagacuccaucucaaaaaaaaaaaaaaaaaaagauugacuguaaucuaagggugguauuuuuuuggagguaugcgauaguaucauagaaaauggaaggcauuauucugaugauucuuugaauuugucuaaccuguaugucaguuguccuuaggugcagucuuguuuuuguuagcugccaacuuugacguggacauuugcacuuucugugaucccaagaagucuucucuaacccaaaacaugagugaacgguguaaauuucacaggagagaggaguguauuuguuucuucuguuaugguauuggaccccgaagugguguuacuuauguaccaauuucuuuugagaguugguaauuuuaaaaugucuuucaccuucuagaguuaauauuuauguaaauaaaaacugagaaaugagugaaauucugguaaaggaaguugguuguaacauuuuaacuuauauccacauauagcuauuauaauucaagaaucuggcauaacauaagcacauaaagaaauucuggucuuccaagaaaaaaguucagaaagcuuuuaggucguuuauuuuuaauugcaaauuaauaagauuaauagaggaucucugcccuauuuccacucuuagaaauauauggucuguuuggaugacauagaccucuuaagucuguauuauccaggaugguagcuucuagccguaaugugguuuuugagcacuugaaauguggccaguuugaauugagauaugcauaaguguaaaauacaaacugaauuuugaacacuccguaccaaaaaaaaagaaaaacucauuaauuguuaaauauugacuacauguugaaaugauaauauauuuugaaucuauuaaauaaaauauuaaaauuaauuuauccuguuuuuccuuuacuuuuuugauguggcugcuauuggcuccuacuguauuuauauuggacaguacugcuuuaaggagaaugaaaacguuacaguugauaaagccuguuuucugaucucuaacaucacuauuggaccagagucuauuaacuugcagcagguugguagcucuuaaaggagcagagguuuuaacuugaagaucugauucaaaauuagagcauuuagaugucuuugacuauacucauuaaaaaacaggaacauuaaaaagguaggcuuuagcugggagcagggaucaugccuguaaucccaacacuuugggaagcugaggugggaggauugcuggagcccagaaguucgagaccagccugggcaacauagugagaccucgucucuacaaaaaaucaaauaaugaggcagguggauauggcuugagcccaagagguugaggcugcagugagcuacgauugugucacugcacucccaccugugugacagagccucaaaaaaaaaaaaaaggcuucucauuaaaaucuugggagcucaggucuuaucuaguuggggcaauaaguuacagcuaucuccagauuuuugcuauguaauuucugaaaugcaaagcuugcuacuaaacuuagaccaaaaaaauauguaaaugggaagcuauuuuaugcuaaggagauuuuauuuuuugcucugaacuguaucugccuuuuuuuugguaccaauguuuuauaauuuuuuuugguggaaaguuuuuuuaaguuuuguuuuuuuuuuuuuugagauggaaucuugcucugucacccaggcuggaauguaguggugugaucucggcucacugcaaccuccaccucccggguucaagcaauuuucuugacucagccucccgaauagcugagcugggauuacaggcgcccaucaccacgccugccuaauuuuugucuuuuuaguagagacaggguuucgccauguuggccaggcugguuucaaacuucugaccucuggugauccacccgccucagcaucccaaagugcugggauuacaggcaugagccacugugacugacauuuuuuuuuuuuuuuuuuuuugagacagaaucuugcucuguugcccaggcuggagugcaguggugagaucucggcucacugcagccuccaccucccaguucaagugauucuccugccucagccuccugaguagcugggauuacaggugcaugcuaccacgccuggcuaauuuuuguauuuuuaguagagacgggguuucaccauguuggccaggcuggucucaaacuccugaccucaagugauccaccugccugggccucccauagcgcacaugugugguggcacaugcuuuuuucacuacuacaauacuuuauaugaacauuuguauaaaauguugccagguaugguagcuuacaccugcagucccagcacuuugggagguugaggcagguggaucuccugaggucaagaguuugagaccagccuggccaacauggugaagccccgucucuacuaaaaaugcaaaaauuagcugggcgugguggcggacaccuguaauuccagcuacucgggaggcugaggcaggagaauugcuugaacccgggagguggagguugcagugagccgagaucacgccauugcacuccaaccugggagacaacagccaaaaacucugucucgagaaaaaaaacuuaaaaaaaaaauguuaucucccuucagacuguuuccugggcuccuuaucuauaacccuuugucgauaucugauuauauuuuuuaggaaaaccuuuauuccacaaagucuuauaggcuuuauuaaaauauuuaagcucauaggugcuuacagaaaaaaguccuaugcuucugagaaaauuacaaaguauuaaaguacuugcauuugauuuuuuucugagacuauaaauaaccuuguuugguuuuugcuguugcuaccaaugaggaguuacugcaacuagacuugugcuguccaauaugauagcauugguuacauuugacuauauaaacuuaauuaaaguuggaaaaauuaaauuuaguuccucaguucuagucacauuucaagacuucuuuaacuguguguggcuaguggcuaccauauugggcagcacauuuauagaacauuuccaucacaguggaaaauuuuauuggauagcaccgaaccagagagaaaauuaaccaaauguuuuauuuaaauaggaagcauuaucaaagucugagcuaucugcuacuaaaauugcuuuauuuauuauaguucuacagcaucuguaaauauuggaaugaauguugucauucuaaaugcacauguauuaucuaguuucauaucucuaaaauagguuuauuuuuguaaauaaauaaaauguugaugaauuugugucuccucacuuuuauuccucgguuccugauguuguauuccguuuccauuuguuuuuacagcauuuaaagauuuugcucuauuccauugucauggcugaugaccuaaaauaauucuauugauauuaaguuaaacugaucauuuucaaucugaaaaguaucauggugauuaaguugcauauuaggaauaagagggcuuaauacaguacaaauauauaccccaucuuuucuaauuauaagccuuuggaaguuuugaagaaugagaaauuuuacauugcuccuauuuguuauacaauauacucuuacauaaaguuuguuuagagaaugcuuguuaaugaguuuuguaacucuuccauugaaauauaguauuuuaaugcuuuucuuaauucuaggaagcucuacagaggaucauuucaacucuggcaaauaaaaaugaugaaauucagaacuuuauugauacacuacaucauacacuaaaaggaguucagguaugauuguuuuaugaaaaauuuuguguaaauaugucacaaugagccaaaucugaaguacaaauauacucuaugaauuuuggguuauaaacuaauggaggugagagcagagcuuuaaaauagcagauaaaguaaaaauguuuucauugcaauuccuguuuuguccauggaaaaauccaaauaguaagggaaaaggaaaacucuggaauaguaguuguuagaaaauaccagagugcucacuuuaguccuuuuccauuugacauuuuuucuaauauaaauuaagagcaauuuguaguuuuucaaaagugcuggcaaguaaaacguuucuuuuacaauaaacaauagaagaaaaauuuuggcuacgugugauggcucaugccuguaaucccagcauuuugggaggcugaugcagguugauggguugagcccaggaguuugaaaccagcuugggcaacauggcaagacaccgucucuaccaaaaaaaaaaaagauacaaaaauuagcugggugugguggcauacacaugucaucccagcuacccaggaggcugagguaggaggaucgucugagcccaggacgucgaggcugcagugagcauugauuguaccacugcacuccagccuggguaauagaacgagacugcaucucaaaaagaaaagaaaauguuauugguaaggggucuacuuguagaaguagaugaaaguaacauaaaaauaaaagguaaagugcccauugagaagggagaggaauacuuaagaaaauaguuccagguuuggggagauaaucuauauuguaaguagugacauauugauuguggaagagagaacucaagauaaucugguugcuagaaauguacaaucuaccaagacugaaucagaaagaaauagaaaaucugaauaggucaauaaugaauaaggaaauugaauccacagugaagucucccaucaaagaaaagccugcaaccugaugguuuuaccacugaaaucuagcaaauauuuaaagaacuaauaucaguuauucucagccucuuccaaaaaaaucaaacaggagggaguaguuccaaauccauuuuuacaaauucaacauuaucccaauaauaaagccaaaccagggauacuacaaaagagagaaauacaggccaguauuccuaaucaacauagaugcaaaaauccucaauaaaauacuagcaaacugaauucaguagcacauuaaaaagaucauuuaccaugauccaguaggauuuaugccugggaugcaaggaugguucaacagaagucaauaaaugugauacaccauauuaacaaaacuaaagacaaaaaaaaguguaugguuaucuuaguagaugcagaaaaagaauuugacagaauucaacauccuuucaugauaaagacucucaacaaauuagguguagaaggaauguaccacaacacaguaaaggccauauguauaauaacaaucucacagcuaccaucuuaucaaaggugagaagucaaaagcuuuuucuguaaagucaggaacaagacaaagauguuuacucucaccacuuuuuuuuuuuuuugagacaaagacuuguucugucacccaggauggagugcaaugccgcagucucagcucacugaaacuccugcuuuccagguucaagcgauucuccugccucagucuuuagaagacucuaaagacucuaccaaaaaacuguuagaacugauaaauucaguaaaguuacagaaugcaauaucaacacacaaaaaucaguauugcuucuauacaugaaaaacgaacuauuucaaagagaaaauaagaaaacaaucccauuugcuguagcauaaaaaaauaggaauaaauuuaccuaaggaaaugaaagaucuguauacugaaagcuauaaaacacugaugaaagaaauuuaagaagacaaaugaauggaaaaauaucccauguuuguggauuagaauuaacauuguuaaaauauuuguacuacccaaaguaaucuacagauucauuguaaucucuauccaaauaccaaugucauuuuccacagaaauagaaaaaauucuaaaauguauauagaacuacaaaagaaccagaauaaccaaaauuaucuuuagcaaaaacaacauucaugggaggccgagucagguggaucaccugaagucaggaguucaagaccagccuggccaacauugugaaaccccaucucuacuaaaaauacaagaauuagcuggucgugguggcaagcgccuguaaucccagcuaguugggaggcugaggcaggagaaucgcuugaacccaggagguggagguugcagugagccgagaucgcacuacugcacuccagccugggugauagagugagacucugucucaaaaaaaaaaaaaaauaauuauuuuagcuaucuugaacuauuuuauuggaaaauuggugaaucagcuuucuuuagauaagcauaaaacucauggcuauaaagcucuugaucuguggacaagcgaaucaucacauuugguaucuggaaagagagaucuuauguagagcuagcucaaaccauucuucugauugauaaauuauuagaauucuaccuuaacguuagaaaaaaaaaguagugggggaauuaaacuacaaccucguugcugaagaugggagcuuaguaguaggcaaaaggcaacaagaugccaucuggugauugagaggaaaauagucuguuucuuuuuuaugaaugaauagacugaggucuaggaauuuaagugccuuguauaaggucaugcuguuacugaguggcuaaugugggauuugaguuagguuuuuucccuuccugacugcacauuccacuucuauaguuguucuuacuacuguaaauagacuaguaaaauaauuaccaccaccuuugaugaggugccugugagguaucuaguuuuuauaaacauuauaagcaaaaguuuggacauauaauauuacaguagauuguauauauuaguucucuuagucagugccaguucgcuucucuuaauugaaugauucauccaaguugaaaaaugucuuaagagaauuucuucuaucucauaauuguugcaaguguggauauugcuuaucuagggauuuuacaaauaauucaaguuauuuuuuguugaaauagcagcaaauauagcaauggggaacucaagagacuugaaaugcauuauugaccauguuacuaguaacuaauuguauggcuuugggcaaguaacuuaucuguauuuuaguuaauaaaauacaggauuugacuacaaauucuagucauuagaugauuuaauauuugauaaauaucuuaggauccaauaaauaauugcuuagucuuuuaauuucuguuuaucuuacacaaaugcaguguuuuagagacccugaaagauuuuaaaauuuagacaaaauccgccucauuucuguaugugcaaaguguuccucggaauuacugaauuaaaaucucuggaauauuuuauaagaauaccucaccagugauucugauacgcaccagagguuaagaaccacuggcuuagagucugccugagagacugaaggucuggacgaaguugggaacguuaaaacaaccuuucauguuguccuguggaaacaguaaagugaagagaguaugggcuaguccauaaaagacaacuuaacugauaguauagcugaaacaguauuguuagcauuagcgggcaguuuguugcauuuaucucuuuuuaaagccuuaagucaaauauuagaauuauguuauuuuuauauuaggccaacauaguuuguaauauaaauuuauucucucuuuugggcauaccuuuuagguuuuaaauguuugauagcgcuucaguaaaauuguuuuguuuuguuuuuuaaacaggaaaauucguccaacauacucucagaguuagaugaagaauuugauaguuuauacucuauacuggaugaaguaaaagaaaguaugauuaacuguaucaagcaggaacaagcucguaaaucccaagaguuacaggugagaucauacagcuauugaaauauggauaauuuuagucuauuuaauccuugauuuaugauaagcaaaaauuaaugaauuucuaaguauaacuauacccuuaccucguagaagaaugguuuuuuguuuuggccauaaguauucuaaaauuguuguuaaaaaaacaauuuauucucuuaaccauuuuuuuuuuuuuuugagacggagucucacucugucacccaggcuggagugaucuugguucauugcaaccucugccucccagguucaggcgauucuccugccucagccucccaaguagcugggauuacaggugcccaccaccaugccuggcuaauuuuuguauuuuuaguagagacgggguuucaccauguuggccaggcuggucucaaacuccugaccucaggugauccacccgucuuggccucccaaagugcugggauuacaggcguaaggcaccaugcccagccaauucucuuaaaccauuuuaaacuguacaguguacaguugaugguguuaaauauauucacauuuuuguauaacagaucucuagaauuuuuucaucuugugcaagugaaacuuuaugucccuugaucaacaacuuauuuccccuucuuacuagccccuggcaaucaucauguuauuuucuguuuccaugacuacucuacaugucucauauaaguggaaucauagcauuuguccuuuugugaccuauuuccacucagcauaauguccucaagauuuauucauguuauauagcaugugcuaggauuuccuccuuuuuugugguugaauaauauuccacuuauguauauaccacauuuucuuuauccauuuauaugucuacggacauuuuggcagcuuacaccucuuagcuauugugaauaaugcugcaaugaauguggggguuuaaauaucucuuugagauucuguuuucaauuguuuuggauauguauacuucaaaguaggauugcugaaucaugugguaauucucuuuauaauuuucugaggacccucuauauaauguuuuccauaguggcugcacuauuuuacauccuaccagccgaaguguuccaauuucuucaugugcuugccggugcuuuuuauuuucugguuuuuuuuuugauaguggccaucauaauggguaugacaugauauuucauuacaguuuugauuugcauuucccuagugacuggugauguugagcaucucuucacguguuuguuggccaucaauguauuuucuuuagagaagugucuauucagguucuuuggccaucuuuuaauuggguuacuugggguuuuuggugguuguuaaguugcagcaguuuucuauucauucuggauauuaacuccuuaucagguguaugauucacagguuuuuuuuuuuuuuucccauuuuguaggcuacuuuuuuacucuguugguuguucuauuugauauagagaaguuuuaaaguuuuacgucaucuaauuugucuauuuuugcuuucauugucauauccaggaaaucauugacaaauacaguguuaugaagcuuuuccucuauguuuucuucuaggagcuuuagagcuuauguuuaggucuuuaauccauuuuuaguuaauuuuugcguaugguguuaaguaagggaccuacuuuauuuuuuugcuuguggauauucgguuuuccuagcaccauuuauugaagagacuguccugucccuauuguuuggccuuaguaccuaugucagagaucauucgaucauauaugugaaggguaauuucaggacugucuguuuuguuccauuggucuguguaucugucuuuaugccaguaccacauuguuuggguuccuauaguuuuguaagguauuuugaaaucaggaauguugaggcauucgacuuuuuucucuuucaaaauugugcaauucagggucccuugagauucuacaugaauuuuauauauauuuuuucuguuccuacaaaaaaugucuugggauuuugacagugauuacauugaauuuauagauugcuuuggguaguauggauaguuuaacaauauuaaguguuccaaucuaugaacaugaaugucuuucccuuuauuuuuguuguauauuucuuuuagcauuguauuguaguuuugggugucuaggucucaugcuuuguugguuaaauuuauuucaaaguaugcuguucuuuuugauacuauuauaaguggauuuuuucuuuuuuuuccuucuuggauuguucauuauugguauguagaaaugcaaauuuuuguguguugauuugaguuauagauaucuuugagcaccuaaaagcuguggaaaaacacauauguugucuuucuaucuuacauacacaccauaaaagcacaauuuccaaggaucagauacuguaucuucgaaguguguccauacuacccagguugagguuuguuguucauauuugggggugggggauguauuacuuaaauaauucaaggauaauucguuuauucauaaaguuuccauacauuucaauaaauacuaauaagaaaugaauucauuuaaaaaacaaaacacuguagaagaaaggacaacucagcaucaccugaagauccaacugaaaacucauccugugcagaauucuguucuguuuuggacccagacccuucuucacagcaccacuuuggaauggccuuuaagcauccaguugcuuaaucuccaaccuucccuuuucccucccuguacuuuuucuuuaccagagcagcucuaauugucuucaucuaccacuagccaacauuucugucacccuagcucauacugcauauuaaaccugccaccaaaguggccaugggucaugucuuuucucuugccuuuccuucuucccaucaaguaccaaaaagucuuuugcauauugagugugcauuaugcaucuugaucaacccccuagccaucccuggcaugagugauguuccagugcaacugguaauauuuucccuuuucaguuaccucucaguuccuagugccucauugauaucuguuguuugucgggaccuucuuucugcuugaauauauguggacaguuuguucuucuggcauuguuagaggggagcuaggagcagccaauagaaacauuuuuaaaacuugcaguuuguuagauaaaauugaauugcgagcauucaucuuuagagcaggaaccuugccauuuagguuuagaaaaauacuuccuacuugucccauauucuuuauguaucuugaauugcuaguuuuuaauuaaugacaguggacuaagcuucgcuuaggucccuuuuuguuuuaaaugaugaguguaucuuuaccuguaugcagugaagcuguuuucgauaaauuauggcaagagguacaaaguauuaagauaauuaaaauuuguuauauauauauaaaaaaaauaacacguuuuauauauauauauauauauauaacuugauuaucuugcuacaauagcucacugaaauguuuuuccucuauuauugcuauuaaaauuauuuguaaguucauuauaacaauauauauuuaagauucuaauggcaauaggaaacuucauuuuaaugacuuaguuuuuuuuuuuuuuucccuagagucagauuagucaauguaauaaugcccuggagaacucugaagaacuauuagaauuugcaacaaggucauuagauauaaaggaaccugaagaauuuucaaagguacacaaaaacugcauuaauacacuuaacaagggaaguuguauuuuuaaaaaggcguuuuuguuuuucuuuaguuuuggauuucuuuacugauuucuaauacuaauaaagccuugggguuucuugauaaguaaaaugcuggcuguucauuuauuccaaagcaaacacuuagaagugugugucuuuagggucaucaacaaauauguuuaaaaaguguuucuguguuucugucuaugagcugcuugggaaagcaucaucacuuuaugcacaugagcacuguaauuguguaacuucuuauugcagauaaaugcccccacugcuuaauuuaaguaacugaauguuuuauuacaacauggaaauguagauccuuacuuaagggauauguuuaguauaaaaauguaaaaaguagagcaagaagccugcuaauguuuuaacuuagauccugguguuuaagugauuguaaauuguaaauuguaauuuuuuuuuuaaguagggucauuuuaaaugauuaccauuuugucaaaucaaaacucagaaauguagaauauauuuuaaaaugaugugaaaagauuuggaaauuaagcuauauaauuagcaaaaauuacuguguaguuaucaagauaaaauuugaguuugauguuauuuacuucaccuuuguggaguauguagugagcugcauuguguuagaaagguagcuuuauaacugauuuaugccuagugauuguuuucauuuuaugauuuucugugaacuugaagguagaaaaaacuuccuugagaagguaacauuugccaccuuacaucuuuggauauuaaaauugaacuuuaauugauuucuucuuuuaaacacaugaaucaaaacaaaaguucuuuugcuguaagccaaugcaugaauuaauucuuuaaauuuggaggugaguuguaaagaagcuuacuaaugcacauagguggacuuauuauauaaaggaauuacaagggaaauguacuauauuuaaaaguacuuuaaaaguaugauauguuggccagguaugguggcucaugccuguaaucccagcacuaugggaagccaaggugggugguuugcuugagcccaggaguuugaggccagcuugggcaacaugaugagauccugccuguacaaaauacacaaaaaaauuagccgggcauggugaugugcaccuguagucccagcuacucgaaggcugagaugggaggauugccugagccuaggaaguugaggcugcaccgagcugugauuacacugcugcacucuagccugggcaacagagcgagacccuaucucaaacaaaacaaaacaaaaaaagcacuauaucacuuauuuagagggcauucaugugauaaccuuaagugucuggaacauagcuaagaaacaugcagaaagcaaaagaugucuuagucaucaaaaucaacaucauagaguucauggacaagaguuaauguccucuauucaagaucauuucucagaaucuguugacuguuguacuugauacugcuacuauuuucaguauuuuucuuucuguuuucuacuuguuaacaaauuccccuuuuaguggaguagggcaguuguuaaugacaggcauagucauaguagcaagaauuaccaacugacagccuaagagugaggaagaagacaggaaaacuauagaauguggacacuaauacucaaaaaugccuugaauccaguugauuuaaggagagacugauacuuggaaaaacuaugauaaaaguuuauuucucccacguuucucuuucuauugacauuuuuagaguucuucugucuucuuucucccaaaugcuacccuuuucuguuucacuguccuuuauucuuuccagcuuuguuucuguuauaauuuguuccugacagauuauaaauuagaaagguucugauaaaauaagucacauugugguuuaauaugccacuucgcuuauucuuacuauuugggucuugucuugcagcaguuuauaguacuguuuaguagcuuaaaccauuuggagauguggugaaaugaauuacaaccaugugucgcuuaacgaggaugucuucuaagaaauguaucauuaggcaguuucaucauugugggaacauuagaguguaauggcacaaaccuagacaguauagccuacuacauaccucaguuguauuguauagucuguugcuucuaugcugcaaaccuguguagcauguuacuguacugaauccuguaggcaauugcaauacagugguauuuguguaucucaacauagaaaggguauaguaaaaauacaguauuauaauuuuaugggagcaccauuguauaugcaguccauuauugacugaaacguaguuauguggcacauuacuguaucugucaguguuuccuagccagaaaucuggguuuaucauuuaggaaaaaugcuuaacugagagcugcuugcaauuauuuucuucauauguccaaauaguauccagauaauaauuugauuucaaguaaaaaacuaaguucacuuuccuagccagcuacauggacuacaggccugccucaaacaccuacuugcugacugaauagggagagaugacuuuggagauuauuacuagucuagcaguauauuguuagaugucuggaaaaagaaauucauuuaagguauacuauuugugaauaucccacauuaaagugcuuaaaugagauuaauaugaauggcccaugaggacaaaaaaauagcauaggcuaaaaauugaggcagugugucuuuucauacuucauuaucuucaaaaagaauauuucaaguucuaauauuuaaauuaucacauugcagugucucagcaugagaacugaaugugaaguuaugcuauuuacuggcauuuuacuuucugaaaguaaacaaauacaaauagcacaaaugcaaaaagauuuuagaacauaccuucacuaauuuuuuuuaacugcuagaaguuugguugguaguaaauuuaugcagacggaucaccagcaaaugggauccagaucauuagcuuuauuccuggacuuaauaaauuggcaacaucccaccaaaugugcauucucugcuaauagcuggccugcagaacacugcuuggauccuuuaccaaaauuaguauuucuauucccacccugacuuuagaccuugacuucucucuauagaaagagcugggucaguggaacaauuuccaagucaguguaacuaaauugccaucacaaucaugccacacaugcuccgguugucagaguagaagggagaaaauaguuuccuauccauggggucccuauaauggaauaaaaaguacaguugggugaaaggggaacagugucuucugcauuugaucacagcugaagagggagaauggguuuaguguauuucccacaucucacuuguaaugaaugauucgccuguagaauauuguccauugaguguuaggcucugaccacuggaaggagugaauaagaagaggaguggguagaagcucacucaguacuuucaucaaguaagcagaaauacugccagaagcucccucuguaggcugaaguuaagaauguuaggagagaggagaggaccuucaacaaaagcgugaauguuucaguuuugaggacaauauaaaaaaacagaucuaaauauuuguuaagcacaggucaaauuguaguuuucaccuuaauuucauuucuugguguuuaugucuuacagaaaugcaaucuccuauuguacaaauaugccuaaucauaaaacaguugcggacaguacuguauuucaaaguguauuucaaguuauucacuggggcuuuugugacagauucuuucaaaugaucaugcuuuuugaaaaauaguuccuuuuaugaacagauaaauauaugucuaccaaauacaaaacuucuaauguauggaaucaacuggugugcaaucuuuuuuuuuccaaagacauauuuuugccuaaaggaaaauaaggcuuugaggcucuuuuucccucucccuuucuauaaaaagagaaaugaugauauuaaaaaaagauagaaacaauaagauacuuuaucuucaaagugcuugauaaauucacagaagaaaauaguuucuauauucacccauuacagauuaagaacaaaagagauugggaaaagaucuguuaacuuuuuucuaugugacugggaaaauaucugguuuaacgucuuuaaauuuaauuggcaguuaugaagauugguuugcgauuacuucuucuuuacucguauuacaguuucucugcauucauaucagagauggugccuuccuuucucccucucucucucucuucccucauugccucccuccaucucuuaguuaauuguuuuuaaacuaaaucuuacaauuccauuucuuuaaucagucauagaagugucaccugagaccaaacuuccuuaaguagaauuguaaugcugaauuuugucaaacaucuguuuaauuaguaccagcugauuccaagauuuaccacugcucuguugccaacacauuuauuugagccuacauaauuccauguagugaguuaugaagaagcugcaaugaauguuuagauuuauuuuuagguuaugguacuguauauuauugaaaagcuuccaagaagcuuaguuauauuacuuuacucaacaucacucuuuagaucuucuauugaaauccuuucugccaauuuuguaauugacaaaagucaccguucuugaaauagaggaauagaaacuuagaagcuguauaguauuguguaucuuuuggauaccuuucuguuuugagagaauucuagaaaaaaaaauuauuuuccaauuuaagacauuucuugaaauugggcccuuucaaagaaauaucuucagaauuugaaacucugccuucuaaucauugcucagaauaacuucuuaaaccucucuugcauuuauacaauauauaugcaguaaaauuugaaccuaaaugaaaguggagccaugggaguuuucaguuuuacuagcuggguauauucuauguaaaugcauggacaacaguuuuuccuagauuaucuggcuuuucauuuauuccuuuccugguuuuucacaaacagcaugguacaugaagugauaccauaaaagcuuugcaugcaugcauaugugcacacacacacuaaaaauuuuuaccuuauuaaauuuaguaacacuugacacaaaauugaaucauuguggucaguuuaaaaaacgguaaucgucuucauaucauuggguuaugcaagggugauugguaauauuucucuaaguuugaaaccaguuaggaaauaagacaaaaaaaaacugauaagaggccaaauaaugauaaaagcauauuggaaaagauggcuuuuguuauugggcaaguuucccaauacuaaauaccuagaauuagacagacaaauucacccaggcaugaucagcaggggcugccucaggugaugggcagggggagccucuuucagugaaaguuaugguacagagggaaagaacagaauauauguuaucugugggcaagcaagcugugagaaaaagcagaaagucuaguuucuccuuucaaacccauuaucagauaagucauaucauuuuccuaggagaaauaagggaauggagaggcaaagaguaauccugguaguacuuguuucauaucagguacagagaagaguccuuucuuuccuuccuuuaacacuuacauuaaaaucuuuguuuuguaauuccagcuuuaaugauaguaauuaaaaaaucaauuaaauuaacuuuuuaaacauuuucuaucucugguacuacaguaguuucaugacuuaagauacagauuccacagaauuuguuuguuuguguagcacgugggaaugauuuucggaaacauuaagaaacaaaauuccuuagaaaagaaauagaaugauuaauauacaaggucucaacugauuaauaguaaugcugagacuguauaauaugcugaucucuuaaaucucaguucuguguugccugggugugcuggcucaugccuguaaucccagcacuuugggaggcugaggcaggcggaucacgaggucaggagaucaagacugucuugucuaacauggugaaaccccgucucuaauaaaaauacaaaaaaauuugccgggcgugguggcgggucccuguagucccagcuacuugggaggcugaggcaggagaauggcaugaacccgggaggcagagcuugcagugagccaagaucgugccacugcacuccagccugggcgacagaacaagacucugucucaaaaagaaaaaaucugaguucuguguuuuugaguagaaagaguccucagaccagaauguuuuaggguggauauaaaaaugaccaauaaugaauaggaacaacguuagaacugaagaagagaggccacagaagcauugcuacauauaucuaauuaacauucaaauaaguuuaauaauuauuaaguauuacuauguccuaagcauuuuugcuaggcacuggggauacaguguugagcaaaacagccuugucuaugucugauauauuguuaacuguacugguuacuguggagaaaaaaacuuuuguuggauauauuguauguaaauauaaaagggacaacaguuuuuacuuguuuuuuauuauuuugugugaccaugcagccccaaguaaauagcugaguucccuuucuaaacuugugcuugcauaaaaaaaaaagacaaaagagauaccuuauauauagguuuaaguugguagcauguaugaaaucaucauggagaaagaccccauugcuagaaguauuucucuggucucuuugugucugaauuucugccauuacaacuuucuuuggaguaaagguuuauagaauugcagccuaguuguauuuguuagcaggcaaacucugagaauuccuugcccuauagaggcauauagagaaaacuuggaacaacgauuaugaaguagugaaagagaucucugaagaaaaauuagagaguaaauuugacauguacaagaaaaccaugaaggaaguugucccaugaaggagauugguugcucuaguugaugaguaucagacugaaugaaaguggagguguguuuugauaaucuuaagguaagaauaaaacauuuauagucaccuggaauuuguucgaaguguuaaauuuuccuccuaaaaggugauuuuuguggggucuggauuuucuacuauaauucuaacaucacaugaaagcuuaugugaacuauacacauaaauuuucuauaguuuguguuuuggugaauaugaacuaaucuguugcaggguuuauauccuaacuuuucuugcaugucacugccauugaaacuugcaugaaaagcacuaacuugccuucuuucucuucucccugauuggcuccaaggcugccagacagaucaaggauagguaugguauaaaacacauuuuuacuuaaguauaaauauugaagucagaaaugaaauucagaaauaguuuuuuaauuaaaauuguguuaguuaagauaaaaguacccaaugaccaaguacaaaauaaaauguccucuguguauuuucuuggaauaaccauuguaucaauaaaauuuuuuaaaagcauaguuguggauaauuaugugcuucagaagaauuucauuucugguguagaaauauaguuaguuuuaguuuuagaacaguucuuaauuaguuguacuaaugaaaagggaacuauuuugaauaacuuaaaaauauauauuucuggaauguguuuuuuguuguuaaauuuaaauguaagugggucuuauuuucuuugaacucacucauuuuaaguaguccucaagaacuaaagcgcuccuauuucacugcccuccuguuuaacaccuuguauucucauuccauccuguuccuggugccaucucuuucuauuucuaaugccaccacuaucuaguuaauauucugugggaagagaaaauuaaagaaaauuauuaaagguuuugguuuaaaaguucuuucuuauugguagagccaggcuuaagaaaaggaauuuaguacuuguaaugaacauagauugcuaaaggaguugcuggcaacauuuggauugcauuaacacagaaggaacaguuuggaucugccugucuagucacugaguauugucuguauugagauuauagcaaguuuuuucaucugagggucaugagauucucugaaaggcacagcucuucaaagugccacuccaaauccuagauuaaauuauucuucaucagauaauucacaaaaauuuucauuauagauuaugugaaaaacagugccucuauuguuaaucuuggcugacaguuuuacuucuggguuucucuuuuuuuuuuuuuuuugaggcagagucuugcucuagcacccaggcuggagugcaguggugcgaucuugucacacugcaaccucugccucaugggcucaagugauccuccaccucauccuccugaauaggugggacuacaggcaugugccaccacacccagcuaauuuuuguauuuuuuguagaaacagggucuugcuauuuugcccaggcuggucuggaaugccuaagcucaagcuauccgcccaacuuggccucccaaagugcugggauuacaggugugagccauugugccugguccuguauuaauuuuuauauuuuuuguauauuuuacaucaggcaguagcuaaagacauggaucauucuuauaaauccuggaucuagaaagaugauugugaaaguuugaaggugaaaaauauuagcugugugaggaauggaugcuagauaggucaguuuuguggauaagguagauuuggguugugucuggaaauugcuaugagucauccaucuuccucccuggguauauuauacuuacuguuuagcuaccuaucccacugcauccugcucuaguuccuaauuuucugaauuagaaguuacuuccuaaucaugaccuugcaaaaucuguccuuuuuucaagauucuauauggcucuuugcaucacagaaucuugucuguauccuuaaacucuuugucuuugcccagauuuguuuaucagaauuuaauuucaugaccaauuucaauggcuguauucuucacugaagcuuggguuuuuugcgucuucuaagccagccucuuggcuugauuucauaaguauccaggugaucucaggaauuaggguucaggcaaacucugugugugugugugugugugugugugugugugugugugguucuuuuuuuuuuuuuuuuuuuuugcuuguucaaacccuauagcauuuuugugauccccugcagaauuuuuacuuccugcccgaggaacauuucugauucucaacuuaauuuuuuuuuuuuugagacagagucuugcucaguugcccaggcuggagugcaguggugcaaucuuggcucacugcagccucugccucccggguucaagcgauucuccugccucagccucccaaguagcugggauuacaggcaccugccaccacacccagcuaauuuguguguguguguguuuuguagagaugggguuucaccauguuggccaggcucgucucgaaccccugaccucaagugaucugcccacuucggccucccaaagugcugggauuacaggugugagccacugugcccggcccuucaacuuaauuuuuaaaauuugauguuuagcuuuauaauguucagguuucucugauguaguuuuugguacucgccaaaagugagcuuuuagaauuccauuauugucauuuaaaauauaaaaauaauuuaaacguagucauaauaaaauaauuacuguagcuauuuucaccaagcaaagaaaggauuuuuuuuuuuuuugggucagggucuugcuccaucacccaggcuggagugcaguggcacaaucacagcuuacugcagccuggaccucccuggcuuaaggggcccuuccaccucugccgccugagcagcugggacugcaggcacgugccaccaugccccguuaauuuuuuuguaucuuuuguagagaugggguuucgccauguugccuaggcuggucucaaacuccugggcucaagcuguccucucgcgucagccuuccgaagugcugggguuacagauaugagccaccauguccgcccuaggauuaucuuuuuauaagggcauagauggauuuuaagggagaauguguaacauaucugagcaagaaaucaaauauaaaaaaugaaaaugucugugaaaacucaucauuuaucauuugcuaugguagaaguuacacagaggaacagcaggauuaagagagaaaacucaagauagaaauaagauaauagcacaucucuauaacuuuauagaauuacuggcauguacuucuggggacuuaauaauauuggaauaugauuaguugagguauauugcaggaguuauugguucuugaaagagagggguuaugaaagagucaaguuaauuagguaguuugaggaaaugaaaacuauguuuuguaguuauuuucucuuugcaaaaaucaggagcgaaggauccuugaauuuaccuugugcugguagaaaugaacuaagaaaaucaaggggaauuaaagcauaccuagccuucuggauccuguaguguagagaauuaucuaaugaauuuuagauguuuaguuugggcuuugaggcacaugucuaaauacaugaaguuaaaaauuaaaguucagucuucugaaagauuguagcauuguugcccaucuaaauugauucauggaaacuuaaguuuucauugacuaaaaaauaagaguuguucuuguuuuuuuuaaagcuuugauaagccuuucuaaugcauuuauggggcauauucuuuuucuuugaugucauggugauugaaucaaaucuuacagguuuaagguuuaaaauucucuaaaauacuuucggauuuuuuuucucaacauuucucaguaaacauuuaaauaucuagucagguuuugaauaaaccaaguagguucuaaccuaugcacugauucagugagcauuuaguaaguacguaucugacuauagcucuuucagauguccucgaaucaaaagauacuuggggcuguaaagaauaacauauguaggacuuaguauuuguuccuuuuuauugaaauuguauuauuugagagacggguuaguguaguaugcaugaaauacucagcauuauacuuggcauauaguaagcagucagugugaauucccuuugcuguaaauuauauuucaguauagcacuuucuucuugauaaacacaucaacuguuguuuacucauuguuacuauuaaauuauuacuaguuuuaaaaugaaguaaaauaacuaaauacagaaauagcuugacauuuuucauccuaaaauaagugaauauagcaaguuugacaucuuucauuucauugacuucuuggguagauuuggcagauccaauugauuuggcagauacaauugacuaggccuaguauuccccuugucccaccagcucuguuuccuuccccuuccaaauuguguacuaggaggacaguguucaccuguaguacuucugaucauucuugaaccaaagauaguaaggggcuuacuuugugauacuuguggaaauuuauuggaauaugaaaaauugaaauuugagauaaaauuaaaaauuaauagaauaagaggauuucuuuuaaucuucaguuuuaauggacuacagauucucuguacuuuggauaaaguggcuucauucuuuuuuuguuuuucccuccacauucaucuaguaaauguuuauugaauuccuguuacuuccauggcauauacuuuuucacagggcuguuucuuacaguaggcuucccuauagcugauguugauagaucagagugacaccuagugugguauucauugauagugauuucacuucucucuuuucuuauccauggccuaucuuuagcaacuaccaaacuauacaauauuaggucaaucuaccucuacucuuauuugaggguacaugggauagcucuuauuacuagggagaauauuugaaucaaggugugauucaaaugaauauaaaugaauuuaaguucauuaucuggcauaugaaaaggaguaaggcuggcaucaggaagucaguaagauugaguguacagagguucagaugaauguugagucugguaaggauuauuuuuauuggauauuuguuguuauucauauauaugcaauuuaauaaaaauuggcugggaggaaaguugcuaaccaguugucuuaaaugucuuuaaaaagacauuuuguaguuuuuuauuuaguuaauuuugaagacuaagauuaaauuucuauuucacuuuuaacuuuuauuauagucucugaaauuauuagugauauaauuugucuuuucauuuuauaaauuaaauaugauuugauacuuccuauuucuuuauuuuaaaaaguauguuuguguuuaccguagagucacaauggcuucagccuuucgccuuucuuugaaaccaaaggucagugacaacaugacucauuuaaugguggauuucucacaggaaagacagaugcugcaaacuuugaaguuuuugccagguaaauacauguauuacauguaaaguuuuguauaaaacuuuuuuuuuucuaca

SEQ ID NO: 13969 - RNA, 2289 nt, Homo sapiens
aaugggaguuacucucagcaaagaauguacagcaaaggcaagaguaacagcagcauuaacccaugugacagccacaccuuggugaaguuagcacuuuacauauaugaauaucugcuccauguaggaguucagagaucaucccgaacauuuuuaucagagauaagaugggggaaaaaauugggagaaccaccaggauucuuacauuccugguguuguguauuuugggaucucuauuuggcagcuccagagccaaaggaaacaugugaacacucaaguguaacaaaaaacuuccaugauuaucuuuuuauaucaccuugguacccuggagguccaagguucccauugaagauaccuaaagaggcacuuggaaguauccuaggaagucagccauuacuccccaguggaauccaacuugacaacaaggacauuuaaguaugggugggccaauuucuccaagaggaauggugcccugagggccacagucugauccuugguugucaguacagaaugaugaaggugcaaugagaugcccagugaaugcuuuagguggcucuggaaugccuagaaugaacaugggucuggaggguggcagaucuuggccaaacccaacaaaugccaauucaguaccauacuccucaacaucuccugggaauuacauaggcccuccaggaggugagguccacaggaacacccgucaugucuagucuagcagauuuaaucaacccuggagauaugaaugaaugcaguauguuguagaccuaacagaccuaauuuuccaguggaaucugggucagaugguaccauggauggaguaggaggaggaauggagucacaucacaugaauggcuuuuaggcucaggagauauggacgguauuucuaagaauucuccugauaaaaugagccugaguaaucaacugggcucagggauaauugcaaaacugggggaaauuuuuaaaauccuuuucagggaguuacuccucucgcauaacagugagugugugauccauuaccaaguacccucauguaaaccacagugaacuagcccaucacagaacuaucauaaaggaaaauuauuuaucacagcguacauuuaaacaaaggaaucuguccgggcgugguggcuuacaccuguaaucccagcacuuugggaggccaaagugggugaaucacuugaggucaggaguuugagaccagccuggccaacauggcaaaauccugucucuacuaaaaauauaaaaauuauccaggcauuguggcacaugccuguaaucccagcuacucaggaggcugaggcaggagaaucgcuugaaccuggguggcugaggugggaggauuacuugagucuaggaguucaggaccagccugggcaacaaagugagaucgugucuacuaccagcuagucaggaggcugaggaacaaaaauugcuugaacuggaaggcggagauugcaacgagccaagaucacaccacugcacuccagccuuggugacagagugacacucugucccccaccccaaaagaaaagaaaagguacaaaguggcauauuaaaguugacuuaaacugaacugcaaauaauuauguuuguauguauaugugugggaagaagaauguacuguaucuguguguguuauauggacauauacacaaacauacauugacccucaggacauuguaaaauauuaucacauaacaucuuagguagaaauaaguagggauauuuauuccauccuuuauucacauuaacauuuuaauuacuaaaaguugcuucugcauccucccugaacuauugugugcuaucuaugucccugcuuuaugcaaguucauucguccguucuuucuuuucuuuucuuucuuucuuucuuucuuucuuucuuucuuucuuucuuucuuucuuucuuucuuuccuucucuuucuuucuuucuuucuuucuuucuuucucuuucuuucuuucuuucucuuucuuucuuucuuuuucuuccuuccuuccuuccuuccuuccuuucuuccuuccuucuuuuuuuuuuucgacagagucucacucugucaccuaggcugaagugcagugggacaaucugggcacacuacaaucuucaccuccuggguucaagugauucucuuuccucaaccucccaaguagcugggacuacaggcaugggccaccaugcccagcuguaaguuauuucuuaaggugaacucagauguuauguuuuuguaagugucugcaaucauggacaggaauaaaaucacuuaguugagaguuuauauuaaaaaaaguaaauaaauaca

SEQ ID NO: 13970 - RNA, 1433 nt, Homo sapiens
aggcgaaaggggaacgggagucaccgagaagagaaagaagaaaggagagaggaggaggacgcugaggcuguuccggauugaaaugaucccggcuuugugcggcuuugggaggacucccccuuccgagugcccggagggaccuagggaaguccuccugccccgagcuccuccccaccgggacccggggggugucugagcgcuggccgccgccaccccauaaauuccucguggcaaccggaggaagcgcgccaggucuccgccgucccuccacugucccggcugauaauuuaccucuuugucuuuaauaaaaagcugacuuuuucugucaagcucugcaccgggaaaauaacaaucguauuucagguugaaagcuccuauuacugcuggguuuuggaggcugcgauaaaaucuucaucgacgugaagguaccuucuggguuggcuugggucguaaguccuaagaugggggccguccuucccugggggcagggacguagggaaccaggcgguggggagggagaaaggagcgacgaggucagaggaaaccuuggguuuccaaggcuccuggggcaccaaagggcuucccgcagucggggaauugagcccuggggaggagccuuuugcgagaacgugagcgcgccccaacacgccucagaccucguaaacccacuuggcaaagaccggggaagcggcuggcggaccgacugcggugaacucaagaaauuaaccugcgcugcaauuaaacgggcugccgcccuuucacacucaccucgagcgaccgagauagagaaagcucccgaaccggccgcggggggacuuggcuccacccucccgucccgggagaagaggacaaaaaggggagauggacuuggaauggccccgcccuucacagcgcuccaauccuuggaaaccaaaccuccucuccaagccuccacgucuagaagggacaaaggcagcgaggagauccagagaccgacggggagaugguggcuuucaggcuucuggugugggugcaugggggaaagguacaaugguuaacuuuccaucaaaaauacggcaccacacgauggucuugagaagacacacucggucuucugguuuagaagcaaauugacuuccugaagcugugaagcgaacuaucgcaaaacucucuugcuucuugaaugugggggcgauacaaauucaauuaaugaugccauacacguaaucuuuucgacuuuuuagaagucacaaacgcuuuaacucuccagugaaaauaauugaaagagguuaaacauaaggggaaugggcuuuuuuuuuuucuuguuuuuauuugggacaauuuuucaaaugauaaaacuguauaaauacaagcugggucagucaaggaaagcgcuguggcugaagauuuucguaaaaaccuuaguaaacguggcauuuaaguaacuaauuaug

SEQ ID NO: 13971 - RNA, 1744 nt, Homo sapiens
gauacuguagaacccccauccccaacccccaccgcucccaguccaauuaaaaccguaggagacuuucgaccuggugguggagggggggaaccacuccuuugcaaaagagauaguucagaaugauacgggagagauuacacuaaauaaaaauucaaggugugaaagcuucaucuuggcucgcgugucuucaacaccaugacaccuuaucauuaagagcgcugauuguuacuuuccgagccuuuagaugaucagccagaaagugcaaacaacgcggggcuggaggguguaaaguuauuuaagcaggcguucuuuuuuucuuuuggugcgcagucaaaacauuucacaaguuaggaaaagaaaguggugguuccgaagcucggaaugaugggcucuuuuccuccuccacccccccaccuuccauaucaggaaagaaauaaaacgcacaaugagccuuuauuucaggagagaagacuucaaaauacgugccaguaauggacaauuugagcuuuucacuggaaauacucacaccgcaagcuggaaagggauuaaaaagccccacgugguugaucuggguuuauacuugcaaccuccaguuccccacguauguucuuugcaaagguuggccucuagauggaugcaaguaagggacccucuggggcucgggcucggcgccucgggcagggcugacguugggagcgcuaugagcugccgggcaggguccucaccgggggcuuccucugcgggccagggcugccgggcgccaccgggacgcgagcgcgcacgccucggcccggcggccgcgcuccucgcaccgccuucuccgcaggucuuuauucaucaucucaucucccucuuccccuucuccuucuccuuugccuccuucuccuuugccuccuucuccuccucuuccucccccuccuccaccaccaccuccuccuccucugccgccgccaccuccuccucuugcaucucacuggccuggcucugagugacaaagacaaugucccagccuuaacuuugcaaccaccuugccuccuucugggguucagcaggggggagggggaacagcagcagcagccucagcaucuccuccagcuucuccuucugcucuucucgagcucuuggauaauucuuccucuuuuuuccccuagccuuuuuccucauuucuuucuuucuuucuuuuuuuccuuccucucugcugcacguuguuguuguuauuagaaaggcuucgcgcacccccuggugcuccggcguuuuguguggcaggagaagauugucuuccuucucucuuucugucuugcuuucucucucccccugguugcucauuauucagagagagacacagagggagggagagagagagagcgcgcgagggagagggaggagaggagagagaagaggagagagaggggagagagagagugagagggagagggagggagggagagagagagagagggagagagacggauaucucaggucaucugcagcugcagcgagucugaggagccgaggaaggcagggaagauggcgauccuccauugcugagacccggcagaagcacaugagacucccaaacaacuuccacaacaauaacccgagcaggaagaggagaaagagaaagaggauaaggaggcgguggggcuggagaacccgaagcaccucccggcgccgggacgcuucuucuguaaguuacugcaauuaacaaccaccucggggugguccgagugcuccggggaagaga

SEQ ID NO: 13972 - RNA, 1744 nt, Homo sapiens
ucucuuccccggagcacucggaccaccccgaggugguuguuaauugcaguaacuuacagaagaagcgucccggcgccgggaggugcuucggguucuccagccccaccgccuccuuauccucuuucucuuucuccucuuccugcucggguuauuguuguggaaguuguuugggagucucaugugcuucugccgggucucagcaauggaggaucgccaucuucccugccuuccucggcuccucagacucgcugcagcugcagaugaccugagauauccgucucucucccucucucucucucucccucccucccucucccucucacucucucucuccccucucucuccucuucucucuccucuccucccucucccucgcgcgcucucucucucucccucccucugugucucucucugaauaaugagcaaccagggggagagagaaagcaagacagaaagagagaaggaagacaaucuucuccugccacacaaaacgccggagcaccagggggugcgcgaagccuuucuaauaacaacaacaacgugcagcagagaggaaggaaaaaaagaaagaaagaaagaaaugaggaaaaaggcuaggggaaaaaagaggaagaauuauccaagagcucgagaagagcagaaggagaagcuggaggagaugcugaggcugcugcugcuguucccccuccccccugcugaaccccagaaggaggcaaggugguugcaaaguuaaggcugggacauugucuuugucacucagagccaggccagugagaugcaagaggaggagguggcggcggcagaggaggaggagguggugguggaggagggggaggaagaggaggagaaggaggcaaaggagaaggaggcaaaggagaaggagaaggggaagagggagaugagaugaugaauaaagaccugcggagaaggcggugcgaggagcgcggccgccgggccgaggcgugcgcgcucgcgucccgguggcgcccggcagcccuggcccgcagaggaagcccccggugaggacccugcccggcagcucauagcgcucccaacgucagcccugcccgaggcgccgagcccgagccccagagggucccuuacuugcauccaucuagaggccaaccuuugcaaagaacauacguggggaacuggagguugcaaguauaaacccagaucaaccacguggggcuuuuuaaucccuuuccagcuugcggugugaguauuuccagugaaaagcucaaauuguccauuacuggcacguauuuugaagucuucucuccugaaauaaaggcucauugugcguuuuauuucuuuccugauauggaagguggggggguggaggaggaaaagagcccaucauuccgagcuucggaaccaccacuuucuuuuccuaacuugugaaauguuuugacugcgcaccaaaagaaaaaaagaacgccugcuuaaauaacuuuacacccuccagccccgcguuguuugcacuuucuggcugaucaucuaaaggcucggaaaguaacaaucagcgcucuuaaugauaaggugucaugguguugaagacacgcgagccaagaugaagcuuucacaccuugaauuuuuauuuaguguaaucucucccguaucauucugaacuaucucuuuugcaaaggagugguucccccccuccaccaccaggucgaaagucuccuacgguuuuaauuggacugggagcgguggggguuggggauggggguucuacaguauc

SEQ ID NO: 13973 - RNA, 150550 nt, Homo sapiens
acacaugugaaaaaaauucuuuauuaauuucucacauuucauuacaaaauguauguugcaaacaacuugaauaaccuacuugugguuuuuuuuguuuuuguuuuguuuuuaaacccuuggcuucaaggacucagggucucccuaucucuuaugaaguauugggaaacacugauuacuggagucaauagguuaucauuuugcuauuuauuuucuucucucaagcucugaaaaaaauguccucuguauaaauuaaacaacaacaaaaaauguuguaaauucuaugucauuacagucaacagaauuauaauaaugcauccaaaaugugcggccacaaaauaucagguauauguuugaaaaagaaaaaaaugacauucuagccuuguuaaaaggauaauggucccauauuuuuauuaacagguuagcaaaacaaaauccaauggauuacaauauuuacauguuauuugaaaaauaaaguagugauaaaagcaugucacaauuauuuucuuuuuuuuuuuccuuuuucuuucuuuuuuuguuuguuuuuugguaaccauuacaaacacccaauccagguauggaacuguuuaauacauuugaaaugaggccaauuaaaaacaaauauagacacaaaaugaaucuuugucuggauaguucacacuuuccccauuuucugguuuccacaugauggcccccaucccuuaaaaaaauuaaauuaaaacaaacauccuacaaauaaaaauucuuaacaguaagaaaauaaaagaagaacaugcuuuucaaguaagcacuuauuccacaaaugcaacaucuuuccauggauuuuauuugaagcugugugggacacugucaucucagcaauuccccuucccuuucuucccucccacccucccacaacccuuccaaguaaaaaaaaaaaaaaaaaaacaugaaaaccaaaggauucacacgugcacacaugcacacacacacucauacacgcacacacacauccaagcacacacacacacgggcuucuaaaaccuaggcuucaagaaaaguucuuuucuauuuuuuggaacgaaacccuuuguucacaaucagaacauauuauaaauguaggcuuagauuuagucuaagcugcucccuccugaaaaagcugauaugggggacagagcagcuggcagcuagauuuaaaaaaaaaaaaaaaaaaaaaaaaagaaagaaagaaaguaguucuccaggcuccuuguaggauauguuauuucuuguccacucucacgaaagggaugggauucuaguacauccccucguccccuaaauaaaugaaaacccccaacaaaacacaaugccagcagaaacaaaacacagauuuuaaaaucacacacaaaagccagccaauccuaacagaaauuauuuaugagacggauaaugcgugaauuugacaggcaacaaaagggugaggaggaccuccucgucuggcccacaagcugcauagcugugccgaaaguuugguucuuuaguuaaauuaaaaaaaaaaaaaaaaaaaaaaaagaaaguuaacuucuuuguuauuuccauguuuaaaauaaaaacauuccuauucacaaaaaacuaaaucucccuugccccgaaauuaaaacaacaauaacaacacacacacgaaaaacaauucauaugaaaaacugaauugugcuguguuuguaacacucaaauugauagaaaauaaacauguggcaaacaaaacuccacaaucaccuuaaaauuagcucacaugaaucuaccaaauucuaaauuauaguugaacacuaauaaacagcuuaccuggaauaaaggaugacaauucacaaacaguuaucuaauaauuaaagucuguuucuuuuuuuuguuuuguuuuuuacuaaaauaauuaaaaaaaucacaguauuuuaagaaauaaaacccacauggggauuuuaagcacaauuuguguuccuuucuuuaaaacucuuuuuuuuucuccauucaccaucuugcccagcaguucucucuacauuuaaccacaacgacgacagguaguacugacaaaugcagagaguucccuugguuaaguuugagguacuaggaaacaggugacuguuuuaugcaaagcaguuuuuuuuuuuuuguuuucuguuuuuuguuuuuuguuuuuuuuucccaaagcggcugcaguuaggucuugaaaaagcuuaagguauuaaaacuagaaaaacgcaccaaaaguugugcgucaaaaaguugcuccccaaugagaagucuucuaccgucauggagcuucuguuuccacauacuguccaagaccaccacagggugcaccguaccauugggaggugcuuccauauuccgcaacaaaugaaacuuccaugaugaagauccggaagaaaagauguagugauggaaaaggagccacauauuccaaccauuuaaauaacuuuaauuuacauacucacucacacagguaccagugcuuugaaaauagauuguucaguccuaaaaagcagcuuuguucugucuucucuuuucugucccucccuucucagcccaagccagcccucccacuuuuucaucacuguucaaguaagguuugauuaagaauuucaccaaacgcucauucuuuuuuggccucugcauucuccaggagagauuugucggcaguuacuacacagauggcuacuguuucauucuuuagggaaaagucuaucccaauggccucgucaucuuccuuuuccucuauggagggcauuuuaacacuguucuccaugaucucuuuuggguggauuucuucucugcucaccugcuuggugucauucaaugcccuggaaaaacauuuaucgaagagacagaugaguauaguauauauauuucucuuuuuaaacaaaaaaauaauaaaaacccucgagugucuuuauuuuccugauccucaaaaagccuugggguuuccuuugaacaaaugccauggguguaugacaaaauaccaagugaugcaucccugcuauguuuugcuuaagucauauauuucuguaucuuaaagauuugaacuuacagaaguauccauuauuauacuauauauugauuaucccauguuuucuuucuagauaagcauaaucauuuuaugucacuuucucuacugggucauaagugguaacagcaagaauugucuuaugcucagagucaucggcugaacccagaagcuuggagauugguuauauuuaugaagucuaaaagaguaacucagguacuaaagauuuauuugucaggucccgaaacaaaucacgaaaacaaacuaaaaacaaaaaccugaagauggaacccaugucucgggaagcuugguuauauucucugaggucuagacccuugaggcuucagggaccaagcuucaggcuuccuaucaccacacaagccauguuuccuccugaaaagaccacauccuagguucucucugcaucugguggacuaacgugccuuguugaggggcugauuuuauguucagggaucucauaaguauuuuacaaguaugcucucaccuaccugggaggcaggcagaagcuggcucuguccccgaggcaguacaugggaauguucagggccacucagggaaugaucagucagagaggcaggaacagaagccagaucuuuugaccucgauucacguucuauuauagaaugucacgcuaaugaagacuaaagggauauuggcuggagaaaacacuauacuucugcacacaggcuugagcaggacugaucauucauaaagacgauuuuuuucccuauuugacuugcggcugggugaccauuuuaaaaaacaacagaaaaggagaaacuugguuccucaccauugccucuccucccacggcccagaaaugugacacagagggguguacauacugucaggggaaccaaaacaagagccccucccucccucccuaccucuugcuuuggacaaaggcauccuugaaguggcccaacuuacaugccgugucucagcacaugucuuucccacucagagcccugugaaaacgcccguccacaaaauucacauggaaaacgcuucucaguguuaagagcagccccguggucagaaaaucucaucagcucugcaaagagaaagcagaaguguuaccugugugcugugggaaucagcagaauagguaagucagcauucauuaggauacccucucuccuaccuucacugauaaagccauguggugaaagcaauuuccagauuccucacuuuuucuuagguuucccccuuagggcauuccuugaauagcauucgagaacuguuucugguucuugggccccaagaccucauuucgccucaccuccccaaugcuucuaucacaaaaucugggucuuucuugacugaagagccgcuugcccgagauuccaaaggaaucugagcauuauuuuuuccgauuuauucucucccuugugugaugauuuauaucagugccucacaggcuagcaucuauucauuuccuuuuugacacagguuuaucuuuguucacugaaaagaacauaggcuaccgaaagcccuggaccagguuauguguuguggaccucaggguuucuacuuguuccaaguaaggcugaaggcucaugacuuguggucauccaucauagacauuauaaucaauaccuuacagggcgguuaugugcacugaaugagaucugcaagcgaagaaucuaccaugaacauuuaucuggaugagugggaaccaguaugugaacacauguccccugcuauugagagauccuggccagcugccuggcaccuaccccucaauuggugguauucaugaauacggggauaugcagacauuucuggacggucuguuguaaacaucaaauauugacuuaguuguuuuguuuccuccaugguacuaggcacaugguagaagucugauaaauguggauuggcuguuuaacuguuuucaggccacgucuccuggcaaacucaaagauaagagauuauauggccauuguguuagcccgaguuccuagcccauauguguuucauuauaccacagagggccaagucuucauguagguaauaaacagcaggaccuugccaguucugcagccguguugcaaagugagggcaucgcacagggaaguguugaucaucuuuacacucugaucacucugguccacacauacaagacauuacaggaagaugccuccugguugaaaugccccaucuaauaagauucucaggacgauguuaacaggauggggggcucugugaugccuuaaucuucagcacaaacagcuaugugacuggggccagauuuaacaaaagaugaaacauuuucucacaaauuaagaagaucaccacacaagccauuaaaaauaauugcacagacuaucuuccuugauucuuuucauuggaaaugagacagcaccaucugcucugcgcauuaauuccuuagcagggauuaucuugggcaagaaaucaacagaaugccuuccugacuccuccccaacugcauaaugagagggggguggggaggauucugcuuggguuaauuuugauuucuucaugccuggauucuucucuuucaaaucuucccugagcuuccuaggcaggaccugcagcguguccauauucaguccggcacuugcauuuagaaaggagguagggagugggguggcugcgaggcugugaacccccuaaacugagggugucugauaaaagucuaaauugccaacaagaggaauaauguuccugguacacuuguuucuuuacccuuaaucuguaaauaggaaaccagucaucuguccuuuccaauggcacauacuaaguuccauccucaaaggaggaggccacugggcacuggccacacuuccaagagcucuccaccagccugagagcugcacgcaagccaccuccugcccucugcuccuagaagcugggaugucuagcagaaacacccgaggcuauuguguguauuucuuuuuccugccaagaauacaccuagaugguggaaaguugauucuuggucuauucaaaggagagaugggacaaaggaggcugcucuuucaaggaucggcgagggggaagggaagguuuaggcuuguaauucccauuaaugugacuggaaguuacucauguaaaucccccacccucugagaggaauacgugcuucuccacccugagggcuuuuuguucccccaugugguaaagcucacgaauguggacacuauacuuuuuccagugagaagaggagacccugaaguucuuuccagccaaaccacuccaguguaaugccacagugccaaguaaaagggggcugccaaguaggguaaaauaaggaggucugccugguauaccacacacaucucaaccaccauguuuuaaauucgaguuuucuuucuuuccuuuucuuuuuuauaaggagucauaggggagcagaagccuagaaggguauuuugccuuuauaaugcuuauaaccuuugaaaucacacaugcucagcuuuagagauuaaaaagccauaauaauauccaaugagaaacaguuuauuuccagaggagaaaaggcaaggccacagagcgucaugaagaaaaaggagucuuucugucaaaaguauccucucccagaaaacuccgguaacagugcagagauguuaagaaaucauuguaaagaacauacucaugaaaugguuugaaaaagaaaaaagaaagaagccaugcuucuccgaucacaaccguuuuccuuguaagaaauggauuaauacagccucuacuaauaaaaauaauaacuuuauaagaacaaucaaccuauaugguaaggauguuuuauuuguccauguauuuuucagguuaauacaggcacaggguuuuugaaaggguaguguaccuuggcugucauuuccugcugacugucuuggucagggguucaagagccaaacuggggcccccuucgcaaacccauagucuuuagcccuggcaucaugguaggagggugagugcaagucaggaaaaggaacagggaacaccuuggagggaaguagcccaccaauaggcuuccuuaauguuugcagacagaacaagcagaaaacacaaagaaauucugcaaaacugcuccuuacagcaaggucccaagggccacugaauccacagauuucagggucagguccccuucagugaagauuacacuacucgaagcacugggaaaguggugugcaggguaagaagagggcuugccuuuggagccagaagauguaaauuugaauugaauuuggucuccaggguuuauauuuuuuguuguuguuuguuuguuuguuuuguuuuuuacuuugaacaugcucuuaaauuuccuggguccuuauuuucccauuugugaaaucacaaaaauaacaccuacauugcaggcuuaucauuuauuaggugauuguuauauucuaggaacugggugaaggucuucuguguuaucucauuuaaucuuuacaacaacccauggaaccacacccuggauagccaaagaaaucuuaaacaaacagaacgaaguuggaggcaccacccuacccgacuucaaaguugacuacaaaacuauaguaaucaaaacagcaugguacuggcauaaaaaacagauacacagaccaacagaacagaauagagagcccagaaauaaauccacacauucacaguccaucgguuuucaacaaaggugccaagaacacauaauggggaaagggcagucucuucaauaaaugguauuggaacagguggauauccacaugcagaagaaugaaauuagauccuuaucucacaccagauacaaaaaucgucucaaaaugaauuaaaaacuugaauauaagaccugaaacuauaaaacuacuagacaaaaacaaaggggaaaagcuccaugacauuggucugggcaaugauuuuuuggauaugaccucaaaagcaugggcaacaaaagcaaaaacagauaaacagaauuacaucaaacuaaacagcuucugcacagccaaggaaacaaucaacacaguaauagacaaccuauggaaugagugaaaauauuugcaaaccauacaucugauaaggaauuaauacccaugcuguauuagaaaaucaagcaacucaacagaaaaucaucuaucugaguagacauuucucaaaagaagacauacaaauggccagcaggcauaugaaaaaauguucaacaucacuaaucaucagggaaaugcaaauuaaaccacaaugagcuaucacuucacaccuguuacgaggcuauuaucaaaaagagugaagauaacaugcuagagagaauguggagauaagcgaacuccuguugcauuguuggugggacugcaaauuaguacacccguuauggaaacagcauggagguuccucaaucaguuaaaaguagaacuaccacauugaucuagcaaucccacuccuagguauauccaaaggaaaugaaagcaggauauugaagaaauaucugcacucucacguucacugcaggguuauucauaauaaccaagauaaguaaucaagcuagguguccaucaauaaaugaauggauaaagaaaaugugguauauacacacaugaaauacuauucaccauuaaaaaauaugaaauccugucauuugugacaacauagauaaacuuguagaacauuacauuaagugaaaugagacaggcacacagaggcaggcacaaauacugcaugaucucacuuauguggggaaacuagaaaagucaaagucauacaagcagauaguagaauggugguuaccaggggcucgggguuuggggagauauuguucaaaggauacaaaauuucagucagauaggaaaaauaagcucaagagaucuauuguacaacacaguggcuacaguuaauaacaacauauuguauaccugacaauugcuaagagaguagauuuuaaguguucucaccauaaaaaaugacaaguaugugagguaaugcauauguuaauuagcuugauuuaauuuuccacaauguauauguauuuugaaacauguuguacaucauaaauauauacaauuuuuauuaaaauaauuuaaaaaaguaaauuuaaaaaguccaaaaucugaaguuuuaaaguuaaaaaaaaucuuuacaacaaucuuaggagggaggugauauuauucucauuauuacgauugugauuauuucacagaugaugaauguacaaggaaauacaauaauuuaccccaagccaucuagacaguaaguagcagaacuggaaaccaaauucaagcaggcuaaauguacaguccucucuagucaugagauuaaagaaaaauguuauauaaaaacgaccagcacugaggcuagcacauaaugaugcucaguaauggcaacuaguacuauucucaucucugggucaauaucugcaauguugauuucugauguuuauguuauccacgugcuucugauaaaucugcaauaacuaaaguaacauaucucaaccuauauucuuguauguauagucugggguuuuucacaauauucuacguugaacaauauagaaaaccaacucugaaucacauaaauguauauccacaacuaaauauacuuuugaaaacuuuuucauuuugaaauaauuauagacucacaggaaguuagaaaaauaguaccaaagucccacaaaaccuuccccaguguauucuguaaauacauaguugaaugaaagagguggucucucuuucucucuccuuacaaagcaagucagagcacaaaggggguuaagaaaagggccacgcagagggacaucaggggguaggggcucaaguucuuugcaccaccguccccuacaguuccagcagugugugccccagcagcaauuuuaaauaugcauucaacuggaaguucauucucauuccucuagagcucuacagugucauccaucuugcugucugcuuguccuuauucugaagauucccuagauaccaguuuuccuuauuaaaaacaaaucacugccaucuauuuuucaacaaacauauaucuauaauuagggagaaaaugucuguuuuccuuggcguuucuauagcugguaauaguuuacaaagacacagcucuugauguguuuucuaagucagucuguucugcuacuuaacuaagaaggaucauuccuucuguuacuccuacaacaaccuccugccucccuucugucucacuacggacaugccagaugccaucugggauugggagggcaggaugagacuaaccucugucuucagccuugcuguucauuucuucuuccuuguccucaucaucgcugcuggagcucuccauuuucuccuucaucuguuccagcugauccaaguuaacccguccaaccagcucaaaguuacggcuuaccugaaaaaggcccaaacaaaugauggaauaauaaaccgcagaccaaaugggguucucccugauggagagaucuuucuaacaucauuuuccugugacugugguuuugcaaccaggaccaaacaacuccggggccuaagaggucuuuuucuucguuuugacucuuuuggagauggagcagcccuuugcucccacauuccaucauuuucaccggaacuuuuguacaccggaccuucauuaccaaacuugugaagaaacaugagcuauaguacgcaggagaccaaaaguaaaaugaaggcuagaguauagaguaaauauccaaaacacauuuuuuuuguaguugaauucaaagguguaacucuuauaacaacccaaguuucaaauacuucugcaggugaagaaguucugcaagcaugccgaccacuagcagugagacacaauacaaccuucuuugccacgaucccaucaaccaggguguugcaggcugucccggcuuaggccagaugacagccaucugauccuuaacucuaguuuaaauggaagauaauauuauuacuguuaguguuacuacuguuuuugaagcugaccacagccuauguaucaaggcugggauuaucugagaaaaaccuagaugacuaaccccuaaaagcucuuuaaaaguguuaacuauggcugguuuuuauucauguaaaauguggucagaauaaugugggaauccaagcuuucuucaaaguaucauuggaggggaacaaaaaucuacacuaagaaaagucuuuaaugauuuuuccauuuuggguucucagaucaauggcagcacaaaauuuaccuucaucaugaaucgauuuucagaaccucuccaguugcaugcauagaauguucaggcaugacaagcuggugcagggcuaaagucaaaaaauugccaugggcuacgccuucuauguaagguguuaugcuccccuuguuggaggccuggggaggggacauacaagaugaaugagaccugguucuggccuccagaggcucacaguugaguugaagagggaagacagacaucauuaauuagauuccgaggccgacuucccuagcugccacaguagggcacagcuagaugaugaggacacagcuagaugaugaggacacaggagaggaaagagauaauuuacaagacaauuccaaaauagucuuugggaccagacuggaacaaagauuugcugaaugccaccaauuccaugugccuggcagaugggaacaucauuaucgacugugacaaauguaaagagccucagcguaccaggccuuagacacugagacugaauaaugucccaacaacauccuguaagagauagguagcauucaggaggagaagaacucagggaaaaaccucuuuuaaaacaggagaaacaauacacugaucuaucuauaacaaugaaauccaugaaauuaguuaacuuugaaaacaacucaacauggggguggacaagacgcagacaacaaugccaacgcuuaacaagcagggaaggcaacuucuuguuuuucucaauuaaaaaagcuauaaaaauuaagggacuaaggcaagaggagaaagaggucaauuaugaauccugauuucucuuucuuccccucuaaguccacaguaacgguuuccaaaggacuuuugcuuguagcaccuuacuaacuagggcuuuuacauuuucauugauuuccuuuuaugacauaagagcaaaaagggauagcauaagaaaaugcucuuugaagucagacagacccgaguucaaguuuaggauuugccauuaaccacuagauucuggauaaaucacucaguauauguccuugauaucuucauuuguaaaaggaggucagcauagugcuugagacacaacagucccccaaaauguaauuuccuuccccuuucugggaaugugagccuuuucuaguuuuggcucuugggaaugcuuacaacaagcauuguaaaugcauauuuacgaaguuauguuuagccacaaagucuacauuuuagccaaauagcauucaugauaaauauuugaauaaaaaguuuucuggcuugcuaguuuuucaggaaaagugggcaagguuccaauuugccuaauuuuuaaacauauuugaagagaaguauuuuuaagugacuagcacauaaaaggcagccuuuccugggccacuuucuccugcacuucucaccauuaggaaucagggaaacuauaaauacguguaaaggacaugaggggugggcugucaccaggaaacaaaaacaaugaaaccaaggagaccaaagaagaauccucaaacaucugcuuuaauccaguuguuuuaauucauucauucauucauucaucaaggauuccuggagggcuggcuugcugugugccagccucugggguccacacuggaaccccugcuucuuuuggagcucuuggugacagaaggagaucugucaccaaaccaaauguuauuuuuuucccccucauucuggguuuuuuugaagacuguauuuguccauuuucccagcaccaucaucccuucacuggaaaacuguuaacauuuuaaauucugcaugauuuuaaaauaguacaugacauuuucacaguaugauguucaucccaggcuaacccaggauuuauuugguccugaagauuucuaaaaucuuugcuaggcaauuaaaagauuuaaaaaugagaacuaaaauuuuugcuauguaauuagaagauuuuaaaauaaaaacucuuuauuguuuuggguuaugacgguauuugaaauccccaagccaucuauccaaauauuaauccuaacacaaaaggaagacucuuuuccacauuccugagcccauuaucaucuuuuaccuggauuacugccagccccuuccccucccauguuggucuccuagcaccuacucuugucccuucuuguaccugauucuuuaguguggucaaagcaaucuuuaacaaaauguaagucucuucaugucagucucugcuugcccugaggaugaaauacaaauuucuuaacugucguuuacauggcgggcucucauguuauucuggcccaucuucucuaggcucccccuugcucccaccacccugaacuuacugagguccuggaauaugucaggcccucgaggagucuaugccuccaccaucucaccugucugacacucucucaugccugccggcuucauguguugaguccuuaaucuccuagcccugcuucugucacuucuucugggagaccuucccuaaacuccuccuguguucgauauccuuguuccauguguucacagcauucugcaccccgccuucaagagcucaccccauucaguaaugaauuguuuauggccugccccuccccaguccaacuacaaacuaugaggacagacuugcugugagucuuacuuacagcugaacccccacuggccagcacagugucuagauuaagagaggguguuauucucgccuccuggcuacuggauaucuucauuuucauuuaaaauaguuucuuuuauauaaacauucacaaaaaauuuaugaaaauaagaaaaacucauuuaaaguccaacuaccuauacauaauaacuguuaaugaauuaauguauuucuguauuccuguucucuaucuguagauuauuuacauugcuguuaucauuuuaaaacaaacaaguguauauccaacuucuucaugccuggcauaguguacacaucauucucugaauaaacauaauuuuuaaucacuacauagcauuucaucaaguaggcauaugauaguuuacuugacuauucauucccguaugaauuuacgguagaugauuucuggcuuuccacuauuaaacauguuugucacaaaaaguaauaaaccuuauuguauuuaagccuuucuuucaugcuuaguuuuaauuuuauaggcuaaauuuccagaugugaaauuacagggucaaagucaaaggguauagacuuuauaaaaguucccauauauuuugaacugauuacacuacuuuuugggcccggagauugguggguauuugaauaacuccuugaugaugcagaugacauauugagagaaacacacuuguuuccucuaaagaugagaagcaguuuauuaucauuuccccaaaggcccacaacaaagggagaaggagcaagcuuaagaguuugagauuuagaacccagcuccuuccaggcucuuucugcaggcaaaagaagccguauauguucuugaaggguggauuguucagauacauaauaauucagacuagaaaccuauaugcagaucuuuauuccugugaaagcuaucugugaaugcccauucacucaagguccccugugaaggccacuaacccagaguuuggugaagucaucugucuaaugagaaugugagaugagggcugggugcggugacucacgccuguaaucccagcacuuugggaggcugagaugagucgaucacuugaggucaggaguuugagaccagccuggccaacauggugaaaccccgucucuacuaaaaauacaaaaauuagccagguguggugggcggguaccuguaaucccagcuacuugggaggcugaggcaggagaauugcuuaaaccugggaaguggagguugcagugagccaagaucaugccacugcacuccagccugggugacagagcaagacuccaucucaaaaaauaaauaaauaaauaaaaauaaaagugagaugaggugucaaauguuuuauccuuuaacaaugaagugaggacacugcaaaaccacuuccacacuugucuauuuguuggcuuuuaacuauucagcaaaaugguuuagaucuggucuuagcauguauuuccauacuucuggcauauucuaaggugauaauaauuauaugugauuuacaaauauuaucaaguugaauaugcauuuucauauuguacuaggauagcaaacccagucugauagaagacugauaugaaugugcuugcuaaugauagaauggaacuggaacccuugucuucagauuacauugcaggcaucaaauaggacagacugagauugagaaaguccacuuaauguuuccagaauuuuuaacucuaagguugccccucuuacuuaacauuuguagcuucaaaaagaggcacccaaccaggaugcucauauuaccuaauacugcauguugauguuaaaaagaaugugcagcgcugugaagauuuugaaugacuuauaacacaggcugguaaacuuuuuguguaaagggccagauaaguaaauauuuuuaggcuuucuggacucuauagucuuuguuacaacuauucaacugcuguuguagcucagaagcaacccauaaacaauaagucaauggaugaccauggcuguauuccaauaaagcuuuauuuagggaaagugaaaucugaauuucauauuucacauuacaauuuuuuugauacuuuuucaaucacuaaaacaugucaagaccauccuuagagaguggaccauauaaaaaaggagguggacuagauuugguccaugcaucauaguuugccaaccccuaacguaccaaguggucuacucaacagacagaucuucuuugccuguccuuaaaaaucagaaugggaaugagggaaagaaaacagugggacaaagauucagcaaaguauugucucuacgauuucuuacagcaagauggucaaaagugcagguaaaaaaaucuugaauucucagauaagagcaccucaauuagaguucuuguaaaagcuucaaggaaggauauucaaaguuuguccauacagucccaaaugguagaaugucuguuuuccauggcugaauaauauuccauuguguguuuauguaccacuuuuuaaaaaauucauccaucaauggauaguuaggcugcuuccaugucuuggcuauucuauugugaauacuguugcagggaacaugggagugcaguagcucuuugagacacugauuuuguuuccuuuaguuaaauauccagaagugggauugcuguaucauaugguaguucuaucuuuaauuuucugaggagcuuucgugcuguuuucucuaauggcucucccaauuuacauuccuaucaacagugcacaaggguuccccuuuucuucacauauaucaaaccaucacauuguacaccuuacauauguacaauuucauuuaucaauuauaccucaauaaagcuggggggggaaagaaagaaaagauauucagccaaacaaaccaguuaggcaguauugaaguucuauggaaccugagccaugaaacuauauuuguugugcacugugcuccucuccaauuuuaaaacuaccucuuaucaagcaaguaacaugcugaauugugcuucuuuguuuaaacuugucucaccuaguugcuuauaaacucuuccaggguagcaaccauuucuuacuuagcuuuauaggcucagugcagagucauacacuugacacacaauaaaugcuauuugaauuuaccaguaacaugaaaacccaugagagaucauaagguauaaagacuucauaauauugccauaagaucaaccuauagaacaggagaaaauuuuuacaaucuacccaucugacaaaggguuaauauccagaaucuacaaagaacuuaaacaaauuuacaagaaaaaaaucaaacaaccccaucaaaaagugggcaaaggauaugaacagacacuucucaaaagaagacauuuaugcagccaacagacacaugaaaaaaugcucaucaucacuggccaucagagaaaugcaaaucaaaaccacaaugagauaccaucucacaccaguuagaauggcgaucauuaaaaagucaggaaacaacaggugcuggagagguuguggagaaauaggaacacuuuuacacuguuggugggacuguaaacuacuucaaccauuguggaagacuguggugauuccucaaggaucuagaacuagaaguaccauuugacccacccaucccauuacuggguauauacccaaaggauuacaaaucaugcugcuauaaagacacaugcacacguauguuuauuguggcacuauucacaacagcaaagacuuggaaccaacccaaauguccaucaauaauagacuggauuaagaaaauguggcacauauacaccauggaauacuaugcagccauaaaaaaggaugaguucauguccuuuguagggacauggaugaagcuggaaaccaucauucugagcaaacuaucacaaggacagaaaaccaaacacugcauguucucacucauaggugggaauugaacaaugagaccacuuggacacaggguggggaacaucacacacuggggccugucaugggguggggguagagggaagggauagcauuaggagauauaccuaauguaaaugacgaguuaaugggugcagcacaccaacauggcacaugcauaccuaugugacaaaccugcacguugugcacauguacccuagaacuuaaaguauaauaauaauaaaaaaauugccauaagauuugcaucccaugaaauaaaguugcuuguuaaugagagaauaaaaguaggcacuuucuaaaugauuuuguuucaauacuuaccaaguaacuauuaagugcuaaaaaugcccccaguaguuuuuacauguaucacuuaucccuuacgaccauugugcaguaaauguguugccuucuauauuuguagaugaagaucacaaaacagguaggugaugaagccaggauuaguuaggacucagaucuccacaugacacagcucaagcuuuucccauuauaaugcaaaucaucugcagaaaugcaaaauuacucacaaaauaugucaaaacuaccauggcuauacuggcugaacacaggaaugagaaagaaaaaguauuaacaauaacguuauguugcaaaaugugaugggauagaacaguagcauccuuuccgaauuuuuuucaaaauaaaagccuaagaauauuaaaaacaaagaaucauagaguacccagaaggauauagagcacagaagucaaggaagguaucuacuuucuuuugcaaucacugugucacaaucagaaaacauauuuccaucauaccuaacuuagcaaaaguccagacaaaaucacuuauuuggagacacucagcauaacuucagacacaaguacucaaggaagcuaggugaaagacauaauuaagaaaggcucagagcuuuguggcuggccaguuaagcagcugucaaucuccuggacccaaaauacagagggaaaagaugcuaauggaugcuaccacauuuugcuuauuugaacaggauacuuaaaauuucauauuugaaaaguugauuucauuuauugauuuauuuaacaaacaauuccugaggcuuuacuguaugcugggcacuagguuagauuuugaaagaaaggugagauaaauaaaucugccuuaagaaaggaaagagaaaaguucuauggaagcuuugaaucugggacaaagaauuuugacuggggaguuuaguggaugguuucgaaggcacagguaaagaacaucuucaaaugucuauuugagaaauacuguuuaagguuuugccagacacaccccucugaaaaacggucacaccucuugcucaucuaauucugguuucucugucuucuacaacacacggaagagacagagcuauaguuaacaaaccaagaagcagaacugcaugagggaaagcagaaacgaaauggcauagucuucuagagaagccuucagcuugcagaaaucauugcuguugauaaagcuaaagcugcuagcauuuaguucagaaauaaaaagcaauccaaaaaaaaauguggccaaagguguguuuuaugauuugggaaaaauucuucuuaugauuuauuugggaagaaucuuuggagaaagauucuucguuuauuucucauuuccuuuucuggaaacaaauguccuaagugacuuuuuuggccacuguggauuucacuaguccaaaaaacucagcaauuuuauuagaauaacuaaaaaguugaugauuccuucugagcuuaauguuuugcuguuuuccccaaacuggcaaaaaguaagauaugaguuucuuaagaguucaacugcuuaaggcuccauuuauauaaaaaauuaaaaacauuucaaaguaaauucaauuagugaauguguauugccugaauagacuauccuucuaaauuuaauauacugaacaugacaauuuuacgagcggaccaaguuagagauaauauauuuuuauguuccuuaaacuagcaaagagaguucagaaccauaaagaacacuaacaagguauugcauauaaacuuucuuuuaaaaacaguguguguauuuuuuaaaugugagaagugcaagguuuguuuuucuucaugacuuuaagguuccuaaagauguugucuuaggcugggcacaguggcucacaccugcaauuccuguacuuugggaagccaaggugggaggauugcuugagccuaggaguuugaagaugcagugagcuaugauugcgccauugcaccucagccugggcaacagagcaagacccugacucaaaaaagaaaaaauguugucuucaucuuucaacaguauugcuaauaaagggcauuacugauaaauaauucacuauguguguugggggguagaauguugggggacagagaaugcagggagugaaggaagggagagggaaguaaaggggagggggagaggagggagagacuacacuagucaaccuucuagaggacccacugagauuaaaaacagacagggagucacaggauaaaaaaauaaaauuucaaauaaccugcacuguuuccuuuagauccuaagagauuacaagugaugccucgcucacuaguaacaaagauaaagaucuaggaggaaagauuguguuuaucaccuauaaaaugaggguucugaugguuaucccuuuugcacucuggcuucugaggauaaacaugcagccuaaaucgacugcacuggagauuuugguucuuaaaaggaaugguauauuugacuuuaaggaccuuucuugcugguaccaggauucuguccaguccguggaugauauagucugacaucuuuacagauguuccugagguuuauaaccuuugcaggcagaauucagaaguccaguuuugaauguucaguucuuuuuaaugaaauccuuuaacugaaaauacauucuacgugucuuauaguuuauucuguagauucuccccaccacacaaaucaccuaaugcuauuuguagaagaauauaaugagcaaugcacuguuuuacugggaaaaaaagugaaucccuguuuggaaccaauugcuaagucuauuccacauuaauccggaucuugaguaucuuguugauauaacuguucucaggaugaacgucauaaaaagacuacaggaaauuaacauuuauugaagaccuacuguguguuggguuaugggaaacuugcaucuguuuuagguauugagguauaauuuaccuaccauaaaauuuaucuauuauaaguaaacaacucaaugauguuuaagaacacucucaucacucugagaagcuccuucauauccuuuguaaucaaucccugcucccaucuuccaggcccaaguaaccucuuagcugcuuccugucucuaucauguugccuuuucuagaaauuucauauaaacagaaucauaaaauacguagucucuugugucuagcuucuguccacguaacauuuuuuggauuccucaaugcuguuaaauguaucaauagcucauucuuuuucaucgcugaauaguacuccauugcauggauacgccguauuuuauuuauccauccauuuuaugugaagguaggauaggucagauggcaaguguacguuuaacuuauaaacaaaugccaaacugcuccgaaguggcuaugguauuuuacauuccaaucagcaauguaugagauuccaguuugucuacauacuugccaacacuuugauacuaucagccuucuuaauuuuagccaugcuagcuagugguuggggaguaaaaucuuauuauugucuuaauuuauauuucccaaguggugaaucaagcugaacauuuuuucaugugcuuauuugccauuuguauaucuucuuugguaaggugucuauucaaaucuugugcucauuuuuaacugaauugcuuaucuucuuauuguugaguuguaagauuucuuuaaauauuuugguuaaagcccuuuguuagauaauuacuuugcaaauauuugcuucuagucuguugcuugccuuuucauuuucuuaauggugucuucuuuuuucuuuuaguuguccauaacuuuugcaucauauauaaaaauuuuuuucccuaacccaagaugauauaaucuucuauuauucuucugaaaguuuuauaguuuuagcucacacauuuaagcuuacgguccauuuugauuguuguguguguguguguguguguguguguguguguguguguguguagagagugcuguaaaggucaagggucauaaucugcauacacaaaucuaauuguuucagcaccauuuaaaaaaaaaaucauccuuucccuauuaccuuaacaccuuuuaugaaaaucaacugaccacauauaugaggguuuauuucuugacuuuugcuucugcacuacugaucuaugcaucuaucuuacgucaauuuacagugaguuuugaaaucaagaugggugaauccucugauuuuguuguuucuccacacuaggauauucuauaggucauuugcauuuccauauaaauuuuagggccaguuugucacuuucuacccccaaaaagccuacugggauuuugauagagauuauguugaaucuguacaugauuaugaaaagaauuaccaauauugggucuccuaauuaauaaacaugguauauauugcauuaauuuaguuuuauaaauuucucucagcaacacuguaguuuucaguguauaguucucauguuaaauguauucuuaagacuuuuauucuuuuugauguuauuguacaugaaacugaucuucuuaaaauuucauuuuccaguuguccauuacuaguauacagaaacauaacugauuuuuguauauugauuuuauaucuugcaaucuugcuaagcucauucauguucuaguagcuuuuuuuuguagauucugcggauuuucucccuauaaaaaucaaauugucuauaaauaaaaaguuguguuucuuccuuuccaauucucaugccuuuaauuucuuguuuuagcauuaugguccuugacuuuuauauuugaauuuucagcauaauucuguucaguacauuguacacugauaccccuauuccucucucaugaacccugaaaucagguguuuguauaucuuucccccuaacaaaugaccauuuuuagccagcacauaauuccacuggcugucagccaaaaauucaguuucaauagcacugccaucuuuacuuacaaaagucuuuggagaauuauuucaaaaauucaaauugcauuuuguacucaucauguagggaaaaaagauuagaaaaugagaaaaaaaguacugcuaucucaguaauaagcaugagucucauaaaccuaacaauugagacaaacaugagaaucauuaggcaugcaggaagucgcaauucuuuagcuucaauuaggugcucacuggacuuaauaagcuggucaaccaugaggaagagaaaaaaauuaaagaacauaauauggcauagugaaaauauuacguuaaagacugugucuaaacuaagaaaugagacagacagcaauacaauaauagugggggacuucaauacuccacuaacagcacuagacaggucaucaagacagaaagucaacaaaagaacaauggauuuaaacuauaccuuggaaaaaaugggcuuaacagauacauacagaacauuccauccaacaaccacagaauacacauucuauucaacagugcagggaacuuucuccaagguagacuaugacgagccauagaaugagccucaauaaauuaagaaaauugaaauuguaucaagcagucucucagaccagaguggaauaaaaccggaaaucaacucuaaaaaggaaucuucaaaacuaugcaaauacauggaaauuaaauaacuggcuccugaaugagcauugggucaaaaaugauaucaagaugaaaauuuaaaaauucuuugaaccaaacgacaauaaugacaucaccuaucaaaaccucugggauacagcaaaggcaguguuaagggaaaucaccaagaucagagcagaacuaaaugaaauugaaacaaacaaacaaaaaacaauacaaaagauaaauaaaacaagagugguucuuugaaaagauaaauaaaauugauagaccauuagcaagauuaaccaagaaaagaagagagaaaauccaaauaaccucauuaagaaaugaaauggcagauauuacaacugacaccacagaaauacaaaagaucauucaaggcuacuaugaacaccuuuacgcacauaaacuagaaaaccuggcagagauggauaaauuccuggaaaaauacaacccucguagccuaaaucaggaagaauuagauacccugaacagaccaaugacaaguagcgagauugaaaugguaauuuaaaaauuaccaacaaaaaaaguccaggaccagauguauucacagcagaauucuaccagaauugguacucaaaggauugguagcauuacuuuugacacuaucccacaagauagagaaagagggaacccucccuaauucauucugggaagccagcaucacccuaauaccaaaaccagcaaaggacauaaccaaaaaagaaaacuacagacugauaccccucaugaacacagacacuaaaauccuuaacaaaauacuagcuaaccaaacucaacaacauaucaaaaagauaauccaccaugaucaaguggguuucauaccagggaugcagggauaguuuaacguacacgagucaauaaaugugauacaccacauaaacagaauuugaaacagaaaucgcaugcucaucucaauagaugcagaaaaagcauuggacaauauccaggauugcuuuaagauuaaaacucccagcaaaauuggcauacaaaggacauaccuuaauguaauaaaagccaccuaugacaaacccacagccaacguaauacugaauggggaaaaguugaaagcugucccucugagaacuggaacaagacaaggaugcccacucucaccacuccucuucaacauaguacuggaaguccuugccaaaacaaucagagaagagaaagaaauaaagguuauccaaaacuggcaaagagggagucaaaccaucauuguuugcugaugauaugaucauuuacuucaaaaacccuaaggacuccuccagaaaucuccuagaaccgauaaaggaauucagcaaaguuuccagauacaagauuaauguacacagaucaguagcucuuccauacaucaacagcgaccaguggagaaucaaaucaagaacccaaccccuuuuaaaauagccgcaaaaaaauaaaguacuuaggaauauaccuaacaaaggaggcaaaagaccucuacaaggaaaacuacaaaacacugcugaaagaaaucguagacgacacaaacaaauggaaacacaucccaugcucauggaugggaagaaucaacauugugaaaaugaccauacugccaaaagcaaucuacaaauuuaaugcaaucugcaucaaaauaccaccaucaugcuucacagaauuagaaagaacaauucuaaaguucaaauggaaccaaaaaagagcccagauagcuaaagcaagacuaagcaaaaauaauaacucugaggacaucacugauaugguucagcucuguguccccacccaaaucucaucuugaauuguacucccauaauucccauguacugugggaggggucuggugggagauaauugaaucacgugggcaguuucccccauacuguucuugugguagugaaugucucaugagaucuaaugguuuaccagggguuuccgcuuuugugucuuccuccuucucuuuuugccuguugccauccauguaaaacaggacuuucuccuccuugccuucugccaugauugugaggcuuccccagccaccuggaacuauaaguccaauuaaaccucuugcuuuuguaaauugcccagucucagguacgucuuuaucaguagugugaaaacagacuacuacaaucacacuaucugauuucaaacuguacuaugcuguuccucaccaaaacagcauaguacugguauaaaaauaggcauauauaccaauggaacagaauagagaacccagaaauauacccaaauacuuauagccaauugaucuuuggcaaagcaaacaaaacaugaaguggggaaaggacacccuuuucaacaaauggugcugggauaauuggcuagccacauguaggagaaugaaacuggauccucaucucucacuuuauacaaaaaucaacucaagauggauuaaggacuuaaaucuaagaggagaaacuauaaaaauucuagaagauaacauuggaaaaacccuucuagacacuggcuuaggcaaggacuucaugaccaagaacccaaaaccaaaugcaauaaauacaaagauaaauaguugggacuuacuuaaacuaaagagcuuuugcauggcagaaagaauaguuagcagaguaaacagacaacccacagagugggagaaaaucuucacaaucuauacaacugacaaaggacuaauaucagaaucuacaaugaaaucaaacaaaucaguaagaaaaaaacaaucucaugaaaaagugggcuaaggacaugaauagacaguucucaaaagaagagauacagauggccaacagacauauggaaaaaugcucagcaucacuaaugaucagggaaaugcaaaucgaaaccacaaugcaauaccaccuuacuucugcaaaaauggacauaauaaaaaaaauuuaaaaaauccaguagauacuggcauggaugcaacgaagagcgaacacuucuacacugcuggugggauauaaacuaguacagccacuauggaaaacaguguggugauuccuuaaagaacuaaaaguagaacugccauuugauccaccaauuccacuacuggguaucuacccagaggaaaagucacuauucgaaaaagauacuugcauaugcauguuuauagcagcacaauucacaauugcaaaaucauggaaccaacccaaaugcccaucagucaacaaguggauaaagaaacugugauaucuaucuaucuaucuaucuaucuaucuaucuaucuaucuaucuaucuaucuaucuaucuaugauggaauacuacucagccauaaaaaggaauguauuaauggcaugugcagcgaccuggaugaaacuggagacuaguauucuaagugaaguaacucagggauggaaaaccaaacaugguauguucucacugauaugugggagcuaagcuaucaggaaaaaaagccuaagaauaauacaauggacuuuggggacuugggaggaaggguggaggggggcaagggauaaaagacuacaaauagggugcaguguauacugcuggggugaugggugcaccaaaaucucacaaaucaccacuaaagaaauuacucauguaaccaaaugccacuuguaucgcaauacucaauggaaaaauaauuuuuaaaaaagaccgugucuaagaugcaaaguauaauuagugguuuuguaauauguuuuaggucuuugggaacacagcugccauuaugauagguacaucuauuauuauauuugaacacaauucaauuaacaaauacucuaaggaauguauugggucucaaaguggaggagauacaggacuucauuuaaucuuacaaaacuucugagaaagguauaacaauucccauuuacgaacuggaaaacagacccagaaauuuaaguaauuuguugaaauaugcacaguaaaugguggagacaagauuaaaacccagaucuuuuugguucaaaagcucuuaauugggcccuauguuccugagcaacucauuuccaugauccauaccucaaagccucagccuuccgcccacugcugaggaacccucugguucuaugguuucuaacauuuucuggauuuccucagugauuugcaagcuaccgugcaacaacuagagaagaaucuucuuucugauuuguucugucugaaaauaucagcccggaggcuuaaacacuguaauaaaaaggucugagguaguuacguaaauaagauacaugugaauaauuauagaaagcuuuguuugaaaaagaugaguaauuuacccuuaaguuuggggaagaaaugcccaggaaguuugaaaaagaaaggauaugaaaaauuuuaagugagguaauucaggcuuuuccucuuugcuucauuuucucgggcagacacauuggaaaauaagugcauuccaaagcagagaaguuaccauuaaacugguccauuguggacaggugacaaagcucagccuucucucucaacaccccacagaacaauucuaacccaugggugcagaugauucagacuaaauucuuuauaauguggguuuguaaggccagaaaagaaggacuauauuuccacucaugaggauacagagcaaggaaaaagcaaacaauaucaaaagugcuucuccuugugccuucaguaaauacucaauagauauuuuggacuuguuggcuaauuaaaaagcauuuugauaggcucuugucauuaaacaaauacuaauuauagcuccuucuguacucugggcaauaccagaaaugaucaucucaguucaugagaugccagaugagcccugugcagagugaggaaguuguccugugugauuucuacccucugaucggcaaaccucuggaagagaauuuuuuuucacaaauccucuauuuuauguccuguacuaauguauucauucucgagucuccuuccucccaaaacauauauuuuacaauccuuauaauguucagacauacuggguaaugccuugacaaaucuuuguaguuagcaaaauauuggaaaccaccuacacgauugaggaacacagagguaauucuaucagaacagggguuggcaacugugggcccacagccuguugccugucuuuguaaauaaacuuuuacuggaacauagucauguuggcucauuuauguauugucuauggcugcuuucuuucuuuuuuugucgcccacgcuccagugcaguggugcuaucucacuucacugcaaccuccaccucccaggcucaagugauccucccuccucagccucccaaguaguugggaccacaggugcacaccaccaugccuggcuaaucuuuuguauuuuuuguagagaugggguuucgccauguugcccaggcuggucuugaacuccagcauggcugcuuucuuaauugccacaaagacuacauuuuaggccugcaaaggcuaaaauauuugcucuccgguccuuuauagaaacugccaaacccugucauuuaaaauguauuaacauuucaaauaacauagcaaaauacuucuuuuagaauaagcuuuaaaaaauguaagguaucauguuuuauguauaguauaaucacaauuacguaaaacaaaugaaagugggucuagagaacagaccagaaauguucagcauuuggacuagugugguagaauuaugggugauuucccuuccacccaaccuguguuucgcaauuuuuaaaaaugaccuuacguuucuaauagaagaaacuagaccucacuuuaaaagcucuuugaguccacaucuccaucugguacacaguggucgugacuaaaugcaguggugucucccccuuggccccuccccacaagugugcugaggcgggagcaggaaguccugguaaguaccuuaugcucaucccgaagguggcuguccaguuccuccgugugcuuggucucauaguagcagagcuggcauuuguaagguuucaguucauugugcuuuucuauauguugcuggaggcucucaucacuggagcaggugaagguacacuuaucacagcggaaaacuacucccugcaaguauuuggacaguuuggaccggcaaacuucaauggggacaacacgcucuucuguggaaacaaauugaauggaaagaugggaauuuuuacugauggcaaaacagaaguucuuucuuuggaauacaagaagaaacucacccaaucuugcugcuccucguggaucugguuccuugaacugacacacaugcacccugccccuccccuaacccccaaacaacauauuccucaggaaugaguggguguuuuuaagaccaaaagcucuuuguguacuuaauacccagaaugaccuauaaauagagguggggugggcuaguaggugcuugcuaauuccugaauggaggugauuaaggcaagggggaggaauagaaguagcugcaauuuuuaccaacauuaaugauuacugacaacaaccauuagcaugccuuccuuccucagcaagugcaacugaggcuggacuuacagaugucuuuaauggggaaagaaacugacauucaccaggcaccuauguucugguaccuuucuaucagcaacuuuaugaggcuggaguuacucucauuuuuacaaauaaguacaaaugggcaacagagucuuuaaguaacucuccaaaggucauagacauugcaguuggcaaagcagagaugugaaaccaggucugcuuaacuguaaaucuauuauuucucacuauuuccaauuccauucucauuuccccuucuaagguauucucaaagagacucuucccuccuuuugaaacuaaggggauuucucaucuaauaucaagucugaaagcaaaccuguacacuuucauucacuaaaacuccaacuaugaagagcucacaaaugaaaugacugcaggcaacaaucgggggaggugggguugcgcaggagacagggaggauuugugucuuuuuagacagucuguaaucugauugucagagggaaaaaauaaaagagagagaggauuugggugcuuuucccguuaacauaccaaaugcuguagggcuggaaaugcgugugcuuguuuauuuugcacucucucacccuuguguuuaacugcucaaauuaaauuucacaccagucugcccagaguaucagcgcacacgccagauauccauaacugggauaaaauuaaaaucugugcuauuuaugcaagaaucaaauauagcauguguuuucaugcugugucuggauuucagaagacucagaaaguuuacaaauggacgcacacaacauauacuuauauuauuuagaaacagcaauguauuauuaagucaagaaagcaugauuuauucccagagucacugaauagcaauguuuccagggcaucgguacguuguacaccgaugcgacucacucuuuagaguccucccuuuguugcuggccagugugcaggcucuagggaauuuuccccacccaaugucaugccuuagucucaaccacaacacucugauuguagggcagucacugccuugggaguccuugaaggcagcgauuaaucggcccgcaaaaugcugggcagaggaagcguggaaggugguaucugcaacauacccccuggagcucuaaugcauguuauuuucccuauacaaagaaucaguugcuuauuuagaaauauaaauauuuuuaaacccaaguauagcagacagcuaagaaacacaugauuauaauguaauccacacauuuuuuuagaauagcaacuguuuaaguccucuaaccauucaguuguaugguuugguguaaacggagaaaaaaaaaugcuuuggcauaaacuaguaaaucuuaaggagcucaugcuaggauauucuauucuuguaacucaagguuucuaaaaaguagcauuauugaaauuuugggacaggauaauuccuuguuguggggggccagccugugcauugcaggauguuuagcaauaacuguggccucuacccacuaggugucaaaagcacccccuucucuccagcugugacaaccaaaaaugccugcagacuaacacacucuggggaggcaaauugaccucagcugagaaucacugcucuaagcaaagugccaggcauuaacugcaacuacgcuggguaaggcacucauggacagaacccaugaacaagcuagugucaacagcaagagauggggcaugcaggcugaaccacggggaacugcccccaugcuggggauaugccuuuagaccuuaggaguucaugggaaguguugacaugaacuuuacuggcaucuuccuugggacugcaucccccuugcucucucuacauuuuaguuccucauuuauauguuaucaucucuacuguuucuacuuucauucuuuggcuuugcccuguccugccugccuugguuccguugaccucuacggugaagaagaacagcccgguaucauuuuucauauaaugaugucccacacgccucaaagauagucauucagugacucuccagucuucacuucuccacaauuaauaaucaguucuuucaaacuuuuuuaugagccuccuuuucaauuccucuaccacuuagguugguuuucuuugcaguuuccaauuucacuaugugugucuaagugaauuuuacacaaagucaugaauagucagaauaacacccugaaguucaaguaauuauucaugugaacaccacugcagacuauuaagugcucgcuacgguucaagcaccguuagguguucuacccuugacauaacuuuuuguucucauaacacccugcaaagucaguucuauuuucuucaguuuguugauguggaaaccgagaacugaucaauuaagcuacuuccucaaagucacaccucugguucagcacaaagcugugaccugggaacacaggucuucugaucucugccagggcccuccucuuggaccccugauaagaacucuccagucuguaugugugugcuuauaagccuuucauucauaauauuuaaaaaaugcaaaagcuacagauuucuaagguaacccuuuauaucugaaugucuuucaagcaccuucuacauuugaggaaagggucaaaucccugcugaacuuaaaucugaaaucuagaacuucccauuuccaaacuaagacaaugccagucuaccaaaucucuuaauuaugugaguuuuuacugagauauuaauuuuagaaaaaaaguuagcuuuuuccccuuucuaaaaacaugguuaacaugaccaagauaaaaauaaaaaaagacagacuuuaaaaggugggcaaaugacugacaguguuuucugaaugaggucauucauucuugaggcaaaugaaagacauaaaaguuaaaaacuggaaugguuccagguauagacugggcucugccuugguuacagaagcucagugcucagggcuuuuucuaugggggcagugacaacugugggucuuuuugacuucacaccucucaaaauuaccuugggugaaaacucaaggccugaaucacacucauugugacucagcuucuagcacuggcugcaaaaauauuaugacuucaccaguucaacuacaagauggauugugucucucaucuccuccuacucaaaagaugcuuggugcugcagcaggacauaaaaccgaagagguugggcccgagaguaaugucacauugaagcacauguguacuaaggugcaacaagagcugagaauagcaugcuuucaagccuccauggaggucaguggaaaauucugcacagcugcaauacagaggguucacuucugcucaaauuggcgagaaaccacaccacugcagagcccagauucaacuagcaaaaauccuuccugaaaggcacaccacaacauagguggguuuccuucccagaacaugccaagucuacaugaagcaaugagauuggaaguucuucacuccaccaaaacuuugcgugcaaauugccacucuagaggacugagucccucuuugcaccaaagcaaagaagugacaaagucugaguauuagagaaagcuaugaagaaaauaacauuauuuuuauauaaaucaucccaaaacauagccauaaauagacaaacauaaacacaagcaaaacaguuccugguaggaaguaugagguuuugauguuagccaggcugccauccucaagcuagaaggaacuggaaauggcaccucuaauucuaucaggcaaagguauuuggagaaguugaaaggaaacauguaauuucacugaauaaaauuaaagauuggcaaucucacuguagacuuuauucucaagaaaaaugacacugaucagauaaauuaggggagauuauuuccguucccaaggcucccacuugcaagguucaguuaaaugcggcauuugucuauguauugggaaacagaaacuuuaaguuaauaugccaauuaaagacccauagcagugauuacaugguuccaaaauuacaauguaaauauguggcaaaacuguguuucaucccuaaaaucuguggccaguuuuuaaggcucacuauggaugugcaagauacauauacaugggcaaagcuaagcaugaaacauugugcuuccaauggugaucaacucaauaggaauacccucauaaaacuauuauucaccuguuuuuuagucucucuucucguucaaguucaaauuccuucagugcagaaaccuugccugacucuucauggcuguaucccuacagcuuaaaacaaugcuagagcuuucuccuccagcugcccaagaugucaaaagaaaaaaaggccaaggggaagaagacggccuuggcuccugcugucauuaaaaaguaggaggccaagaggguggugaauccccuguucgagaaaaggcuuaagaauguuggcauaagacaggaccuccagccccaaagggaccuuaguccuuuugucaaauauucccacuacuucuggcuauaguaguaaagggcuacccuauaagcagcucagaaugacuccugugauuaaccaauucacccaugacuuggaccccuaacagcuacucaacugcuuaaacuggcuagagacaaagcaagagaagaagauuguuggccugcauugagaagaaagcugccagcaaagggaauguccccacgaagaggccaccuguccuuccagcaggaguuaauacucuuaccaccucaguagagaacaagaaagcucagccgauggugacugcacaugauguggaucccauggagcuggcugucuucccgcuugcccugaguccuaagaagggaguccccuauuguauuaucaaggagauggccaaauuggggugucuaguccacagggagaucugcacuacuguugccuucacacacauuaacuuggaagacaaaggcgcuuuggcuaagcugguagaagccaucaggaccaauuauaaugacagauaugaugagaucccacaucacugaggaggcaagguccuugguccaaaaucuguggcuuguguugccaagcuguaagaggcagaagcuaaaagacuugccacuaaacuggguuaaauguacacuguucaguuuucuguauauaaaaauaauaaaaagucuccuucaaaaagccaaaaacaaaauaaggcuggcauauaguggguguucaauaaauauuuguugcaugaaugaaaaccuaccaaaaguccuaccacugacuucauccuugaaagagaaguucagggcuuaauuuuucccuaguuaaacucaucaaaucauggucaaucucaccaaacguugaucugaccuaaguucacaguuccugaaugagaugggucuaccaauccuuugcuucaaccuuugcuaaauuaguauucaauaagugucucaucaguaaccugaucagaauuuguccuggcuucccaucugucuacugacuaaaguuccaacuucuauauuaguauccaggcgcuucauacuuuggccagaacauacuucucugguaugcuuccuauucucuucaggaccccggaaaugucuaauaacauucugcaaacaugucuugcuuccaccgaccucagugguuuauuaaauugucucuucccucguguaguggguugaagagugucccccauaaacuuaagucuaccuggaaccccagacuuuauugggacauagguucuuugcagauggcaaucaguuaaggccagacuagauuagggugugcccuaaacccaaugacuaguguucuuauaagaagaaaagagggcacaaagagauacacauagagaaaaagcccauaugaagauggagacaaacaugagagugaugcagcuauaagccaaguagcgucaaggaacgcugggagcugucagaagcuaggaagaggcaaauaaggauccuucucuugugccuucagaggaaacacagcucugucaacaccuugauuucagaguucuagcuuccagaacugugagagaauacauuucuauuguuuuaaucuacacauuugguggucacuuguuacaauaguccuugcaaacuaauaugcccugccuuaagucuucucugccuguugaaauguuaucauggcucaguuugaaagccaccccucucuacuacaaacagaaauauaccuagauacccaucacucacugucuugucuauacuacgcacaugcucaucucugaggagagugggugcugggucuuauguuccccauuuugcccaaagaaccaagcauagcguggcacguaacaagcaaauaaugaauguuugcugaacacaugaguaaacaucauacucucuuuugcuguggccaacauaaaucccugauuaguucauauucagauuucccaugagcgaaguagauucucucucuacuuaaauauaucaauuuauacagacaaaaagcaauggaaacucuauuucugccagcaguaguucugucucugggccaguucagaaguugguuuucuugcuuuucaucccacauacuuuaauuaacuaagaccucagaaagaucuuguacuguggaccugagagaccaaggaugucauggauagagcaggaagaggacaggugcagaaggagccaugucuuguuacuuugagaucagccccaacucaaaauugcaaggcagacaugcagcucugucucucgacuugucaaggucagcuuccuacugagcugccauuuugaguagagauggacaccaaagccaggccgggacacagaugguauacauggcuguccugaggcacucugcugccuguggauccguggacuuccccucugaccuccucugauaauucugucuuugaacucagccgccacagcuacuagaacacucaacagggugauacuaccucucucagggugagagagugacgccugguggguaaaggcaagagcugugggucagacaagccuggguuuaaaucccagcuggauuacuuacuagacauuucauguucgucaaguuguuagccuuucugaauccauuuauuuccucaucaugggggauaacagucauccaccacauaggauuuugugagaauucuauaaaaugacauacuguaaagcacuuagcacaguaccugcuaggcaagcaaccggcaacaguaaccauuguuguuauuauuguuaauguuguuauuauuacuauuaauccucaaaugcucauguucauuucagauggauguuuucugaccuugauaaggacucugaaaaugauccuuacaaguaaacagaagagaccacaaauaaccagugacagguaaugugaugagacaugggaucaaaggacugcgauugacugcuuaccaguugggugacuuugagugagugauuccagcucucaugugcccugcaaaacuuacuauuguauuuaugaugggcacaauaugcacuacgucacacacugugcccuucaggaaaaccugcuagacaaauuccucuagguuucagugucuaggauuccugaaaauuuccugaaugacaguucaaaaaagucuaacaagcaguugaaaucugguugcuucuguggguuucuuuucuaccaugguaggcaaggaaucucagggcgaaaucugcagcccacugugaacaagggcauggcaccucaugguauccacuggguauccaaacucucagcuagcuuuuucauacuuagaggugaacuuuccacuaguuucuucuuauuuugcauuuaccccaauuuccuuauuuguuuuuaaaccuauaguucggcacacacgucuuuaagauaucuuaaaaccuuugugaaaugaaguagauggcaaauaaguacauuaaauuauuuuaaaaauaguuugucucacucucaaguuucacaggcauacaacgggaauagaguaauaguauccuucacaauguugcuggaagaugaagugacugugcguguaagcggcacuuuguugaggguagaaugcuaugggaguauuuguggucguaguguuuaaucucucuuugcuucccccuuucuuguguucucagcucagggagggaaagucauugagcuuguuaggcaucaaagcucuguuccugccaggcagcaauaugggaaaagaagggaaccaaccacagaaagugaagacucgccaugucugcucggcagcagcccugcugauggccccuuaccaagcugugauagggcacagagccaccgcaacacaugggcugggggaccggaagccaggugacugaggcggaacaccaggcgggaccacucgggccaagaauuccugccuaaauguuccuaugauacuucucccagcuugcagguggacauccuagccagcaacgaucucaugucucauuagagugcaagggggaggagggaaaucugugcauguuaaauguccagccuuccauugaguuugcaugaacaugggugaguaugucacaaauguauuggccaaaggcaauggcucaggggcaaugugagguguguugccaauggcccccaaauacucagcauuucagagugagugacaucccagcaagacaacagaugacacucauugcuuuugaggcauaugugacaaauauuggaaggcuuucuaaggucagaggcgaaggaaugaagauaggagggaagaggaugaaaagaagggauggagagaaagaaugaaguagauggaaagaucaguagaaacaccaaucaagacuggcaaugaguacuccaguaaucuuuuucuauccaccuguagcuugaaucuuuucaggacgaaacagauucuacauauuuuuccuuccaaugcagaggaaggcuguuguuuaacaguguuuuaauuggccaaggguaaaugcaacucaaagaaagaccgaaguggacuuaaaagaaguaucacuguuuaucagcaggaaccaacauuuauugagcagucauuaugcauccauuaugaaaaaccacuggacacuuuacccauuaucucauagguacaaucaucucuuuuaauggauggagagguuaaacacagugggcucuaaaaccagaauuuaaauccaaagcccauggauuuucuaauuauuauuagaauauauaauagagacuauuauuagaauguauaauauacauuauuuuaaagaauucucucucccuucaaccauuucaagggaaguuccauguucugcuuuggaaaucauuuuggucuucuugaaagaaucucucacagccauagagcucuccacauuucacauuugcuuucacccacccauuuuguuucuuguucauuccuucuaugcagucuacgcaaggcuguggguggcagaauugucagaauguacaaaucccccaugcugggaagcccuacggaaauguucacugcagaauccaucaccuuugccucccuccagguggaggaaauacucccagcaggaagguguuuuugcccuuuuggcugucacugugguuaucacugugguuucuugccugaagauaaggugaggaacaaggcacaggugcuacugccacucugagagagcaucccuagaaggccaucucugcugccugccccccgcugcauccaagaaaaccaaguuagaaagguuaccucggugcagcacgauguggucaaucauguugcgcuuguauuuggugugauagaggcagagaggacagcgaagaucuuuggggcccuccucgggaacugcugagugcccagcuuccacgugcauaguaaaagcagaucuaggagagaguuugggaggagaggugaugcguguaaccagggaucauugcauuuucacauuuccugcuggcaaacccguuauauauguccaagugcggcucuccugcuuguggggcuaaaaaaaaaucuguucaucauguuuguugaccacccagaaacuuggucacucaaccgaaucugaacacugucaaaugguaguaacuucuuucuggaaacugugcccugggcuggguucagagcuuaguuugaaaagaaacaaauuccccaaacaccuuauucuuaaaaauugucuguuaagaguaucaaaacaaaaucccaaaaaaggaacuauuuuucaucaugcuugggaggagagagacuauuuuaaagcuagguugacuuagaaacugccuguauaauucuucacagguaagggggggaggacaaguuguccaggaagucaaucaucaugauugaugauuagguaaacuaagugguguuguaccagcuuaaagguggaaugguacugcugccucuuccuccauccuuuucaaaucuucaaaauuugcaaagccuuaaaugucucauuaaaaucgauaaagccaagacuuuaaugggcagggacccuuucuugugaacccgaguguugcucucuggagaaagugucugccugucugucggcccuugcccucugggguccucuagccuucucucagcaccaaaucacaaauguauuuaucugaaaaguaacuggagcaaauuaauagagauagaacacacguuccaucaaaucccagcuacuacgaugcuggugggaaagagacuucuucuuccaauucuucuuuuucuuuggacaugaagccuaauuuccacagccucucggugugaagcauguauugaaguagucuaaggcucagauccugauuacaauaggaacagaaaauaauagcuuuuuaucuaugauaucuaaugucauauuauuauaauagcuuucuaucuaugauauuauuacacuuauuaguguuugcuuugugccaggcacuauucuaaguacuucaagauacacugguucauuuauugcucacaagagcccuaugauguagguacuauuauuaucuuuauuuuauagguuaacaaaauagggacacagauagugucuuagugacuuguccagaaucacccagguagucaggcuccacacucuacacuuguaaccacuaaccuaaacgcuaucucacaggaugagauucaaaugcagaagcuuagauuacaucauaggaagcauuccauucuuaauaauugaguccaucaauucugucauccacaggggcaagggugacuauggauucucuuuuucuagacuggagcaaucucccuaugauugcucaaguguaguguuggaagugccagggucuugauucucuaugugucuuucaauacuacgaucuuaagaauuaaagaauuuucuaucaggggagcagggaagacacuacugccggauguuuucucuugacuuugacuuugcuuccaagaacauacuuuuuuuuccaaagcuaaaaaaaggagaggagacaguucucugaagggaaacaccacuccacgcaugggaggaaaucauuugcuucaaucuuacacuacuugagagcccauuugcuccaauuuuaaaacucauuuguucugauauagcucuucaucccuucccaaaucccaaagcagucuucugaaacuacccuccuuccaugaagccuggacccaaccccuacaucaucacaugggcagggccucccauaagcuccaaguaggaaaguguaagggaagccugcagugagggguggagcaggggcggccgccuuguuuuccauagcuguucauuacgucacuuacuuaaagccuguguaaaaggagcagucuuugcacuugaaaagcuucuucccaccaugcuugucccgguaaugacgccugaugcucuggauguagccggaggagaauucacagaauucgcagugaagcacggcuucaguuuucugcucagugccagcagcagccccagaaagaggcacagggcuaacacggcuguuguuccuugccagggcagcugacugauagugguucaacugcugcugaacaucugggggcucugaauaugaugagucugugaagagacgggaaaaaugacacggggcacagagaacacaguaggugaucgaugcuugaaaaccccugacaucagguuucuuuuuacccuccagcuuuacuaagguauaauugacaaacggaaauuguuuauacuuaagguguacaagaugaugauuugauauauguaucuguugugaaaugaugaccacaaucaauuuaaugaacguauccaucaccucacaguuaccauuuguaaugugcagggaacacaccuaagaccuacucccccagcaaauuucaaguacaccacacaaauuucaaguauuauaaauuauagucacuaugcugcacauuggaucccuagaacuuacuaauuuuauaacggaauguuugcaucuuuugaccaauguuaguuuugagaguucuuuuuuuuuuuuuuuuaagagggaugauuaugauuccaucuuuuaucuucauuuacauucuacaacacagauuuggggaaugcaugccgggaggaacuaucaccucuuuuaaucugacuuugagggcucaugguauuuaaaaauaaaauuuugagguuaaagguuucaaaguguaggaagaaaguaaaccguuuuuuuguuuuauuuuguuguuguuguuuuuuuuuuuaaaggaaaucgcagcauggcaacagguugccacagaauacccuucccuguaggugagaaaauaaaccugcauaauguacacaggcgucuacacgagaaaggaaaggacaugaugcaacaucuccuccuuugcagcccagauuuauucaagcaaccaaauuuaaaaaaaaaaucagucuuuaacagaaaugcucaagcacaaggcacucacacaaauauaaaaauguuuuaugccuucacacucaagugauuuaaauuuuaaaauauaaaaauccaauagcguucuccuggaauggauguuuaaagcuuagucagcauuaagauggagauuuauucauaaaucccauuaaaaugaaauuccaaacaaguuucccugaaagguauuuuaaaguuugcgauucugaggaaaaugucggaaaugacaggcacaaaucuuaaccccgagaagcuucaauggcaugcgguggagaaaucugaucuaggagggaggaggggaaaucucagcguuucuucuuugaauuaaaaaaaaagaagagaaaaaaaaguaaaaauaaauaaauaaagggguugggggagaggaaaaguaaaaggucuugaaccuuuucccaacaugcugcuugcaauguggagguuagaaauucaaaaacauuguccuauauaaccuacagcugccuaugaaugacacaaaugaaguccaugaauaccacacagaugaauuucaguguaacuuuccuugaaaagaaaacaaagggcucuuuucuuaagccuuucaaaaagcaggggggaaaggggauagaaacuguacaagccuccuccugauuugauggacacuuaauuuuccaaagcauaauucccuaaggcaggacauggaggaauucucuaaaacccauauuugaugaaaccagcaccauccaucccgucagccucuucgaacaggaaaacaaaagcagagcagccucccugauugcugggccaccgccugucugcaaaacacucaaauaucuuccccuucuuguucuccuccccgccuccucaauucauauuccucaagauugagaaaaaccccuuuggaaauuguaaacaaaccugccacacacacaaaaauaaaacaaaaggaaaccugaacaaugucuccaagccuccauagguucauuaccagguguaaauggaagacaaaggaagaaaggaaugacaacugaauucauuuuacccaguucuuuuaucuccuuuuucuuuauuccucuacccuagcugaugaacccacucuggaucacaauaaugcaauugucaacuuuucauucuucucauucaauagcagguuuguuuaccauuucauggauuguuugagauguuuucuauuuaagcccucaagucuaguuucugcuugaaacacaugcacaaugaagcacaaaacacacuccaccucuccuguuaucacaggcuugagcuguaaguugagcacugccagccaggauccccagauagcuucuguccucuugguaauguugguccuaguuugcacucuuagcucugcagaauagaaauucuauaaccagcaaggccaaagccagguccugcuggccugugaucugucuaccauccacaauccacccagagaccaaaacaaaucucccaagugauggucuaggucuuaaaggagucacaguccccuccauaacaaggcacaucccuggaucucccagauuaguaugaaugcugguagucaucucagauaccagguaccugacaucuccagucccuuucuagcaaaacuauaaagaaaugaacggcuccuagccagaugauaagccagaugaaugcacucccagaccucccauccacccccaacucaacacaugcacugaucugucaggcagacccccuccaaggaccccaaucucuuuuaguuaacacauuuuuaucuugucucuagggccuauugcauauuauuucauccaucucaaaaaacaaauucuauauuuuaacucugguauuuauacaguauggaaaaccugaagaaauaaaaaugcaagaagucacgggaaaagcauuccaagaaacagaggcucauugcccuucucaaauggcagugcaaaaggaacagcuaaugcguccaugucauaaaauuuuuuuuuuccuccugguuaaaaucagauggacagguuuauugacaaaaacaagcaaaucccaucauuuaggacacauuuguaauaaugcccagguuacaacuuuuuggauuuucuuagggcuuuacuuuccuuucugcugccaacauucucaauuucgcucucgcucacguggaauuugugaauaauguaggauuuuagcacuuugggcacuaaagugauaaagacaugaguguguaucauuccaccgaucuuuaaaaagcccacuugcuaagcuacauaaaauuccuguuuguucaugaagcauggccugaagagcaggaaggaggucguucugugcccagguuagaaaggcaaacagauuguuagcugcgaagggcaugucacauaaguuaaaaaucaucauuaagacuauuuucuuucauuuugagcuuaaggaaagaaagguuaaaaauauccuuguguugggagagucagacuucuggucauggggaaauacagcagcugaaucacauggaugugaauucagugggaaguucugcacccaacugcggcucacacaaguuagaucuuuaacaccuguauggccagugguaucuacaauggaaccaacagcaaagacuaaggugguccaccuuuaaaagcaggucauggcuuagcaucaccauacauucccaaccaaccaaccaaccaaccaaccaacccugacacauacagucugagaaaagaguuuuauucucugacuugugacuuuaauuauaugugaaguuuuagaaaugaaauuauaauguauaauuguaguuauaaaauaaauuuaauuaaguuauauggaguucuccaguuuguaagcuaucauaagaaaugaauuaaaaucaggaucaaauuagaauuuuagcaaugauggucacagugccuauaggauuuagaauuuauucagaagccagcaauuaauucucacaacuauggugugcggucuaauuggguuuacaucucaauuuuaccagugagguagcugaagcugaggaugacgggucacauagacacgaagaagcagagguaggauuugaacaaagaccugucugauuauaaagucugagucuugugucuuaggcaucuguucucaauggugaccucuaggguucugugauacaaaucagaggagccaaaaagaacaugaacguugcuucagcaauaaacacauaguagagaggaaagagagaaagugauagaaagguugaaauaguuaagaaaauaacauuagaacagaugcaaaugauaauagaauagacagaaaauaacacuaaaaugaauagggaagaaaacacuaacauuuugaagcauuaugaaaaaaaauaaagcaagacucaaaaagagaaagaauaucugaaauuucaaaaugcuuauauaaacaaaauaagggaccacacaggagacauuucuagaagcauguugugaagauaagcccugcaaauacccagaacuggaaaccuaucugucuaaaugucaugcuuuaguuagaugcuugauaaauuguccucaaauaauaacacucuaacauuccucaagugggguuuggcugggaaaagaaagauacacaaaugcaaaugagagaugggugcuuuuucguggcucuugaacagcucaggauuucaaaccagguaagggcugaauucuaaaugggauguccuaacccucucauuuuucauguuccuggagaaauuggacuuuuuuuuuugcuaauuccagcucucuagaauaacaguuugaguuguuuugauuuuuuuccuuuuuuucuccaaaacuuagagaaaaaaaugaaacaaucacaagaaauuugacuuuauaaaggcaaacgacaaauaaauggaccauaagccugagagaaugagacuuucuugaguauucacaguuccaauuccacaacauuuaguuaacauugugcuagugccaggucacgugcuggcucuggggauccaaagucaaagaagacaugagagaugccuucuagaaacucauauuuauuaggggagacaguugagcaguugacuuaugaaaauacaggccucuccaugucuaguaaacuuacuccacugauugaaggaauaaaagaggcaaagagaacaaaugaacaguaacaggagaguucagcuauuguaaguuuaaggaagacacaaggaagaauaagagucaauugggcagcaaauuguaggagccgcagaggacagcccccuugcaugcucuaagugauacaaagaggaagcuauaccagaggaucaauucucaauuuucugcagcccugcauagagaauaugagugaaggugaaagggaacagaaguaccuuggugccagcgaguacauuuaauuauauuugagcuagauuuuugugcagacuuggaagacaggcuuguuggucagugugaaucaaguaccaagaaaaaauaaaagacaaggaauuuuaggcaagcaaauuuuagagguggccaaggggcaaaugauucaauuacacccauucauucagcaaauauuuacugagcauuuaaguaaauaggagacccuguucugggacaguaagacuugagccuugaccucaagcaacucacuuucucagacaaagauguaaauaauugaucgugauacaaugcaaacaaaauguuuuaauagagguauuuauaaacaggcaggggaaggaaggaaaaaucagcagcacuuugugccucacagaaugugggagugagagagauggagaggggaugucaagagaacuaugaguguccauuaauaaauauaacuaguauuaauuagugugcuaauuaaugaaaucaacacuagacacgcagcuaccuaaacguucaacucacuacaccuccaccuuaagucguacauuuuggagaaacuaaacagaaauucaacaacuacauuauuaucacaaugaaaaaaaaugacuuaauuucccuaggguaaagaaaugaugagucugaacagaaaaacauguacaucagagggugggguagguuguguaagggacaauuuaaaaucgccaaguucuaaaauagcauaggaaguucaaaauaauacauggauuguaauuuucuucugaaaagcagacuauuuagcaacuaaugguugguagcaugggccauuagaaacagaauauuaucuguggauaacuuaagauauuguaaaugcccaaagugaggagguugagggagaacccaaauaagcuagacguauagaccauuauuucuagugaagaaaauuugagaaagguacacaaacaaagguaagagggcagcuaaaaauguacuuuauuuaauagccaggaaacuuuugggaugccaugcaacuucuauuauacaacugcuaauaaacuuaggcaaaggacaaaaauaguuucaguauuuucauguaugcgacagugauccaggaaucuguagugaccagaaacagaauucugcaaugggaaaccuaaugagcuuugugaucaucugagucuucaucuaaagcugaaagacuauucaagcuuugugucugauggacuccugaaacucaccacauugagaacugacaccaucuuucccuaaacaucuccuucugcguucugaauguugguaaauggcccaccacuuuguuugagcucaaauugugagauucuuccuucaaagguucagauuucucccuucccuguggcagcacauuuaaacagguauaacgcaucagagacaugccucaugaccugccuccauucauuuuccuccucaguccugccuucccuaccccuuguucauugagguccuccuauuacauaugggcaacucuugaagucuccuaccugguguuucuucuucuaagaucaauuccaguucagccagcauacauaucauuacucauauaugauuaugauaugagugugcccuauugcucaagaguaaagcucuucagucucgucucagcccaugucuccagccucacuuccagcuagcuuccaauuucuugcaaauucuacguauugcauccuuggggauccuuaaucaacgccaccagugugcuuucucuucuuuuucccuggcaaauucuuacccauccuucaaaacucagcugaaaugucacacccucugugaagauuuuucccagcaauccgaacagaacucuuugcuuuccucuaugcuuugccaauacauacacauugugauucuugcccugaucucauuauaccucauauuacauuuacaaguccuccuuaagcaaacuuggcuagaucaaugucucugaccuuaaaacauucuaaccaaagaagaaccauggcaacagugguaucuaggcugaugcuguacaccauccuuuagcagguccauccauuucugcuucuagcacuggaccuaaugcuaacaagaaucaucaguuucauuugcuccuaaaacuuuuuuguaccaguuauauuugcuacugagcucauucaauuuaauuaauauucuauaagauaaaauauagguauaaaaguguuauuucuaugaaagcuauguugaaugcuuugaaaagacuugauaaagucaaguugcuaaaaaaaaauuacuguuaaguuacauuuuggcaagaccaacuauaaaagauugagaacauaaaaaucuagaaggacucugcucuaagacuguuucacaaaugucuaaguucucauuccacuucaaagaaauggaaacuggaaguaacacacaacgcaguguaggugagugugguuuacacaagggagaaaacagggaacuucaaucaaaggaacgagauucaaauacauaggcuuuacccuguaucacaauacuggugaauacauguauuuacauuuuaaaugaaauuaaaaugcuuaaggcauuuugaaaaggauucccuaguuaggauggugauuaucaaaaaaagaaaguaagugcuggcaaggcuguggagaaacuggaacccuugugugcugcuguuuggaaugcaaaaugguacagucucacggaaaauagcauagaauuuccucaaaaaauuaaaaacagaacuaucguaugaucaagcaaucccacuacuggauauuuauccaaaagaacugaaauuaagaucuugaagagauauguacucccauguucacuacagcauuaguuacaauagccaggagguagaagcaaccuaaguguucaucaacaugugaaugagagaaaaugugguguauaacacacacacacacacacacacacacacacacacgaauauuauuuagccuuaaaaaagaaggaaaucuuguuauaugcuaaagccagucacagagggacaaauacugcacgaugccacuuccaugaggcaccuagagcagucaaacccauacagacagacaguagaauggugguugccaggggcuguggguagaaggaaguggagaguuguuguucuauggauauagaguuucagucguguaagaugaaagaguucuagagaucugcuguauaacaauguguauacaguuaacaauacuauccuauauacuuagaaauuuguuaagaggguaaauucccauguuauaugguuuuuacugcaguaauuuuuuuaggugccuuuagacaagaucaucuguuagguuccuuacaaacuucauaaacuuuaauuaucaccauaaauacuuaaugaugguacuuaagaaaauauccauuagauugaauuuguggacagccgugcuauacaggcacacaaggcauuguuccugucaaucugaaaugacaaccaagcagguaaugucagcuccacaggagcaaggguucaugcugucuuuuucgcugauguaucucaauugcuuagaagugccuggaaagguacuuaagaaaauguuuccuggauuaaacuuguggacaacuuuguuaaguccagauacauauauauuguuuuaaguuauuaaaacaguguguaacacagagcuaucaagaugauucucagacucaagaagucugcugauuuaaaaaauuguucucgguucuauccgaauuccuuuguaccuugauuuaauucccauucucaaaauaccuguuucucaagugcuguuaacacugagcagaauuugguauccagagaaacaauaaaaaccacaaaucaccaaugcaacuuuccaaguauuuccucugaagagccucaaaaauguucuuuaucuaugggcuauuccaaaagaaaauuauauucgaaacuaagcuuuagaauacaaaccauuuccauuccauagugucuaagggggaacauacgccucuaaaggcagucacauuauuuuauuuccuucuuuugauuaugccuugaaaaucuccaggccaaggacucuggcaccuccuugucuacugucaucaguggagcucucuggccuggacgcacaagauuaugauacaauggccagggggacaauggaugcuggaugacuauauauaggaauucuggacuccguugucauggaggcaaacggaaaaacaaacgccuaauccugaaaauaagguugaggccaaacuugaaggaaacacacacugaaaacuuccugucauucugaugaguaaaaacaaaaccuugaaauaugaucagggaauagauugagaaaacaaaacaaaacaaaauauuagccugcaaaaugauacaaacauggcaaaaaaugggcaagcuuucucuuuuuugagaucuaguuucccaucauacuuacauucacugaaaagguuucucaaagaccuuauuuugugugaagccucauguuuuuucuuuauauuuuugaggaauccaggcaggucugaccugaggccaaggaggauuccuggacuuuucaauucacuagaucguauacuugggaacauauucauuugucuuucuauauuuuuugucaaugacaucaccauucauucacccagucaaugaaaucagaauaaauccuugauucauuucucucuuucauuccacacauucaaugagucaaaagcucuguugguucagccuccugagaaacucuaucucugugauccacucacuagcccacugccauggcuuuuguucaggcccucgugguugcugugugaacuucuacugcaacauguuccuaacuggcauuccauuuuccaguuucuucucccccuaugauuccuuucuuuucuaaaaugcaaaugugaucaugacacucacuuucuuacagaaaaaagcccaaacucugaaccauggggcucacacucuccuucaucuuuccaggccgauccucacucccuugcccacacuguuuccaugcugugcuuaaugccagucacauacaaggcuucuaauauucacuuuuuaugccuuuucccccugcauuguuguauauucuugcaauauccuucuuauacuuuucagucugacaaacucuuacucaucuuucaaaacugaacucaguccaaaucugccaucaccacgaagauuuuccuugacccuucuagauacacauauuaaauuccccccuuagacuccccuacuacuacauaucaugcuguauuaagguuaauuuauuuuaccccuaccagacuaugaucucuuugaaauuaggccauccauccaucuauccauucauguauccaugugugcauccauccaucuaucuauaauuguuuuaagucgauguaccccagaacuuaguccaguggcuggccuaaagcaagugcucaacaaacaugcuacaaacauccaaaaaaaaaaagaguacaaacugaaaauacuguucuggaaaacccagauuuaaaaagaaaaugcaacugaccaaaugcuacucucucuuuggauacugagguuuaagagucuucccacugaaacacugaaccauguuugcugaaauaagccugggucuuuuuuaauuacacggacaauggcuucugaacauuuaagaacuugaaugcaauguaauucagaauccauggcugucucaagaaaccaaaggcauuaauuucuagucuugccccuaaaucagcuauaagccaaaacucaaaacacaugcuaucagcacaucuggaagccacuugagauuauucaguaugcagcucucuaucccucauuuuuuucacccaucaguaggcaucgauguuugugagaugcucagguguaauggguaccauguauuuaaauacaucauagcuuuuugauaaacaaucaacaccugagaccauacaaauagagcccuuugcaaucugugagaagguauucauggauuaccuucagguguuuagaacuauauuuucacuguauacacuguuuuaccuauuuuccuccauuagaaaugcacucaucccagauauguagcauacagacuauccauuuugccuaaagacuuguaguggcucagaaaagcagauauggguuuauguugcccagguaaccaaugaagaaacagaagcauaacuuggggauccugaaugcccagucccaaaaauguguguguuuguuuuuucugccacuguagcuauuccuucuucauuaaaugauauuuguaauucaaaguguguguucuuaaaaacccuccuugaaacaggcaggaaacuuguagggaaaugaauguguggugaaggauccuuuuucuaauguuuuuuggaggaaacucuggguggcaucugccauuguuaauugagaagcucucacaauaccgaaugcauaauucaccugugacucuuuugaauugugugaugaggaaguaagguuuccugcuguucguuuagaucauauagaugucuuuaccacacugaaaaaauccaacaaaaaguguugagcacaaaagccucuuuauauaaaugacuuggccucaaccguagagagcuugugagcaaccucagaugguauuuagagcucacaggccgugggcaaggccacagugcuuccuccucaagaccugacuggagggaagaugccuacugacuucaaggaguuggucacaauugauggcuugcuaugaacagugcugugagagcccggagggaacaacuguggagauuucuuaaaagauucgauaaucaagaggaaagagcacaucuggguauaagcauauauauauuuagauacacguagagcucuaagugaugcuacacggaaaucaggugagaaaggcuaugguugaucaagaacaagaaugagcagccacauuucaaagcacagagcucuucuaaaauuguccccgagcgggagucucugagccaacaaacccaguggguuucuuaacccuuuuuuucuuuuauuuucaccuauuuccaugcaguguaagaaaauccucgcucuagguuaagcuauauuuuuaaucaccguuaaagcaguagguuguucccuuaggauagcuccuccacccacuccaaacucaccccacagaaaugcugcccagugaugcuggauucagguguaggguauuaaauuuccaagaagcuggagggaucagguagugagauccagguucaccuuucacugucuuagccagcucugucuagcaucugugucagauguuuuuuguaaagucucuuguugcccuucaccaugaccuuaugagaauuauuacuucccauuauauagauggcaaaacccagcaacaacuggaaaacagacaacuuuucagcucccagaguauguugaggagccuccuucuaggucugcagcaacuuuuaacccaacacaccucuguguccucauuugucaaguggagaagauaacauuggcaacuucauagggugcucuggagauuauauaagaccaaugugugaaguccagugacuggcacauagugagugcuuccaagggccucaguuccacagcaaugaagucugcauuauaucaauucugcaccaaguaaguguuuauggaguguguucuauggauggaagcauuuggacuccuuuacuggacugcagaaucaaguggaacagggaucucugacacagcuguaaaauauguaguauucaucccagcucuaggcacauaguagcugcuuggaggcuacuuuuugacugaccaguucuggcacagccaaaugcacugcuacuuauggcagcaacuuguccagugauuuuguagggggagauggcugaguggggaggggauugauugugggacuuggauucagcucaaaggcagggcucaaccugaguaauaccacagacagaaugauucacuccuauuuuguuaguuaacaaugcacauggaauggucacaaaucaacuugcuucaaaaagucaucucagggcaaauucaauucccaaacuggacaggcuuuccuggcaaugauucuggggucuauuuccuuuucaauauucuucaagauuaccugcagcuuugagcaagguucuuggcauccaauugauaggcuuggccucaaucauuccugucaucaaugaugcccuccccaaccaccuuaccugacacuccaacucccauccuuucuacccuucaccauggcuuucuuucucuugauagcacuucuugccacgucaucuacaguggauguauugguugacugucugguucucccugcuacccacgaggaauguuaucgcgaauuucuuagugugcauggauguuuggauuuuauuucaugauugauaagggcaucucagcuuccuuaggaacuucuggcacagcuaaguauggguuacucuuuagggguguuugcuuacuacucauuuugagaaaucuuaggcucugugcugagaggugcuuucuucccacuauagaucuacaaaauaauuugaagagaaaauaaguggagaaagggauuccaggaagaaggaauagcaagggcuaaagugugagauaguaggacccuuuuaaagacaggguauucaguguagcuacagugcaagggaagaaguggugaggaaugaucccagugagaaaugcagggcccaaugaacagcuuuccaugcuaagcucagaauuuauucugaaggcaacguagacagccacggaagggcuuuaagcagggagcaggugagauaguggccucccaguuuuaccuuuacugugucuguaaauuguacccacaguccugaccucucagaugggaaaggaggcuugguagaaaugcauucccacugugagaaaaaccaacuggcagcacauucccuagugaugauggaauaucaucagcaccccacgauuccacauuuuguuuuguuaaguagaaaacaccaucuuuucuucucgggauuuuacuagcagguuagaauuguucaucugaacuguucaucuaacuguuucuauugaacucaguacauucacaucucaaauggacuauggcucuaccuaugggaaggaaagaaaggaacuuaguaggcuaccuucucugcucccuaccaacccuucaugugcaaaaauuaauaauaauguagaacaggugaccaagugcuuuauccaugugcugcaaaccacaguguguaaucaucagccacccuuugcucuauuuccugaauacacacucucagcaacauccaaaauauuucuagaucugcauuuuacucuuaguuuuaacauccauuugucaacucagacgcuuaauacauauuucuuagauucauuuagacaacacugugaucaaaauauuauuuugcaaagugaugcaauauucuucuggaugucuuagcuuuuuauaaaugguuggauuacucaugauauauauuauauguacuauacaggcauaugcuuuauugcacuacaaaauauuacauuuuuuccaaguugaagguuuaacuugaauaagucuauugacaccauuuuuccagcaacagguacucauuuccuguguccgugucaugcaauauucuguaauauuucaaauguuauuauaauuucuguuacggugaugugugaucuuugauguuaauauuuuaacuguuuuguggugucaugaaccaugccuauguaagaugcaaacuuaaucaauaaauguguguguucugacugcucuaccgaccagccauuucccccaucugcuucccucuccuuggaccucccuauucccugagccacgacaauauugaaauuaggccaaugacuaacccuaguagaauggccucuaaguguucaagugaaagaaaaagucacacgucucucgccuuaaaucaaaagcuaggaaugauuaagcuuagugaggaaggcaugcugaaagcugagacacgaugaaaaccaggccucuugugccaaacaguuagucaaguugugaaugcaaaggaaaaguucuugaggaaaauuaaaagugcuacuccagugaacacaugaauaauaagaaaacaaaacauccuuauugcugauuauggagaaaguuguaguagccuggauagaagaucaaaucagccacgacauucucuuaagccaaagccuaauccaaagcaaggcccucauuaucuucaauucuaugaaggcuaagagaggugacagagcuggagaagaaaugucugaagcuagcagagguugguuuauaagguuucagaaaagaagcugucuucaaagcagaaaagugcaaggugaagcagcaagugcugacguagaagcugcagcagauuauccagaagauauagcuaagagaagggaugaagcuggcuccacuaagcaacagauuuucaauguaggccccacagacuuuuauuggaagaagauuccaucuaggacuuucacagcuaaggggaaguuaauaacuggcuucaaagcuccgaaggacaggcugacacucuugguacagacuaaugcagcuggugacuuuauguugacagcagugcuuuucccauucaaaaaauccuuuaaaauuaugcuaauuguacucugugcucuauaaauggaacaacaaagccuggaugauagcacaucuguuuacagcaugguuuacuaaauauuugaagcucacuguugggacuuacaacucagauaaaaaagauuccuuucaaaauguuacuacucauuggcaaugaacuucaucacccuagagcucugaugaagauauacaaggagauuaauguuguuuucaugccugcuaacacaauauccacucuguagcccauggaucaaggaguaauuuccauuucaagaguuacuauuuaagaaauacagguaauaaggauucaguugccauagauagugauucuuccgaugaauucuucugacuuaggcaaaguaaaauaaaacacuuuucgaaaggaaucaccauucuagaugacauuaagaacaucugugauucaugggaggacgucaaaauaucaacauuagcaggagugucgaagaaguugauuccaacucucauggaugacuuugagggguuuaagacuguggugaaggaaguaacugcaggugugguacaaacaccaagagaaccagaauuagaaguagagccuggagaggugacugauucucaugauaaaaucucaugauaaaacuugcaaagauaaggaguugcuuuuuauagaggaacaaagaaagugguuucuugaggugaagacuacuuuugaugaagauguugcgaacacuguugaaaugacaacaaaggauuuagcauauuucauaaacuuagcugauaaaguaguggcaggguuugagaauauugacucuaauuuugaaggaaguucuacuguggguaaaaugcuaucaaauagcacugcaacagcacugcaugcugcagauaaaacuuuugugaaaggaagagucaaucaauguggcaaacuucauuguuguuuuacuuuaagaaacugacacagcuacucccaauccucagcaaccaccacccugaucagucagcagccaccaacaucaaggcaaacauccuucauuagcaaagagauuaugagucacugaaagcucagauaaucauuagcauuuuuuagcaauaaaucauuuuuuaauuaagauauguacauuuuuuagacauaaugcuauuguauacuuaguaaacuacaguauaguguaaacaugacuuuuauguguacugggaaaccaaaagauuuguaugacuuuuauauugcaauauuugcuuuacugagguggucuggaaccaaacccgcaacaucuccaagguauuccuguauguuagauaccugauagauacaaagauaaucagaucucauauuucaagagcucucagguuguuaggggagauuacagcaacacacacuaagaugagugagugcucaaacaaucaaacaaaugcccaugaguccauuaucuguuguuaguagcguggccagaagacaguggggcucuggagucagaaaagcauucaaaucuugauuuacuacuuuacuaccaugacuauuuacaggacacaacaaauuuucauuuuacauuuacaggacaucuacucuaggaaggaagcagccuuauauucauuguucagaauaaaaaaauaacaaaaacccugcuccuaaagagcucccuccugguaauauuauggagucaguagacugaacuacauguucuuaagagagguagggcacagcauugagggauuucagaggaagaguugacucacaucucgggagaucacuguugcaucacagaaaugaaggaauuugcaaguggcuuugaaagacagguaguaccugggcauguggagaugaaggaaaggggacauaacaugaacaaaggcaaaaggaugaggagagagaugcucauuccaguuaggcuagaauauagggagaaugaggcagcugauggaaagagaaaaggcuggguauaaacauggagaauauugacugaguuuuuuuuuuuuuuccucuuuuaaacaggcugauaugguuugguucuguguccccacccaaaucucaucucuaauuguaauccccacgugucaaggaagggaccuugugggaggugacuggaucauggggacaguuuccuccaugcuauucuugugacaguaagugaguuaucacaagaucugaugguuuagaaguauggcacaucccccccucacucucuuucucucuccugccaccauauaagaugugccuugcucccccuuugccuuccaccuugauuauaaguuuccugaggccucccuagccauguagaaccgugagucaauuaaaccucuuuucuuuauaaauuacgcagucucagguaguucuuuauagcaaugugaaaacggacuaauacacaggccaugcagagcuguuaaagacuucugaauaggaggaugauuugaacucuuaaccuugcuuagaauagaaugaauggaggacuuugcaggugggauaaacaugguaauuaauggcuuagguaagagaugaggaugggaaggagggagauggaugugagaagaauuaaggcaauauaaacaucaggacuaagcagacaacaaaugacugguugauggaacguggguccaacaagaccuggaguggcagaggauauuagcuaggucccaagggcucuggcaaagggacaaguuuaguaggaaauuaaugaguuccauuuuagaaccuuugaaaugaagguugaaugagacccgcagguggagaagguagggagcaguuagaacagagggucucagacuuaacaugagagguuagcacuggaaguauugguggcaucagaagagggcaaguugacuucauauaucuguaaagagagagagagagugcaaagagaacugaggacgagaaccaaguacauguaaggggagcaggagaaacauggcaaaaacaagguaaagggaaggcaugaucagagaggcuggaggagagccugaaacacauagcaagaccaaaaccaagggaagagaauuuccccaggaggaaggucagcaguuuuaaaugccacagacaaaaaaagaaggaugaggcaagagcagaggccgugaccuuguuugucugaagucacugaugauccuugugaaagcuauuucauuauagucauagggaucaaggucaugcugcaaggaauuccagagagagggagggggagccaaggaggcagcagguguaaacagcaagaaggaaugacuccuucccagagaaaaugccacugcaguuagcccguauuagaucacuucaugaaagugguuucaauaaaaugcugaaggcagaacacugagucuagcaguuuacgaaaagcaaagagugaguggugagaaaguagaaguugggauuauugguuuuuuccuuccaagagauuuggaagauaagaucgcagaaggucacauccaagaaugguuuuaauauuucaaacacagagcacuuuccugggguucauguauaaccuuuuuaagauuugccuggggaaaaacaguacaucuaagaacugaggcuuagggaagcaguggcacaguaaacagacuuuggagucaggcugaugugcccccuaaccucaacucugcuggauuuaacuaugacccagggcacaccacuuaacuugcuuaagccuauuuuccuccuuccuaaacagcaaggagcuagucauggagguuccugucucaugggauuguuguauggcuuaaauaaaaugaaacaauguuuacaaaguacucaaucaguagauaugcaauaagugauaguuaucauuaauuaaaaaugaucaucgauuaaugucaguaauaauuauaguaaugaugucuaacacugggacucaucaaugcauuccacuagcccauuagaguaucaagugcuaaggaguuucuuauuugggugguuccaaccaagcccugaaguucagauaaauuuauaucaacaaggcuccagauuaagcaccaccuuccaaacacugaacugucuuaggcuuccaagaaagcucaugauguaaggaaacuucauucagcuugaggcuagaugugaaauuuuuuccuuuuuuacuuaaacccauucuaugguugauuaaaaaggaucauaaauugaaaacaaauuugcuucuacuauaguauuuuaauaauagcuacuauuucuacaguaauuuagaauaugaaaguacuuccauuguguuaucucauuugauccuugaaauaaccccauaaagucggcaucauuauuuugcauauuagaaacuccaaggcucagagaggguaaaugcuuuaacuaaggacaugcaugugugauagggagcuagacaggaccucuaccuaaggcuguacauuucauuaacaacaaugugaaugguacuuccuggacuugagccugcagcagcuuucaagccaaaucucaaacucaugguuccagcaucucccgugugaucuguacaccauuaaguaaagaugaucuauacggagaaguggguucaaaaagaucauuugccccuaauguucacuagcuccaguugggugaaaacaaucccuccugguaugugcucaaucaaaaugagcccagcaauacaccgaaagagucacacuugaugccgcuacagcaccgcgacuccaaaauuccacuggaaaaaaaaaaaaaaacacaacacuguuaugacuuggagaagagguuccauggaacaucuggaugcuuccccagggugagagugccggauuggggcugaggcaagcaagaaggccugggguggaacuuggacaggcuuaugguacccucaaauguugcagauccguugcugucaacaacccuccuuccccuuuuggauacaggaagcccaggagcacagugaaagcugcucugccugggcuagugcugugcggcugggcugcucucaguacuuuauuaacaguggcuuuauauggccagucccaguagagucaccucuguucauugggauuaugauaauuaauauaaaaacaaccaccaacgugugcagcacaguauaguuuugaaagcuucuuucuuacccuuguuuuuugcuuucucucaauuuggaaaaagauaauaaauaaauaaauaaaucuuaaaccuacacuugcacagaauuacuucuccgaccucaaguucuccaacucuuauucugcucuuggcaacacauaguggaugauaucuauuuacucaacguucucuccuaggcaugccgugauuuagaaaauaccccaaaaaaucagaagagaaagaaguacagugaaaaguacuauguaccuuuuuguuaaguuauagggguagaggcacauaauaaugaagcuauucaaaaaguaacuaaaaagcuuucauuuuaaaacagaaaaagcaaaucuuaucaauauuuuacuuaaaccuugaacuuaaauuuuuuuuuuuuugagauggaguuucacucuguugcccaggcuggagugcaguggugugaucucggcucacugcaaccucugucuccuggguucaagcaauucucccaccucagccuccggaguggcuggaauuacaggcgcucgccaccaagccuggcuaauuuuuguauuuuuaguagagaugggguuucacuauguuggccaggcuggucuugaacuccugacuucaggcaauccgccugccuuggccucccaaagugcugagauuacaggugcgagccaccacgccuggccugaacuuaauuuuuuaaagaguuauuguuuuccagacuuccguuauggagauaacauagcuaagaugcaacaguauacuguaaccauauuagcaaaaaugaucuuauuuuauuguccacagaacaacacacagaacugaucaauuuuaaugugcuaauagggaacugcacuuacacuucacugucugccugugguuuaguuaugacaauuauuauguuucuucuaauagacauauugauggcauuacucuugcuuacaugcaagguagaugugaauuuccucaucuuuccuucucuguaucccuaauuaaaaacuuacccaugggcaaaauuuuaaaauacuauaaaaucagaguaacaauaaaaucacaacucacaaggacaauaauuugugauugccacagcuacuaaccacacagcugcucacuccauuuaguuugggacaaguaagauagacugcagcuauuugcaacuucuagcacauugguuguggcucuauuccugucucuuucacuuaagaaaauaccuugaaauacuuagguguaaacugacauuacauagggauaagucugacucagcucaaauuuauuuugaaaaguaaauuugauuugugauuaacaaagauauccuggaaaacagauuggaaaagauggagguuagaaucagaaagacuggcuaacaucagaggaagggcaggagugaagguuauucaggguuggagucugguaaguuggaaaccagaggacgaggggacgagagaaaccaggaugcuggagaaagccccuuugaaacggcuaacccucuggucaggucuagguuggauggggaaggagauccacccacaguggucagaguaaaggcaaauuugaggugcuggagacggagcuguuauggugaauuuggccacaggugggcagcuggaggacagucaggaaggagacaaauuucccuagcuuaggcgacugaagugucuguugaguuauuaccauugagucuagucuauuguaauuccagagcaugaagauuacauuuggauuggaaagcaaggcugugagccagucacugaguucauagaggaagacaaaagaauacuccaaaagagaggaagaaaauaagcaggaagcaggcauuugaaaaaggaucauuaaacaaaggaaguagaaguacucugaagagguggcagaaaguaaggaagguacccacuugucuccguggcugcuuggaaaaaaaggaauuaguugcuucauuugcagaaaguugaaagggcuaugguguugccacuggggugggaggaagggagaaguuaguuaacucaaggacaagggaaugaugcaugaaaagugcaguaacaugggauggcacaucuugcuauacacacagccagauuccauuggcuuuuuccagauucccaggcuuguucacacauaaauuguucucuuggcuuuccuugugugcgguugcuuuugcuguccuaauucaaaacaauuuaagaaauaucuauugaauggccuacccagugcuagggcucuagaaaugaauaggaaauggucccugaccucggagagcacacaguuuagcuggagacacagguaagguagcuaauaauuauaagaauauuuggcaaguccaggaauggaaauaaaugccaagggucaucagcuacccaacuuauuuuguauuuauccuuucacaaagucuuauuucuagcccauuacucugaacagucuaggcagucuguaaucuugauuuuugucuuuuaagaacuguucaccaauacuguaaauguauuaagucucaaguaaguaguggggaaacagacucuacuugaguaauuuuugaggaggugagugagccuuaagauaaaauuaaugaauuuuugauuggcaaaaucucaaaggccuucuauaacucugagaaucccaccuuaaauauaauauacauauaauuuauuauacauaaaaauauauuugaaaccuuuaaguacucaauauuuauuauuugaaaaggaauuauuuuugcgauaugaauccuuauauuucaaagcuauaguaagucauguggugauggaaccuauauagugagagcaaaaacacaugaaagaaaaauaguuuguguaguacgguucaguuuugaagaaaaaaaaaaaacuaaacuaaaugacaaccuauguuuguauacucauagaacaaauaucuagaugacuucaacaaacugugaauagagauuauucuggguagggagaggcuggcaugaugggugacccuuacauuuuauuauguauugccauaaagcuguucguuagucacgaguugguauuacuuuugucaucagaagguaaaaauucuaugcagccaucucaaaagaaggugacuacuacccaugacugauuucauugcacauuccuuguugaagaccuauugaugcuagcugaaugcacuuauagcucaaauguacccuggcacuuccagagaggaaggaaucuugcugcuagucuuccccauugagucuguuucuuaauaaauccaaaguccucuucccaguguuaaguacuccugucgucuggcucuaccucuccuuccuucacuaauuacccuuccacuaaccucaccacacauccuuugcuccagccacacuggauuuuugcagucccaggauccuuucuccuguaucucugcucaugucugauacuccuuccauccaccugcauacauccacucacccuucaaguccagcuugaguacugccucuuccaugaagcccuacaugacucaauuccuucuccuauccaaaguuauagccauucaaaugcagauauacaauuucucacuuuauucuauucuggucuuuuaacuuaauauuaucuguacaucuguuaacuuaagcuccaaauaucaauaaguaauaaacacuugucuuucauuuccuguagaagauuccagagcccacagacauauaagcagccaaggcuucaccacucuggaucauuucuuggguauguguuuuugcuacuagaccccacugaggcacaaaguucaagggcacaggcucuggaauuggacaaaccugugaaugaaacagcucuaccacguacaugcuuugugaugucugacucaccauuucacuccucgugcccuucucuuucaaaugagauuaaucauuuauaccuccaaugcauuagacauauuaaagcagaugacauauuuaaggcaauugguagaauuuuaaaaaauaagaauuauuuuucaucacuugggaauugaacaaagagacaugcagaaccguuauguaaaccagaauggaugacuuucaaacuggccaaaggggaaaaaaauaacuagcagugcuaaaaaucaacacauagguuaagaguuuagaagguccugcaucucuucgauguggcuaucauagcagcucugguggaggacucacagugcaucaaaauaaaagaugacauaagagagugagugaccugugcgagucaucuaagaauguuuuguguccccauggaagcugaagaaccuagccuuggaaugacuucuccacaagcagugugcugggaaaugaaacuuuagcugggcccuaaauucucagccaaacacuuccuuuggguugaacuugacgacucggaaacuguuugcaaaguggaagagccccaauggcaggaacauaucauuuccugagccuaaacagaaacggacugaauccagcagagagcaagcagauucucccagcuguauacuugccccucaugucacuuuuggccauuugcuauuucaccauuuuuguuuaaucaccaccacugggauuuuucuguugguuguuauuuacgguuaacaaaacauguuaacaaaaauauguguacaacauuuggacaugcuuuccugggacauacaaucagaauguauguaauuuauuuuuucaaaaaaauaauuguagcuaaaaaguuauuucuggcaucuuauucucaccucccacuuuuauuuuauuuuauuuuuauauuuuuguagagaugggaucuugcuauguugcccacgcuggucuugaacuccuggccucaagagauccucuugccucagccucccaaaguguugggauuacaggcacgagccacaacaccggggcucuucacacuuuuaaaaaaauuauuuuuuuacauacccaucuuuccgaggacauacccucgacucuagcaaggcuguugcaggauuucuaccucuaaaucauggcucacucuugugacuucucccaacucaaauacccuuccuucugccuauguaaaauccucucacacagaacagaaagacuggagagaccuaugagucauaagaagucucaagacaguuugagggauuuuuaucucaaguaaaauugggcuaaaauacuagcuucagcuccagggacagaaaauuugaagugggcaaugagaagacaaggaaaaauucuuucuuuuaaaaaauaacugagauuaauugcuuuagaugauucagcuaaugacugacauauuuuucugcuaaagaauaaaguagauuucuucucuuuuagauacuuuccacaaaugaggucuggaagacuugaaguaaucuccaagcaguucacccagagauuugaaagucagauguggaauuaugaagcaaacuccaguguugcugggaacuaguucugaauaaguuuaguaguauaugguuacauuucugaugaacaauguuuuuguuggcaugggaacagggagaugaauuaguugacuaaguucccaggacauggaaagccuauacuugaaauguuuucaucucuggcacaaaggaugauagcagccacaaaacuauggcuaauucaaagucacagaaaucccaggcagguugguaucuugggaagcguguaucacgugaccuuugaguucagaguggugauaauauuggaggguugcucuuugccacugaggcagagucuuaacauuuaaucccuguagauuuccagguaauaacagaagauucggggucuucaaugccacuuugcuccacugaaguugcagaccucuuaagucuuuacaguagaaauauagaaacauaguaaguguuaaaaugaacuuuaggccacauuuugauggagaaauucugaugucaaaaagagaagguuaguuaguaucuggucagauaauuuugagaccagcagaaccuauuaaaaauuauagucaagccauuaaaauuaugucuuacaucgcaugugcuauaaacgauguaaauuuuuguauuuuacaauuaauuauucacuugggagucuccauuucaugauugucguuuuuaaagaaaccaccucauuuuuucuuuuaaucugauugcaauuggaaccuguguggaagggcugaugcccuagcaacuaacuggauccucuuaaaggcugaauuuuaugucugaccuauuuagauaucugaaaagcuucucuucaaaaauaaagcaucccagaucuuaauuuuuuaguugucaagcauugcugcagccaagguuaaaugaguugauagacucaacauaauucuuagagaaggguuuccuuuuaagcuuaaauguaauucaugcacaaauauuuuuaaaacuucaucugauaccuuacauuucauauaugaaucuaauaauauauuuaggucaaguuacauuuuuaagugacaucuaggaguauuccauauguuaaauauaaaggcucagaaugacauuuauuaaagacuggauuaaucucauggguauugcuguaauuauuccccccaaucaucucaucuauggcauggguuagugaaguaucauucaugggccuuuccuuuguuuuuguacauaaaguuuuauuggaacacagccaugucguuuguuuacauauugucuauggcuacuuucacguuacaauggcagaauuaaguaguugugacagagacugcauaaccuacagugcugaaaauauuuucugucuggcccuuuuuauagaaaaaaauugccaauaagccggcacagaaagacaaauacuguacauucuuauguccuauguagaagcuagaaaaguugaucucauagaaguagcaaguagaauagugauuacuagagacugggaagggcauuagggugguaaauagauacacaauuauagcuggauaggagaaacaaguucuagaauuuuacagcaucuuaagauaacuagaauaaacaacaacugauuguauauuuacuaacaguuuaaagagcagacuuugaauguuuccaacacaaagaaaugauaaauguuugaggugauggaaaugcuagugacccuaauuuaaucauuacacaucauaugcauguaucaaauuaucacacuguaugcuacaaauguguaauuauuaugugucaauuuaaauuuuuuuaaaggaaaaaguuugccaaucucuaauguuuagaaaaacugagucucaccaaaugagucucuucuucuaaccaauauauuguuuuaaaagucugaugggaaaaguuuucagguagaauagaaagcucuacucauugacaaguuuuguuggucaguuuaucgcuauaucaucuuugaaucugaauuuaacugcaaccaaacacuguauauugacagagacacagagaacaaauuagcccacucuaagaucaauaauugugcgcacuugcuccaagaagcaacucugcuaacagcugaccauacuagaaauguucauuucuccagcuccaucauacuuucuauaucauucugagggacagaaggguuuauacccugucucaaccuucagcuucccaccuauacaggaggucucaucaugcagggaacaaugacaauauuuaaaacgcucuuugucaaggaagauuuuuuuaucuuggcagaguaauugugucagagaauuaauguuagagcauucccuaagguuucaucuucagauugucuuuugaucugccucuuaaauggaaaugaaauaaacucagccuguguaauuugguuaguggaguuaaaauguauuugaggacccaguacaauuaacagaacugaaaacugaugccuccaagauaccacugguccaugaaaagaauaaguauuuaauaaguacuuaccuaacuguccauauuggaaaauuaggggacagaaaaaaauagcauaucugcaaguacuaauacagcaccaggaagaguaauaagaguaguuuggggccagugaaaaucaauccuuaaaggaagugaaagucauggacuaguagagagaagcagacaggaaagaaauccaccuaaccucccagcagagcuuacugaaagugaguagaaguacaaaggaagacauuaaaugcuuaggguaguaaguagagagaugguaggaaugucaguauuugcuagugaagccacugugcaauggagaaagcaugacuaaauggugaacuuuggaugcaaugcugaagacuuugauaugacagacaauaaguacaugugguuccuugaugagaaaugucuugauaaaaauaguguuugucaaauauuauucuagaguuuagagcagaaaaaccaauugaaauuuauuuaaaaaucgguacaaaaggaaauugccaagcuccuugcaacauuuuucuauuaauucacaauaucacagacuucucuuuugggaggacuauaucaaguucuauauuauaaauggagggguaucacaaccaaguguucuuucuguuuucucuggguugcuaacuaaggcaccagcaaacacacacacacacacacacacacacacacacacgcgcgcgcaaaacaaaacuauguuaccaucauucaccuuauucauuuugcaccuggucugauuuuuguuuuuguccuaaaugcaucauaguaacuauuuucuaaagcaggcaauuccauagcauaacugcauagauagaugaaacaaaauaacuuauuaguccccgggagaaacuagagggaggaaaaagauggaaugucaccacuggcuugacuucuuauaaaacacauaguugaauuuuaaguuacguauccauugcccauguccuguguagcuucucagaccuaaaacaaaucucauagcuaaacuacgcuguccuaguuucuuuguuauuuuacagcugugccuauauguguauuuuucuguacugaaagcagagacuuggaaauagccggauaaaagcuaguccuguguuguauauggcaggagaaggaacacaguaaacacaaacacagcagagcauuucccuuuguugacaaccuuauuguuuccucuuaaugcauuguuuagaauagcaauuacaugucauugcccauuaucuuauacacaaaaccaauaccauagagccguugcuuuucuuuccaacaacugaucaucaugaauauauagaggauucgugugcuggugaaacaugucaacacugacagcucagagcccaagagcagggcugaagcacagaacagguguguggccaggcagcuggagugaaaucuccccucuaccuucucauuuuugcuuucuccacuuuccucccuccucuggguugggagggagagcagcuuagaaagaaccucccuuuucaggcuguuucccucugccagagaagacuggcucacucucaagacggcaagcauuugaccacugcaaauaacaggagcaugucaacuuguuuuauucacaucccucacuacggaaucagaaagccaaagacacacuggugauuucccugguuuuauggaucuugacuccccccaggccugcaacacauuuuugguugguguguucacauuguccuggcaucugcagugugggaaaccuuaacugugagccaauagccccacagcuucucucuauuaaaaugugcaauuggauuucacaugaguguuucaaacaccauucaaggccuaauuuacaggcuacuaucuagccccacagcuguuuuuccauccuguagacuuagcuguuucuaggaauccaccauccggcuccuuagcaaagucuucccacuuugggccugcccagccacucuuggccaugcaaaacuauacaaaaucuauaguaaggauucaagaaaauacuuacugaaugaacaauuauuaacuacucuuuccacagaauuauucauucaugugaauagccuucuuuuuguuuaccucaucuaaucagcuuuuaugucaucaaauuaaucacugcugauccauugauauaggucauuuauauacauuaaaaacaguacaggcccaaugacuuuuguguacggaucacuaaauaguuaccacacagagcuuucaguuacuguguucugucauaaggauaaaaguaagaaucccuuuuauauauugcaaauuauuucccuguggcuaaacaaaaacagaauaucuauguuauagagagagcuacucaacgucacuuugucauauuucugugacacccacuccuccccacaguccauccuccaagaaucugaaaucacuccacaaauagauuaggccugaggcuuaggguuaugguuagcucaaauguaagcgcuaauaguaucaucuaaacaguugauuuuaaguugucggagggccagaaaaauacuauacucauuucugauucuuccgugcauaguacagcccucagaagagaguacaggcucaagaguauaacugaacucaacucuucucagucuaugcagaggaugaugauacaugcaguggguggguuuaaaggauucccuugaccucugacugagacccaccuuucaaggaagacagacaaaggaaaaagaagguaugacauugagaaaaaugucccagcaaaagccuuugcuagcaauggcacugagaugaaucuguuucauccaaacagcuccacaaauguagcuuccaugucagaugaaaacaauuaauuaaaaaucacauuaauacagauccuacaauuugagucaaguuagauuuugcccuucugguugcaauauaccaaccuuuccuggugaauagaagauuucaggugaaaaggggacauuuucuuuacccuuccacagguacucucacccagcccuagaugugugacucugaauuuucccagaagagaaaaaaaaaacacuacaggcuuccuuccccauuuuaaacuacuacacaguagcuaaggagauuguguggucacuucauuacaagucguagccaucauaacaagccuucuuuguuaaacagaaguccuuuaaggccgggacaccaguaaggagcuauaguguugaacacuauaaaugauuugcaaaggaaagaccaccaagcuucaaaaauuuuuuaaaaagcagcuuuucaucuuaggacuuaccauuucauuuccuccuacaggugucugcucacagaccucaugaauaaagauuacucauuuacucuuuugguaaucugagaauuagaccauguugacaaguugggcugucagaucaucagguuaucugaagagucucuuguuuuaaacacacacauuaaaaauaaccaaaauucguacuuguuauaaauggucccaaaggccagaauugcaaccaaaggaugaaaaguacagaaauaaaacggccuuuuauuaaauuccuacuaugugucagaggcuguauuagguauuuuacaggugcguaucuuuucucauuaaucucugaagauaaucaguugaggcagauaucacuauacaauuuuacauacggcuacaagaagcuaagauugcccagggaaacgugaccaucaucgagagaagugagauucaaacccaagcuuuuguucugcuuucuuuccaguccacuaagcuccucccaagaauguaacaguagaucuugggagacagucauuccuugaccugggaaguacucaagcugaugguagcuaacuggcucccgcagaagggauucaagaauuagaagggguuggaagagagcaggucuaccucgaagaaucugcagacuuccucuccuucucuucuaagcagcugauucugcaaucauuugaggugagaugagaaaucaagcaggucugcuuccuggucuuauaaaaacaauaaacuaucccuuugcuuacuaugccauaucugcaggcccuaaggucuggacucuuucucuccccuacagcuuuggucacauugcuagcgaggagacccucucccuggcuuccuguauuucuucugaaacuccaaaacuaaacaguaaaacucuccucccaacucaugccuccuuagcauccuuuagcuguaagaaaucccuaugucaccccuaagguaucacguggcucagucagacacacuuccccacucauucacccuuugcacuccuacucugaauuuugugucauuaauguacauaccugucuccccaaacauuucgcagcacauauuuuuagaacaagacaggauauaaauaaaaacaaacaaauuggccugguacuguauucgcuuucuugcuugaaaccacaguggaacgauccaaaacuaauccaucccacuugacaggcucuuuccacuagcaacacucccaugagcacugaauuccauuuucaucauggcgucacacagaugcucaacaaguucauuuccccuucccacuccaacuuccacaccauuucaacuuuuucauauuucuuccuucacuugaaccaucauguuuucacauaagauuuuccucuaaaaaaaaugauuggcaaugaaucccagcccaccucaacccugagugguuaauuccagcuuggaagcccauuuuuaccauuggagucuuccacuucuucagccgggguagcuuuuugggaggaguggugggagugugaggagaggagacugacgauccguggccuggggagggucagggcuuuuccguggaccuugagggaguguuccuucagcuggcugauugucaugguggagaaugagcaccaagaacacuuguaggcaugcucaccuggaagaggauggugacaagaaauagaacaggaaaaagaggggagaaggguauaaggccaggguggaaacaagauaacucaguuaacucaugcuagagaagcgcaucucaagcuucauguucuaugaacgaaccucacagaccaacaaccugccacaaccacaguacuccuuuggaguugaaacucuuccaugagcuccagaaucuagugaacugguccuuuuucauuuugggcucugcuuacaggagugaagcuaugaauuaauuccccaauaggaagucaaacccaacugcccaugauaccuccuuuagaaaaauuuccaaucccuuucccucccucucuacacuagaaaugaccaugucagguuucauucaagguggccuuuuugucagucccagaaaauaacaugcuuaauuauuauuccaaagaucuauuaguggcuuuuuaaucacaaagucauucagugcaagcucuguugugcuauucuauucuguacuuccuugcuaacuauacacauucucaucccacauauauauauuuuuggaccaguucauaaaccucagcauagaacuccauuuccuuaucuagucaauagcacagaaauggguaaaaauaagucauuucucuaaggaagagagcuguauauguaaacauggggguuuaggggguacaguguguguguuuaucuccaauauucuucaauaaagacugccucucaguaaaaauaagcacuacuuuuaaaauuaauuuuaugccacugaaauacaacacagaucaccaugaccaaauuaaguuaaagugugauuuaccuucgccauauauuaccuguuaaauuaauuacauuuuaagaacuaagagugugaagugggcaggcuuaaauuguuggacauauauacacugguaagaucaauucagaaagccauuuugcuuuuaagaacaauagacuuagaaaugcucauguuuccaacccaguaacuccauuucaaagaguaauaagaagauauccuuuaauaaauauaaaguuuuacuuagaaauauacaucauuuaugcuugaaaaagguaugaaauaaccuaaauuuacaaccauaaggaaaagauuaaguaaaucugggcauauccuauugaugauuuauuuuauucaauuaaaauaaauucuuggaguuuauaauaacauaaaaauaaaaguaaauacaaaggcuaaauauauauauucaauugcauuagaauuacaacuauuaaaaauaauuacagagaaaaugacugaaaggaaauauaugaaauguuaacaacaguggcguuuagauaacaagauuaugaaugacuguauuucuucuuucauuuccaaacuuucucuaaugaacauguauuuuuaaaauuaauuuuuaaggugacauuuaaaacucagagaagaaaaaagagaaaacagaaucauaaaguuuuguggaccagugaaaaugaacagagguguggucuaaggauuaaaaguaagaaaaacagguauuggaagaucauucuuugucccuacauuuccgagauuauuauuuuccugccaccaugaaaauuacuaaauggguucacaugugaagugaguauagcauccaaguucuguaauuaagccuuccucucaccacggaugaauauauauaugacaauauauagaauacuacugcccucuuuauucuauuuuuucauuuuuuucuuuuaaugcaagcuugguugugugaauauugcugguggcugugaguugcacgaccugagagagaauucaaauccagauguuuggguuagcacacauuaccuuuucuucuuuaaaauaaaauaaaauaaucuaucuagaaaagacaagaugagucaagagucuuucagaaaagguacuggcuuuuuccaagccaagccccacucagucacucaaagcaaugucauggaggccaagguuccaagguaugucaagaacugaauuacacugcucccaaucucucuuacuggaugcucucuuccugccagccagugaguacagggaggccaguuuuuugggucaguuccaagagcagacacuucagcuuaauacgcuggcaucagugugcaggcucugaugcucucuucaagucuuucccacaggccgaaucaucucuucccagcucucgcugguaaaagugcuuuugacaaggcuaaggccuaugggcaaaacucaccaggauagugucccagcuggauaauuuacaauauacacaaguuagaaaacagugauuugaacccugaagccacucacuucaaggacuuuaguagaaauuucccagagacagaaaaauacaaaaagauagagaaaagccccuauagcuaacuucccugucccauuccuuacuccuaguggaguuugaggcaacugggagaccuggguaaucuuacugcauuaagucaguucaacaaaauccaacacucagaagacaaugaagagacaugguccuguuuacacagagcaugaggagcuggcgaaagugaaggacccagguucugagcaguucuuacaacacuguucaaacugugaccaaggguuauacaaggcacaaggaaugugacacaaugccuccccuuuaggacgauuauaggacuaaagaagaugaugcauauaacacgccuagugcacagccugguggguaagggucaugacacaucagacgucaacaacaguggucuucagauaagauuauagaugacugacuguauuucuucuuucauuuccaauuuuuucuaaugaguaaugagauggaacaacaauaugauagagaccagcacagcugcuggacacucacaacccaaagucauuucugucuuauguacggaaacauaucuaaggguaucucuugaaaaaucucacacaucuugaguucccuuugcccuuucuaacuuccuuaaguugguaacuuuauuuuagcuggaaagucuuuuuaauagauauaacaauucuuggcaauugaauuagaaaguauaggcaguuuagaaauuucuguaaaaaucaccaacagucuaauucuaacuugucaguaggacgaacgaacuaaccauaacaugggugacauaggcuuuguauuauuuuggauuuaggugauuuuguuuaacuuuuacuuuuuucuuuauuuuuucuuuacuagguaaaaauaaaacugaauauacauccaucccaagaauaacauucucaaguguaaggcaggacaguauuucacucaauaaagaucaucagguuucaaacucagagagugcuaaagaacuugugcaucaucaaugcacaacucaccagcaugagcuuugaguauauguguuuucagccggcuguuauaggaggacuugaaggagcagaguuugcaucggaaugguuuaugguguccgugguggguuugcauauggcgauccaaacuugauguagaaggaaaacaaaaagaaaaaugacaaaauuaaaaauugcauagaggauuugcucauugcuuuuuuuccaggaauccuacuucuaggucguucaaaguccuuuuguuuacuuuccaauaauggcauuuaucaauuuaauuaauuaauuuucaagaguuguaccuacucuaagaggacaggaagcuaaaggaagagaucaagaguuuuuuuuggauuuagagauauggcagugguaacaggucaugguaagaaucuuuauugucccuucuuagagcucugaucauuggaagaguguaucuaaagagaagguacaauaugggugaauucaagcuuccugccaagccagugagagugccuaucaauuaguccucuaacuuauucaaauaacagaaugggaauuagagaaauuuagcauuugaaaagagcugacuuucuuuuugaauucuaauucuacuuucauugugaacacuagagugaggaagggagguuucgaaguggcugaccuucuugcaaugggcugucuuguugccagggucuauauuaauauggaggcacagugcaugcauguuuaaaggagccacguggucaaaaggccgcacaucccuucugauacacacaaccauguuugcuguaagucuuccagaagcaauuuacaagggaguuauuuaauuacaacgaaccccuaguacuucauaauaauuauuagccuaaaaaaauaauaaaucuaccaaacaaggugugggaaguucuaauuuguaucagcacuccagagaacuaaauucccuucuaaaugccucaugugggaacgguacugcuuaccauuucaacauauaaugcuguccugagcuccaaagcaacauuuucaauugccccuggacagcucccucuggguguccuuuaguucucuuuaacucaaccuguucuaaacaaacccaucagagaguuuucuacaaaacaaauucucuucuucauuuccuuguuucuauaaauggcacuaaccuuucuuccagaugaguaaacugaaaaccuaguugccauuuguauuuuacuuugucccucaucccacgcaugaagucaauuuuuccaagucaggcaaauccauuccuucaaucauucccuaacuucuugaacuagcuacuauuauugcuucuuaauuccuugucccccagcccccauggauuuuuuuuuuuuuuuuuucaucucaagagcacacgcuauggagucagacuaccugggauaaaaucucagccauuacauauaggcuguguguccuugggcaaauuacuuaauuuuucuaggcuuuacucuucuuauucauaagaugauaauaauggggccauaccuuauaggagaguuuugagaaugaaauuaaguaauauuuaaaggcccuuaguacagugccugguauauagugagaugcaauaaauguuagcaauuauaauuauuuugcuaauuugacucuuccuuuuaccagcaauuuaaauuaugaaauacuauuuccuggcauuuaaaacuccaaauauggucuccuuuaaaguauuuagaccuuaucuuucacuauuccuuuacauguaacuuaaggauuagucaaacugaacccccagcuagggccccagucagcuucauggucuccucccucagcuuuuccucuacaucauauguccuuuccaaacuauucaaguccuauuuuccuacuuuaagacuucacccaaaugcuccuuaugccauaaaaccuuccugacucuuccaaagcugauguaacauuucucuucuuugacacaucauaguauuuuacugauauuuucaaagacgugcuuuauuuugaugagucaguggguuuuguuuuguuuuuuuuuaauuucauaaaccaacccuugacccuaaauuccccuggccacagaccauggccugugucuuuauauuucccaaaaguacaguaccuaggacaggauauauucauuuauucacaauuauuuaaaguuccacugugcgucagacaaugugauagaugcuguucaauaaauacuucuugaauugaaguauuucaaguuuuaugccaauguauggaucugaugacaaagauuagauauuaggcucuguauaauaauaaaguguuuacaacccauccuaaccucugugaaaacaccaccuccuucuucuguucaacaaccacuaacuggcccuuuaucuuuuguaagaagcaaauaguccaucauuuauuucauuaaaaaaauuguuuuaaaaagcaugucagucuuagucaccuuuauccaagacuguccaaacgcauuauugaauauuuaucucucuuuuacacggcugaaagagaaaggcaacaaaaaguuguucuuaaaaccaccccucuuuccauggccccaaaaagccuuacacaccuauuccauauuuacacuuucaaagcugugaugaguaaugggaagcucccucuccucaaucucccuguaugucaagcaacucuuuggcauccaugaacuucuuuaccuuucaagaucuuuugaaaaauugcaagcaauguuucuuuggucacauggguuaauaguccuaauuuuaccucuuuagcaacucaguuuucuaaauggacuuuacuuccucaaacaaugacuagauuuuggcugaauguuugaacgaugaaucaggagacucaucuacucuccacagaugccauuuuaccuuuggguaaaucauagcaauuccuccaauucucauuuuuaaaaugccugcauuugccaaaucuaacgccauccgaucaaucuccuguucucagccccauuuuacagaaaaggugacugaggcuccagguaacauagcagcaggugugaaccaugaguggggccuucuuacucauccaagcuucugcuuuagcuuagugccuuccacuaugacaucaucucccaguaaccacuagugaccccccaauagcacuuacuugugccugaaagcagaaacaaacgagcaauacuggcagcuguacuuguccucgcggguaaacauggccagggccagguggcuccucucaugagaacgcagccccugcauggacaucaggacucugucacauugacugcaaugguauccccccggccggguuucauccuccaacauuccaucaagcaagcaguguucaccauccacccggcccaccagggcgccacuggcgucuuuggcugcuuccaauccauccaggaacaagugggcagggucauccgccuccugcuaagagaaccacacacacacacaugccccaccaacaaaauaaauauccaucaucauugccuccagcuuucuuuuucucccuacauucucccaaacucaacagcacuucuugucaaagcuuccuccccugccucuccagcuaccccuagagggagagcaagcccaacugccauucuucaugcaguggaggugauuuuaggacaacauacccggacacagguugcuacuguuugcgaaaugugaacaagggcuucucccacucugaagacacuucacucacuucuuccccaucuuaaaagaaaauucaaacugcaaccccaucuaaguugacauaaaguugggcuaggguuguggcucacagaaaggagaggaagaaaggaagagaaagaaaagcaaaguaguauggucauugaggagccuugggccauuaucuggaaaggaagcaaagcaaaagaucccgcugucugcccccuacccuguagauggugacuucacucuaugacuggagacugcugcauaaucaauucaaaaaauuaaggagcagccuaguuuuaagucaccuguuuuucgagauagcuccuuggguuacugauuacacaggaaaagcccuucugucucucucacaugaucccaggaaacgagccugggacacaccgcaguggugucugaaagaaagugacugcugauaucccuggguugccacuguucugccaaaagacagaaagcuucagucuucagugaagaaaaguagagacuuuaucuucauguuaaauuggcaaaauaggauguaagcucaagaagggcagaugacaaaaauauguucgcguguacccuuagagaaagggcagaaccccaaaaugacuucuguuuuaauaaauaauagggcuuagcaauauccuggaagacggggaugguggcuugguuacugacaugguggcugcuauuaggauuaugauguucaaaacagguggccuaauaaaagucagagggaaaagggaagacacuugucagcaucauaugggagaggggauggaggagacaaaccaaggcuuucagggucaauugcgacuugaacgcuuuuaguuuuaaugucucuugcaguccccagaggacccaggauaagaagacaaagagauucuccuaggcucucugcauccucagccagaugagaacaguaagaagucaggaagaaagaggagcagaagaugaugggaacagaacccacuugauuccucucaagagcucgggcaacuuggaagaacgaagagcuaauggcacuaaacgcagaauagaaggacgacccgaagccuccuagaccgagaauccuggaccuucugcugccaccaaacuauccgcguggaaggaaaccagaucgaaacucgaccuuucccugaacagaaagaugaggaagguccaaccugcaaagaaaucaaaacaagccaaaccaauccaagcauaauucaggaaugcccgcauucugagaugcucuuuccugagcugcuuuaggcaaugggguuaauaaguaacucgaaucgcucacacacaaugcucauccagaccuuccaguucucaccuucacagcagcugacacagcugggacauugccauacuggacgugcuuucggaggugauugcagauggcucggagcguugggugcacuuccacacagaauuuacauuuguagcccaccacuuuccucuccuugaucuuuggcaccucuucuaagugaccaaaaggcugguaaaauacagugguagccaucaguacuccgagcccucccucaauugucagaauuuauucuugcaguuuacuaacauacuuuauuuuaaagccgauuagcagguuaaaaaccaagggagauauaggcgaguauuuuuauauaacaaauuugucagcaucauggcacgcugccuacuaugcaaagucuuugaaacccaaauacauuacggcuugugaguagagaagauuucugugcagaagcucaucgucacugccacuaagucaucugguuuucaaaccaguuucaacuaggcaggugaaacguugcauaguugcgccauuaaugaacuucuugauaaaauaaaaucuacuccuggagacguuagguucauguagcaaacacugaagaccaagacauggcugagaagugcuaaugguaccaagagacagcccacacugccuuaggaaagagcgagcguuguuguaaaacuaggcuucagauaaagcuacuuggcagaaagacauacauagaaaccaccccaaaccuccccuggggagccaugggaggagucaaagggaaggagggaggagaagggaccaaggagaggggugagcacagaaugggagauaaucaagcucgaaauguuuaauugacuuauugagcucucuggcaagcuaagucacuaggaagccugcagcaguuuggcuggcaacgaagaagugcaugugggcaccagugaugagaggccuccugggggaagggaaaucaaaacauauccuuacccucucuuguuugaaaucugcaaaagcaccaucugcauauuucugcuugcucaaaagcuguuuccuccucuccugacguuuggcacgcuucuggaauuccucauugugaauguucaagugugaggucagcucggcugugcuuugcaguuugcuaucacagugcuuacacugguagguggaguucugcaagcgggggccguugcccagaaugaugaagucccucuuuaggucccgacugugguggucaguguaaugcaugcacagcagcucugcagugcuaaaggacagcuugaagcauuugaugcagcggaaugggagccacucgauuuccugagcuucacccuccaccucggcuuucucaaaguugccucucuccucuucuuccaucagugugggcuucucaugcucaucugcauagacggccgugaaguagccccccaacuugcuggcgugcugcuucuuugggaacaccccuggguggcguuucauguaaugggacacgaugcccuucuugcugaacgacuggaaagagcacaaggagcacuuuuucuucuccacugcccgccggaguuccucgcucagcugaggggagucguccuugggcggggaugggaugaucacuuuguugggcuugucgcugaugguccuggaggcugccaagcagugaguguaauacgcaucaaugucguggcgcuucugguagugggcugccagaccuuugcggaugggguugguguaggcacacagggcacacuugaagagguuguucuugccuucuggcugggcucggacauuauugugcuugaugcgguagugccuggcgauccccuuccucguggagcagaaguacuugcagagcuggcaccggaacacagugugggagaccaggugggagguagagaagugagaaguggacacgggcuccucucccaccuccuccucagugauggagacuugggaagggcucacuucaguggucaucucgggcucgagggggacuggcagcuucgggggcgacugggaaaagacaucaaauucaggcugauugugauacuucucguaguggauuuuuaguuucuccaaagugccguguguguacggacacaguuugcaccgguaggcgccauacccuugcuugaagauccugcucgucuccuccacgucauucugggauaugucagcagacugcucuacgucgugcacaaaguccucagcggucaccuugauggacgggugucgcuucugguagugggucaguacgccguggaugcggguguugauguaugggcaaugccugcauuuguagacggcaccuggguugaugucaauguccugggcaaagucagcagccuucacuuucaugccagggugcuucuucccauaaugagugagaaggccgugcaaguuguuauacucagauuggcauaccgugcacugguaugggguggaggauauggcgggguuggcugaagcuagcugcaggcuuuucucaggggacagucuugcauccucuggacauucagcuuccugcuccgggaaagggguggguauacuguuuucacaauucacagggccugccaacucuucggaugaaagaaugggcuucuccacagcaucuuucuccuugaugauguccaguagcacugacucaucaccauucauggcccagggguggaaugcuugguagugauuagugaugucccagauggaaacagcuucgaaaacacagucccugcaucuguagguuuuggcuucggcuggcauugugagagagggaggggaugggucuggcccagcccacaguuuaguagccauguagguguaaucaacauaguguucuggaugccuccguugguaaugcaggagcaaaccguugggcuccguaugggaguagaugcaccacucgcagugguagccagcuucuaucaagccaucuagaaaugcccaucgcaugauggacgugacuguggcuuucagggcgggguggucuuucuugauaugcuuccucagugcauagaaguagggggagguauaugagcacugccuacauuugagugcucggaguuucguuuugucccgcuccagauuagagggggagacaagcacgcagcuggcaggcuucuucugauuucggucgcagaggcuucgaaugguggccguaugcugccggaucacaucugcauuggccuugaagucucggugcuucuucugauaaugaaugaguaccccuuugaccguccgguucccauaaucacagugcuggcaaaagaacaucucauucuccacaggagggccaucucucucagagcugcuucgguucagcuguuguaugggggcggguggccggggggagccuuggggcccuucgaccccucucaucauugcagcugugggaggagccugucugauauauuuggcaguaaccuuuauuucugggugucuuuucugguaguggacaagcacucccacaacugaccgauugcuguaggaacaguguuugcaguaguaaagcucaguacugaggucugguggcggggguugugggggggguggggaacccauguuggacauuuugggagacauuggagcacccaccucaaaugauaauugagaaagggcagagccccuguccacagacaccauucgcauaguuuucuggauccuaaaguaggaagccuuuucuucgggguguuucuucugauaaugaaccaagacagaaugcauguuggggcuugcaaacgaacaaacaucacaaucauaaacaacaacaguguugaccaaaggguccuucugauuuucacauucaggaguaaaggucuuaggaguguuuuuguugaacguagcuggcaaaccaccaccacgagccacagguguggaagucgccauguucuugggagccgaauucagaaucucccucagggucugggauucuguauucagcccuuccugcugcuccacgacauagcuugaaaauaucaucgcguuguugaucuucaccgugggaugcauucuuugguaauguggcaucaggcuucuaacauucgggcucguguaugaacaaaaccgacaccgguagaucagguccgagugaucaaaguugaguacauucauggcuucuggguggugcucgccauaaugcugcuggagaucuucgaaguugguguaaucgauguagcauuccaggcaccuguacacugcacugugaucauugggguccaagauguaccuaaagcugaauuuaauguaugggugcauucguugguagugggugcuaacacuccgggcagauuuguuguuaaagucacaguguuuacaauaguaaagccuuccagagucaccaaagucuguguuuucacuauugugcucagucccauagaugggaguuuggguauucagcagagcaguauuggaaacuuggugaucuuucaaguuuguugaggagccauaauaauccucuucaucuucagaaagggugagcucaaucucagccccauugguggcauuguaaucgugggugauguuucugaaguugggcucuuucuggggcucacugguaucucuuacccauaucuguugggcagaaaaggaagugggaaccucuaugauggguucugucgguucuuccucccuguccaacucaaccucuaucucgacuucguugucuuccucuuccucuucaucauccucaacauugaucacugcaucuuccugcuguuugguuugguuaauuuugcucugaagguugcuugcuaucucgucaauccugguucucuucuucacgggugacaaaucuagaggaaagucauuggcgagcuuccuagaggcuuuagcuacaaaauuguucuuggaggacaacccaagaauugaggucugacuuuucuucacaguguugcuggaagagggguggcugucugucucauuuuccaaugguaggcuugagggcugccccucgaauuuuggcaaguugucacagaaugaauguuuaugcugcugauggacucuuagcccuuucagaguugugguggaguaauuacacauggugcauuuguaugggugcagaggugcggcuuguguggguggcuguggcugcugcguuggugguggcuguguuuguggcugggguggcaccugaugugguggcugcagcugugguggcuguggcugcugcaguggcuguggcugugaugguggugguggcggcggcgguggugguggcugcgguggcuguugcugcugcaagggauccaacaugacuccugacuuucuaccauugaugcuugagcucucauaagacaccacaccuucauucagugaggaagaaaugcuuucacucugggaauucacagcaucccaaucugacguuguacccgugugacacuguuugugagccccaaguuucaacgagcucuugcaaguaaacggacauucgucacauuuguagacagcugucuuuccagauaaguggauguuuucuaugugacgagagaugcuacgucgaugcauggugaggaaaggacaaaaggggcacuggaaccuauucaugaaucuucuaaauggaauccccuuggucuccaauaauuuguugccaucugagcccaucagcugcucugcagacaggccugaugucuggugauccauagcacuuaaaccauucucacugucuauuucauuuaacucuucaucagaacuagagucauuuagcaugcuguuaguuuccaggucagcagaagaauuggucaugucagucauuccauaacgggaucucucugucaaguuaacuagaccagaauugugaggugacuucggcuucaucugaggguaagacaugggcgaaaacuuggaagcugaagaauugggucucaugauggaguugcccauggagccccugaaguuggagacgguaguauuggguaucucccggcuugcagcauucauggucagauagguggaguuggaaguggggcugggggcacucuuguucggcacaucagguagauuaguuccuucuuguugcugucugagacuggaaaggaucuugaccauacugcgguguuucuucaucauguggucacaccagcguucucggcggggggucugguagcugcaccacucacaacaaaaguugccucgagauuuggucaaaggcuugaccauagacucuaagaugcugcgcuccacaaccucugcuggcaguuccuugcagggguccugcagugauacgggcggaaccacagggucuggcauuggagcaggagcaggugggggagcaguggucuccuucaaauuguuuuugugauacaucuucugaugcuuaauuauucuugcccuucuuggugacuuguaugugcaaaacuggcaagagaagaccuuuccaaaucccucgugcaucaugauauuauaauuuaaggaucccgggacaggggguccugaugaacucccuucagcuugagcuccauggaccuuucuaguguguucuaugaggagguuuuuugaccugaaguagcguacacagaacuugcauugaaaaaacuuguuuguugguuugggauuagcggcaauaugcugaccauaauauccuggacuguggccauaguaaccuccgguccccaaugaaguugcauuuugaccuaaagaaaaagcauaaggaaagugacaaagcaaaagauaauuaaaauauccaaucaugcaaaucaguaccauuccaauuauucuucauuacuaaacaucacaugcaaaaggccugaagucucaagaugaggccuugaagaguauucacaaagcaucaaugaagauauacguacugcaccuucucauggauaaagaugcaguguauagcuuuagguauucuccucaucuccauaaaugagccacacagcuauaaaaauacaaguugcauaaauuguacuacuuuuucuagaacuuuccaagcaacuaucuuguucuccaaauugaaagguaggauauaugaggaagcuuucgaaaggauaaaaccuaagguacucaaggagagauacaugaugcccaaaccacaaaaauggcuagcaaagcacaagaaacucugcaaaagccacguauauuaagaaccauggcuacaggcuaaaaggaaacaagagcaauuaaaauacaucggccgugccaaguuuaguauagauuuaccugauaaaucuucugcaauggcaaauucauccuuuauagaagaaaacuccaccucugucugauuacuggcauucacggacccacaucguagcucauucacauuguccucagcaacaucaguuggcugcagaaaugccguguggacauccugaaugugugccuugagaucuucauaagacggggcucggaaaucacagccaucacacugaagcaccuccaugaucugggucuagccucucacauuaggaaccuguggcagaagucagaacaaaacaucuuaaggaaugcacuaaucacauaccucgagcugauggggcuauauauccauuaaugggaaaaaauuccaguaucaguagauuucucuuauuggacuuugccaguuggaacauuggcuaaagagaggcaaucagacauaauggagaugauguccuugaccucauaacuucaaagaaggaaaaauaccagauaaacauuuucuagcaugauaugucuuccaaugccauuugucaaggaaacgcuuaauacuucaaaaguuuuagaaguuucugagcuucuccacugaauccaaauuucuugguaacuuaauguuggcuuugguucugccuuggacucauuuucuuuuuaaauuggaaccaucucaaaaguaaagaggauguccacacagaagaaagggaaaauuucaaccuucauuagcuguuuauuuaguauuaugaccuugguguuuuaucaccaauuagugaaauaguauuuaaaucuuggggguggagguagagcauuuuuauuguagcuuuucuuacuuuaauaacuuugcugauauuggggugcaccucucuuuccucccuucuccaaauaguuuaguuguggguuuuuuuuuccaugagcuaaaugacuauuugcuguuuuacuaccuaccaauuauaaccuaacagcuucuucaaucuaauuaggucauaaaauauuccucaugagauuuucaaacaaccaacuuuggaugacaauccaguuucuguuuaaaguugcaccuuggcaccucaauuugcaugaagacaacagaaacuugcauuuuugaagaagggcuucuaagucaugacuuuaccuuuuuccacuucuuuccuuuacaaacaugaagcacauaccuggaugcaaaaagcugugaaccuaccguggaauaaaucaaaacuugcccagcuaccuucauucugcuauuuacuuugugacugaaauauacagaaagcuacacacuaacucaaaggagagucccaccaucaagaagucaaaaauguauuagaaagguggaguccuuccuaucuuaauguauauccuaaguugagauacccuguuauuaucuaaugaguaaguuacuucaguaagaucaucacaaacucuacugagucacuguaaucuagaaccagauguccaagaacuaacaccguagccaauguauuuuaugauguaauacucuauacuuuuacuguaaaagauaaauuauuucugcaggaacaaaaaaguccaguaauaauacaucaauguagugaaaggagccaucacacaaggauuuucuaucaaagaaugcuccuccugaucgccugcuaaaauaacuucuggcaaguccaguucuggacagacugagcuugcagagugagccgcagauauuuaccuccucuucuuucacccagcaauuuauccuuuuucaauaaacauugaacugugcaccagacucuuuucagcuaagucucaauauuccagauacacaagcuuuuaugucuaagcaccaacccaaauuguguggaagagguugcuaucagcucuggaucaaauuacagcagucacugaggccccaccccacuucuccuuucgcacaguccauuagaccugaaaacaaauuuuuccauggugcagacaacuccugcauuuagaacacuucacagaaaaaagcagaucauccagugugcacuccccaucccccaagcuuaguccuuucaucucagccaaacaagccacagcucugcugaauguguuuaucacacuuucaagagauaugagcuccugcgucacugaagcucuaagacucacuaagcugcccuaguccucugagcuuuaggggcagccauuuuagcucagagcuucuccuccgugcacaacauggcuucuccuggagucugcuaggcuaacaaucagaaaugaaugcuagaagagcaggcugggcuccuccuaugcucuucucuucccaacaaagaauuaacuguuuucauuucucucugaaaagcagcaccuuucuccuccucaaaugucauucaccaagaucuccaaagguucuuuuauuccaugauugauaugcugguuuguuagucccagcagagcccuggucagagcaggaugacccugggccagauccuguucuacaucaggauuuaggggugcaguggggggaccuccagaaugccuuggcuucuuggaagucguccuuccacacacagaagacauaccauccgacucugcuugccagauuccaaagucuaaugaccuuuguuaaucaccagccagucugucugcaucagcagacccugccaacagacacacccuucaacacaaaggcuguagcuauuccuuuuaaaggagguucucugaaagcuccauuguguagcagagaggaaaacaaaaucucuucccuucaaaacuucaagccuuuagaaauaaugcaacaaaaggcuuucugcugugugucuuuuggaaaguuugagccugauuugcacaacaucaacagaaguuacgguucugcagaaggaaagcagggcaccuucggcauuaagucauccaccuagaaaugaaauucaucucucuauguaguucucuaauaucuuggugucuucugaagcuauuaucaaggaugcuaacuucacuggacacaaacauaaacuaacaaucuccuuguucugcuacaaaggagauuaaaggguuaugagaucagaaaaagagucacugauuuggaaaaagaagagaugaugaaagugauuuccuaauggguucuagcuuuaauguuguugcagccucugccucaaaaauagcucagagccuuagaagagguuaaucuccaggccgcugagagaaccagcaucagguagagcugaauggccuucaauuucaugucugcaccaaguacugaaaggaggauguagccuacuuugaaagccaucuugcuuuuguguacacauuucuccugaagacgcugacagaagaagaaaauagaaguugcuggcauggcccaaucaaagagagagaaacuugauauguuuaugagaugguacaugggcacaugugcaaaaagugacagcaaguggaggggaagggaguagagaaggacagagacaaaaacacacuggacaugacgaugacccauucauauguuuuugcagcagaugguaauccucuaagaaaccaaaaccgaggaaaaaaaaaaaaggugagaaauaagcucugcauaucuucuucaucaaucccgaagagcagcaacccuaagaggcuaaccuagucacugaucugcuauaaaauuaugauuuuaaguuaaaagcuuugaucucauaucuauugacuucauuuaauaauacuaugauuaugaaauuagcaauauuuuuucucaccaaaaucagcaaaaucaaaaguaaaagaggaaguuucugaacuaacuaaaaagagucuauuucaaaaggucaugagaugaaucuacauaucaaacaagcaucccugucuucuaccccagauauaugucuaggcccuucaaggucaaauagaccucagaugccuagacuuuaaacaccacccaucaugaucccugcaaggugaacacagauucauucuaaaauaacuggcaccuaaugugacugguccuccuaacaugaaaccccuaaaccauccuaauuagucacugccuuuaguacuacuuauucguugcugguuuguucaguuugcauuuacaguuugaaggauuucaaaaugugggguuuugaugggcaaacccacaauccaauuguuuauguuugacaaacucuuuaagauauaaagaacauccagagaugaugucaaagauuugaaacauauauacagaaauggggaaaaguaaauuauggacaaagccugcucauuuucaaucuuaagaacaccaauuuuaauuuauaccaccugcccaccuacuuucugugcucagaauuccagagauccauuugccucaguuuucccuccugugaaggaggaaggagacaaaccacagcuucaucguccauccuuccaacucacugcucagacguaaccggagcggggagguguugacauuguacagcauucuuacaggcccgccaccaucacuugguccaggucagcuuggcaaacacugcucuuuaguuugagggcccaggagcauaaaugugguccucaagucaaaaucccagcucucuucaggaagugaucaaauuaaaaggcauaggccuugccuggaucuaaccuguucucugacugaaggacugcagcccagaaauaaagcugugaagcaccacagccaugugauucaguagcaacuaauuauaaccuucaaagccuuugagaaauagaaccagaaacaccauaaggugcuuuuccucuguccacuccagaaaccuaguuucauuuauaagacacuaaacuucccaguucuccucaaucauaauucuaauaaaaggcucucauuagcaccuguuguuugaacuuuucuuaguuuucuuucuuaugaauggaaaaaccaauuauccaaggacagguaauagaauacauaaauucuggaauaguucagcuagaaaaacagaaaaaucaagagacuaaagaucauucuaaaaaauguauuugcagaucagaaauuguugauaugcugaggucaaagauuugugauguguauugggagauuaauauuuucaguugcaagccccaggaccuuaagaugaaaaaugauuuuuuuuaaaaaggcacuaguaaacuuauaaauguuggguugcuauucuuagcaacaagggaaguucucuaucacuacuaaucauuuacacuuguuauggcugaaguggaaguucuaauaauuuaauaaucauuuaaagcaucuuuccaaagaguaaugaccugaaaaguugaggugaaaucucuuucaggaacagcaguuauggaaucaaaucuacaaaugcaaauauagaaugucuaaauauauauaucuauacacaaacacacauaauuauagauauaauuaaugacauacagauauauguaauuaauuuucuugauuuaauuuuaacucauauaugggcauaugcccuccaaauuuaacaagagcugggggcagaaucaguucuuuucugaauaaauacaaaugacaucgguacuaucuccauguuauaguguaaaacaauaaaccagcaggcagggcgugguggcucacgccuguaauuccagcacuuugggaggccgagguggaugaaucaggaggucaggaguucgagaccagucuggucaacauggugaaacccuguuucuacuaaaaauaaaaaaaauuagccgggugugguggugggcaccuguaaucccagcuacucaggaggcugaggcagagaauugcuugaacccgggagaagaagguugcagugagccgagaucgcgccacugcacuccagccuggguggcagagugagacucugucacaaaauaaauaaauaaauaaauaaauaaauaaauaaauaaauaaauauaaaaaaauaauaaaccagcaaaauaaaccaacaagcaacuuccaacaacaagcuaccuccaacaaucccauagcauuugguacuacuacagauucuggcucaccauguagucuucaaaugaccuaucaaauguuuauacuuuuugcuacaugaucuaagcaguucuguguacucuuggcaauucaccacacuaaugaaagguuuaacauaucagggaggauaaauaauuaaggaauucagaagggagacacagcuguucuucaaaaccaaauuuucagaagagaaaggauuaauuugcaaucacauauguaacccccaauaugagacugaaguuaaauaguagcagggaaauaccaugagaugaaguccugccaaugcauguggccucuguuguauacaguuggccugguccaucugugggaccuuguauauaagcacaaagucugaagcaggcaauuugcagauuaauaacccaaucaccuacuggccaaggaugcuagccuucagguuacuuuuuauuuuaggaucgcucuccugcauaaaguuuucaaguacuacagaguaugcuggaguacuauuucuuaauagauaccuuuggaaucaucauuaaaaugaaaugagcaucuagggauguaauccaaguggcuaaaaauguuggauauguaaauaagaagucauuccggcugagugaccuguuaugaaagcagguaguaagugucucauacagaaagagauacuacauaccuucuggagaauucaugcauuccuuugcaaugauauaaggcuaauugaggccaacaggccaauaggcagucugccagcucuccuguccguagaaaaggaagcgugugauuugaauaaggagauaaaagaagagaagggacaagaaaagaaagggaggaagcaggcugauaucucaguagcuuuagacuucauugucuguaaaggggaacuugcaguucacuggauaauucuaauucugagaagcgucuugacaauuuucuugagaugugguuuagaaacaaaacaaaacaaaaugaagacgacucccccucaaugaaauucucaaaaugcaaccaugauaaaugagauuccagcucaucauguccuuucaaaugaugggaacccauucuugguguccuaagaaugaguaagugagaaauaauaaguauugaggaauucucugaaaugucauggguucaccaggaaguuccuuggaaacugcagcucuucuugcccuuguacuuagaacaacagauaacugauuucuccccccccagagcuaaaccucgcccaaacagcagagacagaaaaucacgguguugcuuuaucgacucuucagaaugcuggcuggguuucuacagacacuuuucacacaagaacucucauuacaaaaauuguaaaauuaaagggaaguugcagauaugcugcugggucuucauuacagaacugauuaagacgcagaguaagcagaagcugcaguacaagucaucuuccacaucaugaaagaccaagacaugaauugagaacuuucccugggggcuggucagccugacugaccuugggccuugggugcgucuucauggcccaaaguguucgugccucacaagauucagccaaacauaccaagucucaauuuuacagauucagugaaugaauccagaaaccauuuuuaacaacuuaccuuguuuucuauuacuaugcaaagaaaaaaaaaaugauguauggccaguggcuugcggagugugugaggaaguuuugcugaaauaacuucuuuuaucugggggaaaaucucaaucuaaucucccugagacuugcucacuuuuguaugcucaucauuugcucaaaaaauucagacaauucacuugcuuuagacgagaaugauucugagccugccuccaucaguggcagccccugauguaauaacccuuccagucuauuuucuuauagcagacaaaacugauuaccuaagccuggcaccuggaucugccugucugugugucuuucuccaaaccaugguuucuaauauaacuacccugugaggauaaaguccuaaaccccugcuuucugaaaaggcaaacagugccugagccuauauagaccguaaaugcuuucaaguccuccuacucaaggggacugugauuuuuuguuuuccucuucuugacuucugccuguagcagaagccaacagaaggcuguccuucucucuuaucaaacuaaccaacuggcccauucagauacauuaguuuccccacccuugcuucaacaaauuaaugcaaccuuauagcaggagaaacauccauauguguuucuauaugggacuggaauauacuccaaaauuagaaauguucuaaaaaugaaagcuaagaaauuucuuuucucuugcaauccccaaucuacuuuuagcaaguaaguuuauuccuaaaacuucuuacaucccaagaacugagcagaaagcuuagacauuuguccaccaacacaacaguagacuuuauuaccaggugaaaacacuacagugcucaguuaaggagccaagccucgaauuccauauauccuuaaugauaaaucccacuuuugcccaacaaaguuagguuuuucagcauauccacuguugagcuguuuuaaaaaaaaaaagaaaaaaaaaaaacauacagaaaugccuauccagccauuaaggaauuuguucucagaucacuaaaaccaaaaagcgacaguagguaugaugucucugccugccaucuucaccuugagagcaagucuuuugaggcccuuacuuugaucauuuuguuaaaugaagagauuagaucaugacguucaaccuuuuuguacaaaggaccuguuuuacaagauuuucuucucauauuuucuaagauuuuuuuuccugauuaaauucauucccuuacauuuuauuauucagaggcauauaaaugccaaucuucaugugacugccuucuuauaaauuaaauccaggggcuuuccuugacaacucuaucuuagccaccacucccaacccuuacaaaaucuacaaaauugaaaccccuacucacaccaccaacccacacacaguuucucucuaccacaauccacuacuuuauuuccuucacuauuggcaugacccuuguuuguuuguggucuuuucuucccaccagaacacaaguacccuuagaaggagucuaggucugucuggcucuucagccuugggaacacucaguguacucaacagguacucagaaauauacgcugaaugaaggaaggaacaaaugaaugaacuagagcuucugaaugauaggauuccaaccaaccaacagagauuggucaugaguguuagaugacucuacuaacccuguguugucauaaagcaguagucccaacgagcgguaauuuuauuccccgcuugccccaacuuggggcuguuuggcaguaucugcaggcaguuuuaguuaucauacccagcaucuguggguaaaggcuauggauacugcuaagcauucuacaacgcacaggacaguccccacgacaaagaauuaucuagcuccaaaugucaauagugcugagacugaaaacuuaaugaucuccagguauuuucguucucugcauauaacccaccugucuucagaggcccuuuaugggguccuggcuggggagucucuggauccuuagagggucaacaaccugggagagcccagguccaagauuuuagaauugugugguucuaaaugaucuuagcagcccucaugcuauaugauaucaugaugaguuuucaguuuuauuuuucuaauuuggguauguuaccaaaaaucucuucagaaaaaaaaaaaaauccuaggcgaaggcaugugacuggucugucuuuccuagugauacggccuuuguauccaccuuugcacaguugauaauccugugaguuuugugaguaaggggcaaaugucauuaaaaauggucaagucagcugggcacagugucucaugccuguaauccuagcacuuugggaggcugaggcgggcagaucacuugagguaaggaguucgagaccagccuagccaacaugguaaaaccucuucucuauuaaaaacacacacaaaaauuagccgggcuugguggcaggugccuguaaucccagcuacucgggaggcugaggcaggaaaacuguuugagccugggagacagagguugcagugagucgagaucaugccacugcacuccagccugggucacagaaugagauugucucaaaaaaaaaaaaguuaagucuuuagcaugugaccucugacuaaaauuucugugaaaaacaaugcauauguucuccucuccaauguguaaaaucaucuucuuucaaagugacagggccccaggcuacuauaagucacucuucagaggacaaguaauacguucuuuuuuauucuuauauccccagggcccggcauaagucuggcucugaugagauuugugcuaugaguacuaacuguaugcaggccugcuuuccaggagaaaauuaaccagugguacaaaaucgaacuaaacguucaagaaccuaaggaauuccagagagcauccaugaacagaaaaacaaagcaaaaccuagugcuuaugaagcuaaugaagccacaucacagugguuagcugacuacugagacacuaguaauucuaagucuccacuggcaauucuaaguuuccacuuguccaugaguuuuaaguaaaugaccauccuccuuuuccucaucauccauggagaagcugccucuggcugcauuguuccaccuauguguuuauaacaccgcuaagcuacccugaacugaugugacaccuggagucaucaccugacuacacuugagaccauuugguugccuucccuccacaaagccuuuuuuauucuuguuugcaaaguauccuggaaagccagaggaacaauucuguccuauagcucaaaacuguauaaacauuuucaguggagggaguguaacaaaaucagguagaaacagaauuuuuucuucuuagccucccugaaaaauauugaaauauuauuugugccuuccuuaagucaaagagaagacucuacucuaaaaguuaaccaucaauagguucaucauguccaauggagaggagaucuuaaagaccauauaguccaaccugguccaacaucuucauuuuccagagagugaaacugaagucucaagaaaaauaaccugcccaagccuucuggcacaugcauuuucugaagccagaaaaaaaaucuuuugaauuucauaauuugagacaggaacucacaaguaaagacauuccauacgugucaguuguucaacaguauucacacuuaagguccaugccccguauauucucaguaaugagucuucaucaggaaggcagauuucagaauaaccacaagugucuccucuacucugaauccacacccaggagaguaacugaaaagguacaaaauccauuuuuuugcagauugacuauucaaagaacuucuuaggcaugcaagcaguguguuuauacuuuggaaacauguuuggaagacugaaaguugcugacaaagguauacacagaagaacaagagcuauaacacugaauuaucuuuagaauccaaccucauggagucggaacaauguuauguaguagcuuuaugccugccaaaucuaccccacgagaaacaucaucuuguuucuuauggaaaaugugcacugccaacaaagucacugaagaggcuagcugaacgagccuuaggaggaucuggacauagcagggucgguucauguaaaauggaaaggaaaggaguagucagccuuacgaaugucugucaaaaaagccagccucuuuguggaacaucuagugaaugacucagacuaaugauaccagaauauuguucauacuggauuucgcuucaaauuauauacugcauucugaaaccaacuuggaauauuuuucucucuuuacuaauauauuaauuuaucuuuauccauucuuuauuuaucuaacuuuauuccuagaggguaucuauauccauuuguuggauauaaaaaaaucuaaauguaucagaaagucugggaaucaucuuuaacuuuuaaacuaucuucccuaagggucucuuagaaaagccuguuaucauucugaagagaauagcuuagaaaaucaggaagauguugagaucucuauguuuguucacgguuuuccuccauguagaacacuuuuaccugcuuuuggaaggucuaaguaauucccauccuuuacgacagugguucucaaagucuaaucccuggaccagcagcaucagcaucaccaaagaacuuguuagaaaugcaaauuauugaguuccacccaagacuugaaucagaaacucugguguugagguccaguaauuuuuuuuuacauauucucagggugauucugaggcccaagcaaguuuuaagaccaagcucaaguuuuccuuccuguaugaaacagucccugagaccaccagcuagaacagugagcauuccuugcuccacugcauuggagcccuauuuuaaaaugcugccgacuggaugaaugcaauaauagcuacacaguccuugaagagcacaggagacaacuacuguuugcaaauauuuaacuucuuauauagcaauuaaugagaaaauacuaaguugcagaaccagcaucagaaacuaacaugaguacacucauaaaagacaauuacuggucuugaaagaaugaagacuguggcuacuucaagugcugauacugauaccuaccucccuuaaaaacuucagaaggguucaugacacaguguccuugauauuucuaaagcaggacauggauccacaaaggaaagaaucagaguauuuuaccuagaaaauacuaagaguuggguaaauccucaggaucccagacucuuccaugacaugacgcuuucgugauaaauaaaaucuuauuagaaaauaccuccaagcuuagaguggucauuugauuguugcccuaaagcuauauugcagggcuaaacucucaguuaagaaccaacaucugaagacaaagaugugucuggaaaucucucaaaagaaggauauaugcuuuaggcuaaccaaagaaacuuccagaaaaaaaugguggcuaauugucucacacugcuaacaaaggcuuggcuggggaaaaagaaagacaaaacauagacaaagaaaaaaagaguuuggccacaccaaacccauaaacugacaggacccuugaaucaaaagcaagacuuaaaacuuagaaucaugaaguucagagagaaaaauucaacuguguccugcccaggaaccuagccagaacccuuuuaaacugcugaaggacuacugaagcaagucaagccaucaagacacaaacucagguucuaaaagcagaauuaagcaaggcuugaggaggggauuuaaagagauguuucucucauuuuuugagggccaagaaaaaguucugcuaguuaugccucgaagacaaaugaguuauuaaaaaaaaaaaaaaaaaaaaaaaacuaaaacaagggguggaggacgacagaaaaauguagcauggaaacgacccaugaaaaaaucuauuuuggaggaacaggacacagaagaaaauuauauacaacaauuaacagagauucuaugaaagaagagaucaaagacaagaugacaagacaucagcacaagaugaaagagaggcuggcaguugaagaaagaaaaugaugacaaaaauaauaucauugcagaaguaauaaauauauuaaaguuauaagaggcaaaauccacaaaucaaaaacaauguugaugauguggaaaacagucuucaaaaaacugcacaaaaugcagaggaaaaggacaaguagaugaaagcaaguggagaagaugacagauaagaagguuugaaaacagaucgaacauacagauaaaagguuucguagaaguagacagcaaaacaaaacaaagcaaaacaaaauaugcuuaaaucugugguagaaaauacuuaguugaaauaaaagaguaucuguuauuccaagaaaaaguaagacugaaucaguaaaauggaaacaucuuggugagguuacagaauuucaaggcuaaacauugaauccuauauacaucaagaccuuuaacaauuagucaauuauaacagaaaaagucagguguccucugacuuuuucacaguaacauuugaugacagaaaaaaagugaagcugugucuguagaggcucaagaaagagagaacaauaccgaaguauucaauucccaacuaaguucacaaccaguuuuuuaaauauauaaaaguaauaaaaaaugauuuucuaaucagcauagucagagaaugcagcauguaaguaacuuuucuucaaaauacaaccaacggaagguucaaaaucaagaucucaagaauagguaauuuagagguaagcagaagcugugagcauugaauccacuuacauuuagaacuaaaauugaauaauugauaauacuuacaaaauaaaauuauaauuccuuaaauguagugguuauaacaauaaauaauuccguaacaauaacuauaaaaguauguagaauuggaaaaaaaacuuaaccauaauaaaauacacagauggaagugaaaaagcuuuagaggauaaauauuaacgggccuguaaucccagcacucugggaugcagaagcaaguggaucauuugaggucaggaguucaagaccagucuggccaacauggugaaacccaucucuacuaaaaauacaaaaauuagccaggugguaguggcaugugccuauaaucccagcugcucgggaggcugagacaggagaauugcuugagccugggaggcagagguugcagugagccgagaucaugucacugcacucuugucugggugauagagugagacccagucucaaaaaaaaaaaaaaaaaaaaaaaaaaaaaaaaaaaaaaauauauauauauauauauauauauauauauauguauauaugggcaaauauucucaacuuucacagcaggacagaaauacucauacuauuucauuucugaaguuaacaaauuuccaaauaaagguguaagaacauuaauuuaaucaguaauaaaaauaaaaacagacuauagcuuugaauuacuagaggaaagaacucaaagaaaaugcagauuauauaauaaaaugaagaggacaaaggaaauugcacagaaauauaaaagagaaugcauaaaauuaauuagaauuagguauaugugauauaucaauaaaugugaauuggauaauucuuccucuggaaaauauccccagaguaaauugaaaaacaaucucuaacuggauucugucuguaagagacacauauauaguaaaaugauacaaaaaguuugaaaaucuaauaucauuaaacauauaccaagcaaaagaaggaagaaaucaugauuaauguuauucaugguuaaauucaagauacaaaagcuuuuaacaugauagagaugaacacuuaauaauguaaaaguacaauccacaauggagauuuauuaugaauauuucugcucucuagcagcaccaaauaaauaaagaaauaaagauggcaacagauacaagaaauaggcauaagcacuuaacagauuaauuggagaaagaccaccaaggauaaaauucauguaauucauagaacugaguuaagagguacauuucauauucuauaucuggaaauagaaaacauauuuucauuucaaguaucugugagacaucuacaaaaguuuucaagugcccguggagguuuauagaagucuuuaaugccacaauuaagagauaauacauuacaaauuuaaaaaauaguacacaauuucuacuuacagugaaauaaagguauguuaaaaaaaagaaaaaaagaaaaaucccaaacauuugagaaaauuuuuuaacauucuccuaaguaauuucugggguaaccagaaauaaaaacucaccaguagaguaugacuuuuaaaaugcuauguauuuaaauauggaaucugguaaaagcaauacuuagaggaaauuucacagaucuaugaaaauuauaaagcaagaaauaauaauacuaaaugaaucaaacaucuaacucaaguacagggggaaauggaaagacagaagaagaaaagucgaagaaaagauuugacuacauuaaaaacaaacucaggaaucaauauauuacaucauaagguaauuuccucaguaacuuuuauuuuuuaaaaauaugcuauauaaaauuaauuuaaaacaauuagcuagccuaauuaacaacaaaaagggaguagggcaaaacauaaauauagaaaauaaguauaagaaguagacacuauccaaaaauguaaaggaaaauguauuauaauuuuaaaauuaccauguaaaacucauggcaauauauguaaaacuaauguaaugugucuagaaacacauauauuaccaaaauuaauccaagaagaaacaauaucaaugaaagacuagcaaacagucaaauagccaaccuaaucaccaaaacaucuuaagugacauuaaggaaucaguaaaucagaugcuuuuuaaacuggucuaaagucucaagcacaagauuguuaccaauguauuuccaaauccagugugacacagauuacagagcuuaguccacaauaaauacuaguaaaaagcagaaaaaugucacuuagaaauauugaggcagaaauucaaaauaaaauccaggagcucauuaaacaaauaucccuccaagaucaaguaggguugacugagaaaagucaauuucaauacaggaaaaucuaucaacacuccacuauauuaaaaugucaaaaaagaaaauaauaauuuuaucaguaccaaagaggcugaagagcacuugaugcaauucaagauaaacucaguguuauacuuaaugaugaaacauuagaaaaauuaaaguaaaaaaccagacaaggauuaucacugguaguuagcauuguuguggaaaugcuagccaaugcauuuguacaagaaaacaaaguaagagaaacaacuacuagaaaagaggagauaaaguuuucaaaauuuacaaauaagguaaauuaucuaggcgugggcccaagugaauaacacuuucauuuucuacuuaaugaugugaaaaauuuucaacaaauuucaacacguuaaacauuuaaaaauaaucaucaaauguaaaacaacuggggugacugauaaaguacuaguuaucaauaaacucaacuuucuuauuucagauuacuaagaauguugacucuucugcugacaaugacauucuuuuuuuccacccugucugggauucuugaaugacuacuucuaaaucaauaaccucagacaauccauauucagugauuuuagaaacuccagccuuaagguuaugaagauaauuuuuggugauuauaucuuuauaucaucaauucucaaucaacacauugcucuacccauaccuuuaaaggaaaagcagggaucucuguuaucacggcagaagggaggcaggaauagauuguagcuccaggcagagcagcaugcggaggcuugcauugugaauuuuagcuccagauugacugcaagaacaaaccagcaaucccaagaggaccccacaggcccucugaaaagagcagacugcuccugcaggacccaggagacacugcaaauacugugagugccccagcugcagaaaugggaaagggagacccuccucucccaaacacacaccccccacuggagaagcugaaggucuguuugcagaaguuuccgacuuuaccuggagcugagucaaguuagagagccaagugaaauacagggguagaggaagcagcaggaaggcccugggaucucacuggguccccaagcggcccauuccugccuggcaucacagggauccauugggaggguggccagaggagcaggggguaaaacuccacagggagaaggaacucuguagcugaacuuuguaacaauuuaaacguggugagaagccuccuggccagaacuccggggagggcauaaauccggcgugcagacuacacagguguggaagaacuaaaacucuuuuuucucgcagcugggaggugcguagccucagagaaauuuucaagcccaucucgcccuccaccuggaaacagacucggggcuguugcgggggucacggugagagugagaccagcccuucaugacugcuggcuuucccccacuucccugacaaccuguacgacucagcagaggcagccauaauccuccuagguacacaacuccagugaccugggaaucucacccucaucucccacagcagccgcagcaagaccugcccaaggagagucuaagcucagacacaucucuccccacccuaccugaugguccuucccuacccacccuaguaguggaagacaaagggcauauaaucuuggggauucuagggccccgcccaccucuggucucucuccacacuacuauagcugacaguuuuuagaaagugccaccuccuggcaggaggccaaugagcacaaaaauagaccauuaaaucaccaaagcuaaggacccucagagaguccauugcacacucugccaccuccaccagaacaggugcugguauccauggcugagagaccccuuagacaauucacaucacaggacucugugcagaaacccccaaccagccuguugcuggguggacucgcuggguagcuagacccagaagagagauaacaaucacugaaguuuggcucauaggaagccacauccauaggaaaagggggagaguacuacacaucaagggaacaccccuugggacaaaagaaucugaacaacagucuucagccauagaccuucccucugacagagccuacccaaaugagaagaaaccagaaaaccaacccugguaauaugacaaaacaaggcucuucaacacccccccacaaaaaaaucacacuaguucaccagcaauggauccaaaccaagaagaaaucccugauuuaucugaaaaagaauucaggagguuaguuauuaagcuaaucagggcgagaccagagaaagguaaagcccaaugcaaggaaguccaaaaaaugauacaagaagagaagggagagauauucauggaaacagauagcuuaaagaaaaaaaacaaucaaaaauucagaaaacuuuggacacacuuuuagaaaugcaaaaugcucuguaaagucucagcagaagaaagaaauucagagcuugaagauaaggucuucaaauuaacccaauccaacaaagacaaagaaaaagaauaagaaaauaugaacaaaacauccaagaagucugggguuaugcuaaaugaccaaaccuaagaauaaucaguguaccugaggaagaagagaauucugaaagccuagaaaacauaucggggggaauaauugaggaaaacuuccccagccuugugagagaccuagacagccaaauauaggaagcacaaagaacaccugggaaauucauugcaaaaagaucuucaccuaggcacacugucaucaaguuauccaaaguuaagacaaaggaaagaaucuuaagagcugugagacagaagcaccagguaaccuauaaaggaaaaccuaucagauuaacagaagauuucucagcagaaacccuacaagcuagaagggauuggggaccuaucuucacucuccucaaacaaaacaauuaucagcaaagaauuuuguaucccccaaaacuaagcauaauauaugaaggaaagauacacuuguuuucagacaaacaaaugcugggagaauucgccauuaccaaaccaccacuacgagaacugcuaaaaggaacucuaaaucuuaaacccuggaaacacaucaaaacagaaucucuuuaaaacauaaaucacacaggaccuauaaaacaaaaauacaaguuaaaaaacaaaaacaaaaaaccaaaguacacaggcaacaaugagcaugaugaaagcaaugguaccucacauuucaauacugauauugaauguaaauggccuaaaugcuccacuuaaaagauacagaaccacagaauauauaagaagucaccaaccaacuaucugcugccuucaggagacucaacuaacacauaaggacuuacauaaauuuaaagggguggaaaaaggcauuucaugcaaauggacaccaaaagugagcagggguaacuauucuuauaucagacaaaacaaacuuuaaagcaacagugguuaaaggagacaaagagggacaguauacaaugguaaaaggccuugucuaacaggaaaauaucacaauugugaacauauaugcaccuaacacugcagcucccaaauuuauaaaauaauuacuaauagaccuaagaaaugagauaacaacacaauaauagugggggcuucaauauuacacugacaguacuagacaggucaucaagauaggaagucaacaaagaaacaguggauuuaaacuauaccuuggaacaaauggacuuaacagauauauacaaaacacuucauccaacaacugcagaauacacauuccauucaccagcacauggaauguucuccaagauagaccauaugauaggccacaaaaugagccucaauaaauuucagaaaauuaaaauuauuuuaagcacucucucagaccacaguggaauaaaacuggaaagcaauuccaaaaggaaccuuccaaaccaugaaaauacauggaaauuaaauaaucugguccugaaugaacauugggucaaaaaugacaucaagauggaaauuuaaaaauucuucgaacuuaaugacacaaccuaucaaaaccucugggacaaagcaaagguggugcuaagaggaaaauucauagcucuaaaugccuacaucuacaucaaaaagucugaaagggcacaaacagacaaucuaaggucacaccucaaggaaacagauaaauaagaauaaaccaaacccaaacccagcagaagggaggaaauaaccaagaucagggcaaaacuaaaugaaauucaaacaaacaaacaaaaaaaacacaaaagauaaaugaaacaaaagcugguucuuugagaagauaaauaaaauugauagaccauuagcaaaauuaaccaagaaaagaagagagaaaauccaaauaaccucacuaagaaacaaaacaggugauauuacaucugauaccacagaaauacaaaaagaucauucaagguuacuaugaacaucuuuaugcacauaaacuagaaaaccuaggagagauggauaaauuccuggaaaaauacaacccucccagcuuaaaucaggaagaauuagguacccugaacagaccaauaacaagcagugagauugaaaugauaaauuaaaaaauuaccaacaaaaaaaguccaggaccagauggauucacagcagaauucuacgagacauucaaaaaagaauuuguaccaguccuuuugacacuauuccacaagacagagagagagagagaacccucccuaauucauucuaugaauccagcagcacucuaauaccaaaaccaggaaacgacauaaccacagaagaaaacuacagaccaauauccuugaugaauauagaugcuaaaauccuuaacaaaauacuagcuaaccaaauucaacaacauaucaaaaagauaauccaccaugaucaaguggguuucauaccagggaugcagggaugguuuaacauacaugagucaauaaaugugauacaccacauaaacagaauuaaaaauaaaaaaucacaugaucaucucaauagaggcagaaaaagcauucgacaaaauccagcaucccuuuaugauuaaaacgcuuggcaaaaucagcauacgagagacauaccuuaauguaauaaaagccaucuaugacaaacccacagccagcauaauacugaauggggaaaguugaaagcucucccucugagaacuggaacaagacaaggauguccacucucaccacuccacuucaacacaguguugaaaguucuagcgagagcaaucagacaauagaaagaaauaaaaggcauccaaaucgguaaagaggaagccaaacugucacuguuuguuugcugacaauaggauuguuuaccuugaaaacccuaagaacuccuccagaaaucuccuagaacugauaaaagaauucagcaaaguuucuagauacagcauuaauguacacaaauuagcucuucuggacaccaacagcagccaagcagagaaucaaaucaagaacucaaccccuuuuacaauagcugcaaaaaauaaaauaaguacuuaggaauauaccuaaccaaggaggcaaaacaccccuacaaggaaaacuagaaaacauugcugaaagaaauuauagaugacacaaacaaaaggaaacacaucccaugcucauggauggguagaaucaauauugugaaaaugaccauacugccaaaagcaauguacaaauucaaugcaaucuccgucagaauaccaccaucauucuucacagaauuagaaaaaacaauucuaaaauucauauggaaccaaaaaauagcccacauagccaaaggaagacuaagcaaaagaacaaaucuagaggcaucacacuaccugauuucaaacuauacuguaagggcauagucaccaaaacagcaugguacugguauaaaaauaggcacguauaccaguggaagagaauagagaacccagaaauaaucccaaauacuuacagccaacugaucuucaacaaagcaaacaaaaacauaaaguggggaaagaacauccuuuucaacaaaugguugaaauuuguugaaauuauccaauuagccaauuacugggauaacugguuagccacuuguaggagaaugaaacuggaucaucucuuacuuuauacaaaaaucaacucaagauggauuaaagacuuaaaucuaagaccugaaacuauaaaaauuuuagaagauaacauuggaaaaauccuucuagacauuggcuuaugcaaagauuucaugaccaagaagccaaaaggaagugcaauacaaacaaagauaaaucgcugggaccuaauuaaaguaaagagcuuuugcacagcaaaaggaagagucagcaaaguaaacagacaacccacagaguaggagaaaaaucauccacaaucuauacaucuggcaaaagacuaauauccagaaacuacaacaaauucaaacaaaucaguaagaaaacaacaaucccaucaaaaaguaggugaaggacaugaauagccaauucucaaaagaagagauacaaauggccaacaaacaugaaaaaaugcucaacaucacuaaugaucagggaaaugcaaauuaaaaccacaaugcaaugccaucuuacuccugcaagaauggccauaaucaaaaaaucaaaaaacaguagauguuggcauggaugcggugaacagagaacacuucuacacugcuggugggaacuaaacuaguacaaccacuguggaaaacaguguaacaguguggagauccuuaaagagcuaaaaguagaacuaccauuugauccagcaaucccacuacuggguaucuacccagaggaaaugaagucauuauucgaaaaagauacuugcacacccauguuuauagcagcacaauucacaauugcaaaaucuuggaaccaacccagaugcccaucaaucaacgaguggauuaaaaaacugugagauacacacacacacacacacacacacacacacacacacacacacacacacacgauggaauacuaugcagccauaaaaaggaaugaauuaacagcauuugcagugaccuggauaagacuggagacuauuauucuaagugauuaacucaggaauggaaaaccaaacaucguauguucucacugauauuugggagcuaagcuaugaagacacaaaggcauaaaaacaauacaauggacuuuggggacuuggggggaagagugggaggggggcaagagauaaaagacuacaaauauggugcaguguauaugugggugaugggugcaccaaaaugucacacgucaccacuaaagaacuuacucauguaaccaaaugccaccuguaccccaauaacuuauggaaaaguaaaacaauuaaauaaaauuaaaauuaaaaaaaaagaaaagccacacuaucuccuccuaaaggaauuuaagcagguggagggaaaccugagaaugagcuguuguuaugcaacccaguccuuugccuuucccacauaaccaucugaaaaaaaugucaacucuggaacaaucuuaaaugaguguuuucucccaaauucuuuuugcauauccucagauuggugucccugcaaauucauggucucaacuccacccaguaaucugauguucacauaguuaagucugucucccauugcucacugugucuaacugagaagaggaggaggauuccauuuucucucaggguuucccuuccucaucugcacagacaccuaucuuuucucucuuauccucgugccacaauggaaguggcgcucccaugucccaucaucuaaggcugauuccuuaacuugagcucuugagucaguccucacugccucaucugcgagauggucugauaguuauccuuucugcauuuucaauuuaucuuugacuacuagcuaagucauccccaccuuaaacucucacccaucuaggggagaaaacacacaugcaugcaugcacacacccccccccccccacacacacacacauacacacacauucucucucucucucucucucuccaugucccucuggccuaacuucuucucuagggaaauuauagguaagagucaaagaggccugagguugaaucccgacucuaugauuuauuagcuacaugaauccuugacaaacuauuuaaauucuccaaaccucuguuuccucauccauaccaaguaauccauauaucacaggguuguguagaauaaucuggauaaggaacauaaagcauuuggcauaguuucuggcauauacaaaaacuuaacuacaauugccauuguuaucauuaauuccuccuuuucacaaacugcuuucauguuccuuacuucuccuucagucuucuacaucuggcuuuuguaacucugauucugcuaaaccaaauucaucauggucagcaacaaccuucuuaggagcaauaauaggauacuuuugcuucuaaaccauacaaaaccauuguuucuguaccauucuccaucauggcaaacucuuccuccaaauaacucccuuuccuggacaccuaugacucucuccacccugaccuccucccccagcaccaccaauuuguauucaucccucaaucucaacuuacaggaggguuucucaaacucggggugcuauucccauuugaagccugauaauuauugugagaggcuguccugggcauuguaggauauuuagcaguaucccugacauccccacuagaugcugguagcaucuucccucauccccaguagugacaaccaacagugcuucaacugucucucuggagacacuaccaaaugacccccccuccaccuccagaaggguuagcacaaaaucauacccaauugaguaccacuuucucuagaaggccuuuccuggcaccucaaggcugggguagacccuuccuagggaccccugaaucucccaaacauuuucacacagcaccauccacuuaguugucucuuuccccacagcgcauugugaguuucuugaaagcagggacuguguucuguucuguucaaacccaucuccaggcagaguccagaacccauacauuguucuuccucuauuuggaguucuuccuccaaauguuauuauaagacuuaguuuaauaacaaaguuucaagagaggacuccaugcacauuaaauauaaacugaugauaacaugcaucccuuuugagaaauguauaaauguggggaaaagugcaacuuagcacugacgaaauaaggaauuacacauuugcuaaugcugaggaacugcaaggcuguauguuuguagggggagggagagggcugguggagaagcugaggaucagaauuagagcacggcuuuagccucagucccauauggccaugagcuagggacuggcuuguggcuggaggcgaauccauggaucagcagggcccugcugcuggccucuuucccucucuauucuccuucccuaaucucaaugccauccuugucuuaagacugucuagcagaucuggcauuuucaaacuuaaggauacuucuaccuuugucuuccuuuucucauauccuugugcauauuauauuacugugcuccuuauucugucccugccucuggcaaugaacuucagacaaagaggagugcccuuacaaaacauaauuuuuacucauaaaacauuacuacauuccagaagacugguguauuuaggggaugagaagcaucacaacugaaaagaacuggucuccaaauaguuuauuuccauggaauuacuaaaaaaaaaaaguaagucuucaaagaucgacauauuaaaguagaaugaggucacugauggcaaaaguucaacaguguagacaaaguuaucuugucaccaaagcuaagaaccccaggcaucuaguucuuuuuccugcauaccaaaaccuguacuaagggaauucuuaggggaaguguucuuucauguuuauaguuaagugaaaaaauaaguugcaaaacauaauacauaaucuguuucuacucaaauacugauaauaauaauaugaugcaaauauauaaauauagaaaaaugaccagaagccauauacccuaaacuuuuacuggugaaguuuucucugaaagggagguugaaaagaaguuuuacuuuuucugaauuccaacuucuauaauguuugugugauuuuuauuaguauguggguuucacaaguuggaauuuuugucuguuuguuuaaauguuuucagagaaaucagaaaacaaauuaaauaguuucucucaaaaaauccccagguucaugaaugguuggccaacaagucagcccacauuuuagggaaugugugggugugugaucacuuugguguuuaaauacuuaauaugaauccacaaaauaauguuggcacgugaagaaaagaggcacagccaagacugaccacagaacauuaacugccuauuagcaaguggaccaaaugucaaugccuugugaucugucuucauaaacuucagacaggagcagguguauccuauacaagagacagcaagguuuagcagaaacacauauuugaacaaaauauuucaucaaucagucgaccucacugaucuaauguucaauuucguucuaggaggcccuaaggaggacacagguucuguccucaggggauuauauacuuuaccuucuaucccccaaacacaaauaaacaucuuaaaugucacuccaggaaauauuagaagcaauauaacccauuaccuucuggagcuauauggacuacuagccaugaccaccucauccugcaaccgagauuaggugggaaaucugagacgccaugagguugagucuggcuuagaaguguccugucauugcuaagguccacucuaccucacaucuagacuggugaagagggaaucauugaucugaagcucucugcccucauuuuuuaaaaaaaucauuuucgauugagccaaaaacaaauauuuauugaccagcugccacaugccagcaccauccacuaacuaaacauuugagugccuacuacguagcuaguaugguucuagacgugagagaaaaacaaaaacaaugagggggacagaaggcugguauaaggcauguucuuucucauggaaguuaaaaauauaguugggaugagacuaacauuaaaaaaaucagacaaugaagaauuccaaacacucuauaauaaggcauagauuguuaugguacaguuuccaaguaaagagauggagagggcaguuaugauuagaccauugggaaagaaaaggacaugauuuaaggcuagaaagggcggguuagauaaugaauguucuuguuuuuuuugcauugcauuucuucucauaaguaaauaaaaccaggauguagaggggaggugaacaucauaaccagacugaaugguuugucuaugaauaauuccaugaacauauguaagaaagaagaacccaauacauauucccacccccaaaaagauggcauuacaggaguuccaaguuuuuguuuccaugaauguucuugaaagcuagcaaucagcacaggucacuagaacuaacauagguuuuagcaaagaaagacaacaggaccuccaacuuccugaccuguauaaugggacuaaaaaauauccauuucauagggauuaaauaacguaagaucuauccaguuucaaaugucagagccuucccucccucccuucauucggacagaaacagggaucucuuaucauccuuaaucagggcaaugugauauaacgaaagcugugcccuaucaagauuauuuugcuagcaucaugagggacuccuagaggugaagaggauggugggaaacaggcugcuaagcagcugcugagaugguccagggaagagauaaaggaagccugggccagacgacgcacuggggaugaagaggaggggucaagccuacaugauauuuagaagggagcacgggcagaagcuaaugcuuggugcacucugucuaauaaccaggucaccacuuucugacccauccagaguuaacuaaugagcuguggucuaagcucaauuuuuucuaacauaugucaagaacagucuacucuuugguaauaaauggaaaaugauacuuuuaacugaauuuuaaaagaacagugccaauaaagguauggaauauuauccaagaagcaacagaccuuagguuggaauaguuuaaacaaaggguacucagaagcagugcaucaaccuaugcuaaugguauucccauaaauuuccuauuuaacuagagagcaaggaaauuaccuagaccagcagcgucagauuaaaaaaucaugccagccauguauguaauuuuaaauuuucuagcagcuagaaacaaguguaguuaacuucaauaacacaguccacauagccuaauauauccaaaaauauuaucuuaauauuuuuauauuuaucaauagaaaacuuacaauauuuaucaauauaaaacuuacuaaugagauauuucauccuuuuuuucuaauaagcuucaaaauucaguuuauuuuagacuuacagcaccauauccauuuggaucaggcacuguuucaagggcuguuucacuguuucaagugcucaacagccaccuguggcucagggcuaccacacuggacagcacagaccuagaaaaccuugaaggauuccuuugaacaaaguacuuauuuaagaguuuucauugguacucaccuugagguaguuaccuaaugcagcugaacaucuggagugagagauuuaaaaagcuaaucuaaucacaucuguugucaugcuuacaacccuguaauaccuuuacauuuuccuuaagauaaagacuaaagaguuagagaucccucccgcauaaaaaugaaaagucuguuauaucguguuauggaagacugaacuaauaucuuuauaucuucucucuguaauagagauacaaaguucuuucuuaaagcagcaugucucuacuaccuacacugucaaacugaucauuuacagaaugcaccaaccccagagcugagccagcucaaaaaaaccuucagccaacaaggguuguuuugaaccucggccuagcagcacccaguauggcagugaggagcaugggcuugcagcccaccuaccgguuuaaauccagucuuuaucaauuaacaauggucagaucuugcuuggcaaguuguauaaccucucucugcuuccauuuccucacuguagaaaguguaaagaugguacuauuucauaggauuauaacaaggauuaaaugaggaaauacuaaaagucaguuugcacauagucuguugccaguaauuccuagccauauauuuucauggacuucucuaguccuccagaaaugucaggaucacauuucucaauaaucucaaagagguuuguaggcagcacuucacaaugcauagagcgcaacugaccugcguucacaucccaguuuuuugacaccuaccacguaguacaagugugcaaguuacuuaaccugucuaaagccucuguuuucucauaugcuaaauagaaauaacaauaaaauuacauccacugcacaacaauauagugaggauuaaaugagacaacagaaauagcagggaaucugacucuuagaaaauauaguuccugccgucuccugaguacuguuagcauuaccccuuucccucuccaucagagccuguugcuuucgacauauuaguuuggggaugaguuaggagauaucgcuucgagugcgguuaagacaaauggaaacaauuaugauaguacuguuuacaaguuccaugggcauuuguuauauuaccaaauauuuaccauguccuuuaucaucacuaaaauccauccugcaaaagccauagcaagccaucucagcaacugacuccaaggacuacucuaugaaaaggauggugauuuccuuccaugaugauacauucucacaagguuagaggauguccccugaauauccccaacuuccuuuaaaagacuacaaagcauuugucauuugugggugagucauccaugguguacuggaaagggcuggucagaagacaagguuugggucucuguccuggcaaucaaccagcuaugauuuuggggaaguugcuugaccucugugggucucagagagcacaucugcuucuuggcaucguguugugaagaacacauuuauauaauguauacugaaagccauggucugauuucuaaagagcucugcaaaucaauguaaggcaaggauuugucuaaaguugacguccacacuuuuauguuuugguaguauauuucaggaauuugcucugagauauagaagggggcucuuguuuuaugucaccugugucaucuucccccuaguuccaaagucaguaacuggagauccagaccucugacugugagagcaggaaugggaugaggcaaaggcgagaagccuggggccagggugacucacagcuguggaauccauuaagggugaaaggcucucugcauuccuccuccaugucaagucucuggguuagcaagguacagaugacggaggaaacaggccuauuucuuugcagacuaaauauuauucaucuaugcauaacaugugugugugugugugugugugcgugugugugugcaugugugugugugugaguauaugccuccaaauaugaaggcgaagaucuaagcaaauuauucuucuguuaaacuauauaaaaccagaaacugacuugaugcaguugucuucuuuuccacugccuuggaguuuggcaaauugaaccccacaaauccuuagauacgguaaaaauuuucaauaaaaaauguuaagugagaagaacucuuagaugagccauggaaauucuccaacacugugagacccugagauugugguguuauugaguggggcauggggaugugcagguugugugacaaguuugaugaugccuaaaaauauuuuuaaugguaaaaaccuaaagcaaauaaagccugcaugauaugcuuacguauauagcuaccuaaucuucugaguugcacuuucguuaaauggaugccaggauuauuauagaacaaaaggaaaggaccucagagggaacauuccaaauaccuuguacuuggauuuucucacagcuguaguuauuaaaacucuauuaaaccagcugcuaauaauuuucaaaugguccauuaguucuaccaaugaccuugggccaccaccaauuuuagaccuagucuucaugucuuaaucaacagccucaaauggaauccccugcucuuucaauagagaaauacauuuaaaagaaagauuguugauugcauagguuauuugucauuagggaauuuguauaauauggaauuuaaccuaagaaccccaauccuccugaaaggaaaaugguucuucugagauuucucucucuaaagcaaggugaaagcuaaacauuauuauuauuauuuuccuuguuuaacagaauagaaugcauggaugggucucucaggacucuugggaaaaaacucucuugaauaugcuugaucaacaaugggaacccauccagaggggggaacaaaaagccaggaaaacauacucuaagcuacuucagauaaauaucaagaaacgucaccuuuucuauaaucaaggguguggagaggggaagaacuugcaaaagugauuucacguucagaugugauuuauuaaugguacuaaugauaauucaaagagaaaucaacaccaugaaaacaagaaugccaagacuaaaaggaauguccuuuucuuaggcuuggaaccaaaaauauuuuucucucucgugaccaucuuaacuucaaaagcagaagcaaggaaugucaauccguauggagcuccucuggccacuuacuauguuuccauucuuuccacagagaaggggagaggcagccuauuguaugucuccgccaacaagaugagaaaaaaaaaucacuuguuuuuaaacuuucagaggacacagauaacucagggggaaaacaaagaaaacgcagacaugaauaaaaauuauuuuggaauuaaauauuagauuuuaaaaaucaagaaagucuaagaauucaagacauguucagaauuccuaauggcaaaaagcaugagcuucaagguuuguguaccagggaaaugcauuuuucuuuuuugucucuuguuguuauuuauucaguacuuuuguuccaggaagaacucuucuucauuacuguaaauauaccaaacaaucucccauuuccuagaaaucaaucaucuccuuuuucagccgguguauuuucuguuccaccucugacuuuuuuacuaaauuagcuaaaaaucuccuugauuuccuguacuagccauacgauuuuuccaaaaaagaaaaagacuaucuuauucuuuacucaaccagaaagguacaaagaaaaccaucagauuuuaaggaugccauuuagucuucaagaauaaaagugagaaaguugcuugggucaucucuuuguucacuauugcuggcaagauuccaggcaagaguaugugguaaucucaugauaauugaacaacauagucuacuaugcacucccuacgaugcaauauuguuucaugucacagcaugaugcgagugacaugagccuuagagcagaggacaaaggcagggaaugaccuccaaaauuccauaucagagcauaugcccucugacccuagguacauuuggcuaaccugagacauuuacccauauuacgaagguaagccuaagugcaucaucauuguugaguggggacaagcuucaaauguuucucacuacaaauggaguugagccuaacuacaucauccaaguguaaaaccauguuuguggacacagagaaagaacugcagguguguggauaugauauuugauuaaguggcuucaagugcuagauuuuuguaugcccaaaaaggacuccagaaggaaaugaaggaauucucccgacaauguuuaauuaacuccaaaccaagagaccagaagaucaccaguguucccggaaggggcacugcauguguugccggguugacugaaauucuugagguccacacacacaaaugauuguggaacauaggcugacaacagaauugaagagugaggccauacacagcucagucaaggccacgaaauucucacauauaguuuuuauugccaaaagagcuaaaugccaccacuagauuuuacaaacuuuuaggcagaauauauacaaugauguaugccuagucuaagaauccuguggguauguuaacuggauggcagccggaaaguaagguggagucaagcucuacacuagagcauaaaacaaagaaauggucacaccuauuaguuggccuggauauguguaaguaucaaugccacuguagcuucuuaaggcaguuacccugcacucuaaucaccuggguaagccaauaugucugaaagaauggauaacaagaaagauauccaaauagcuuuauuugggggaguugaucgucagcaaauaaagauaguacauaagccaaauaaaaugcauuaaaacgcaccacuucuagugguggugguaauguguuagaccuguugacaacuggagauguaaauacuagauuaugagccucugaaaggcagggucuaggucuuucauuucuguagagccaacauuuagcacaaagccugggaagcagucaaaugcucaguaaguauuuaaaugaaugaacaaaugaaugaaaaagaguaaaaaacaaguaagcccacgguccagcauucaguaacaggaaaacaggcuguuucuuuucaacuaaccaaggaaagugugagcggggaaaggcuguguaaacaccaauggcagccacaaaucaaagagcagagcagggggaaucacagucugacaaagagaguucuccagcccuguucccuuuuaaccagacucccccguaccuauaccacaucccaucacggcauuacuuucaaauccacaagacagcagcagugacaguaacacccugagcucguuaacgaucacaacccucugagcuacccgagcacagcgaaggagagacaggaaaguuuuacaagauaaauggggagguagcauuucugaggccucccuuuuaaaagggguggggaggaaggguguguacauagggaguggacauacuuacugacuuccaccuaggugccccauuaggccaauauuuugcaaaaccaggugugugcaauuugcuuauuaaaguucucacccuggggcaacugacaagacucaucaguccugggagaugugugcuaugaccccaaggcaaguuaaagcauauccagaauauuuuaagcuagaaagagaaucuuucuguuaaagugaaaggggaucauucugcugaaacaacuaagaggaaaaggaauuaaaaguaguuuguucccaguuuuguguagaaauuguaccauuaucuuccaaaaacaaaggcucaagguuagauugagguuccagaaggaacaugggaaagguuuguaauugaugauucuauaaaugguggcacuucaaaaggaaauauuccagcagaggauaaaagcuccaagguggcccaccuugccuacuuccucaagagguccaagagucaacacuuuugaacaccaggaucuuagaaaucuagguuaacucucucucauuauuagcuaauacggugggaagagugacagauguggaguagccaauggcaacagaccacaguggcacugcauauacggagcuaucugauacugaagacgccaaaaaagagccccaguuauguuuuccaaacuggccaagaugggcaaauggaugcaacugaauuggaaaugacaguagcuuuuucuaugcuguuaucaauagcauucaucucaaauuagacguuaacagacugcucuaccagugaaacauagcuuccucccugccaaacacuaacccuauucagggcaaaguauugucaguucguacauaaaaagauaaccaugacagagcucuggugguagaucuaaauccacauuuggccgggcgcgguggcucacgccuguaaucccagcacuuugggaggccgaggugggcggaucacgaggucaggagaucgagaccauccuggcuaacacggugaaacccugucucuacuaaaaauacaaaaaauuagccgggcgcgguggcgggcgccuguagucccagcuacuggggaggcugaggcgggagaacggcgugaacccgggaggcggagcuugcagugagccgagaucgcgccacugcacuccagccugagcgacagagggagacuccgucucaaaaaaaaaaaaaaaaaauccacauuuacagaacagcuaucauguaccuagcacugggcuagacaaccacgaauucauggcaugcuuuagacugccaggcacauuuaucucccacauucaucuucacaacagcuugucuuuggaaguagaaaggguuccaaaauuacacuugugagggucguguuacgagaaaauuuauuaucagucuuucuuucuaaauguacuacauaaacuauguaacgauaacccaaaaaguccuuuuuaaucacaguuucaucauucuauuugaaaucuagagauucuaguauguugcaacgcaaucaugaccccugugaauucaacaauaaacaguucauuugucucauuaaaguaaaggagagaaaggaaagaaauagauguauauacaauguggguuuagcuuucaagauccagaggguguuugugcuacuaaacaacuucguuaccuugagcaagucccuuaaauauucuuggauucgacuucucuggcuauaagauaacauuaaaaaaauaaccucaaagguuccuucuaguuuuauuguaauaaguaggaaaccugucaggaaguaucuuggaauacugauggucagggaaccaagguuccaguugggcucuguauuauccugggcaaauuaugaccuuugugaaacuguuuuuauacuuccauuuacggagggagaggauuuaguagauggccuaggaggauguaggcaaggaaaagccagcuguggauaacauguaagaacaacauguuagaaggugguggugaaacagaugaaugacuccucagccuuaucaggguuagacaauaccaacaaugcagaaagacagcucuucaugauagguuauaaaacuuauggugaaaaccuuaucauucguucaaacugcuacucaacaacuuaguuacccuggauaaaucaccuggacaagcuauucugaaugagauucucugcccuugacuaaauauucucuuuuuuguuugaaaacauuuggaaauaggaugucuucaugaacaccaagggagaaaguguuuugguaaagaguaaggcuguaauuuuaagucacauaauuguaagggacagcaaguauagggaagugccaccgccugucauuuacccucucccgccuauugcagacuucucugcuugaucuccacacucuuuuccaacaagccuagacaaggcacagaauccucaaagugaagcuccaggcauucuccaccaaucaaucaaaauuggcacgagaaauagaagcuaucugccaacacuguuguaguggaauaagcauggaucaccagggcagaaaacugauauuccauuucaggcuuccuuaacuaacuuccuacauuguggacuuuggacacaucauuucagccuuuccagagcuguaaaaugaagggguuaagugggaugauuuccuagguccauauaaccaguuucuucacauugacugcggaugacaggagcuccuuccuuuucagacccuaucucuucuauuuuuuuuguagcugacauuguuguauauuugaggauguggauuucaaaugugcucacagccuaugucuggauccucaggguggcauccuggcauuuuauuuuuaaaaccaggaucuacuacauugccaacaugcaguggcuugaauccugagaguuggauacccuugagucauuaucaacuuucgaaauaggcagcacauucacacagcuaacagaaagacacuucaaacuuuaaaauaauuuuggaucuacauaaacauacccaagucaugaaaagacagagaaaguuuaaagagcgguccagugagguaacaaucccagccaccuucuuaaccaccccaccccuacuuuucuuuuuuacuaagucaguagugcucaaugagucauuauguggcuaccaccuaucaggcuaaggccaacaaacccacuucuuggguaugaguuaccucuugauuauuauuuaauaaaauacaaacuguucuaguuuguuauuuuauuuaaaauaggcaucacacauuuuuuuaaggcuaccuugagcauacguuaccuuuuccuggggaaaacaaaaagucccgucuaucuagaugaggaaauauccaaagagcaaauaauuaucagaacaugacucucucuggcauccuccccuucucuccaagugguuuaugugaugacagggaauagggauagaggaacuggaaacucuuaagaaucaggugggcuccaaaacaucaagcaguccucaacaucagucccaugugcaagauagccacuucaaguuguccuuguucuaaagucuugaugguagcaugagcucugcaccauacgccuaaagggugaccuaaugcugaguucugcuggggcagcuggaacuggacaggauuguuugccacggugaucugagucacuuuucagcaacaucucaggguuaacaagaucacauguucagcugcuacuuaaagucuuggaggcacuucaaccucuuaacuuggguaagcauuaggaaccuaguagguaguguccaacuccucaaaauaacuuuaaagagacuauacucccuuucuugaaccuucuaagcauggcaaggacacaaccaagaaccacagguucuugggccaugacugcugcuuucuguuacuaaaaaauuacugucaaccagacaaguuuucucaaauuauuuucuuuuucuacucaauuguuucuucucuucuacuucuaaaacaacauucuuuucauucccaugaggcucuuaaaguuagaaggaaagugaagauuaaauucucuuaacaacauuuauucuagaggcacuuccuuuaauguauauggagaguuuaaugguaguagugauaguuguuuuaggaguagacaacauguaaagaaaauaaauaaauuccuugcauuuucuugggaagcugaagugucugaccugccaaauuuugcaacagggccauuuuccuuuuuauugagauuaaagcagaaaucucucuagaaagguuauguugaacacauacauugcuuugaagcagaaucuuaaccucuccaaguuacuucuuaucuuuugaagaaacaucuacugagcuggcucagucauucacuaauaagcauugaugaucaacuacacaucaggcauacuauuagacccuagaccguguugauccucuagccaacguuacucuaauuuacaacuaggucaguuagcaguggcccaauaucagaagcaacagcuucaaaccaggccaggcaggaagccauauggaacaaguccucggucaacaagugcaucucuuauugucaauagaaaaaacaaacaaacaaacaaaaaaaccaaaaauguacuugggugaauucacagcaauuucuuuguauacagaaaucaacauaauguguuuccuuuguuucugccaaauauauuaauaugaaaaaauugcauccaauuuaacugaugaaugacagauauucuguuuccacugccuccauggugggaggaaggggacagggcagagguggaugguggugguugcaguauguagccugucaccgagaugacauuucccaaaccuaaaucacucaguauccaguaaccacaguagugaguaaaucacucaguauacaguacccuuaaggugcucugaagguacuaaauuccuagagaagaaaagacgaaagccuauuccauagcucaaauuauuagcagccacaaauaucaaguucugacagcaacucuuuuccuuuuccuacuuccugcaugucaacucuucaagcacaguggcugcuucuuccucccuuccuuaaugauaccaagaccaguggcucccaaaccuggcuucuaagaauaaacauucuaggcuccuacccuagaccuaaugaauuccucuccugugguagaaccugaaagucuauuuuuaauaaaucccuuuuuguuucuaaguucucagaauaauucugaagaucagccugguuuaggaaucacugcugcauaccacaaguuuauggugauuuagaaagaaaacuuuuuaaaagggagcuguccacccuucccccaccauauauacacacuugugguugcuuaaacauuuuuuuaugagcaaugaagacagcauaacagcuuccucuauugccacccaaauauccagcaauuagcagacuagaccuacagauucuucacauucugaagcuguuaaaacaaacacuugugugccugguguagaguuugcucaccagcccccaugacuugcguaggcuccccuguccaucuaaaugaacaagccagggcugcugauuccagguagaaggauaaauaagccaaaggagccucaaucuuagcuuugaaccgcauccaaacuucagaggaaaagauuuacuaauccccuguuuacaauacaaaaauaauaacacaaaaacaaaaucaccugccauuagccaacucuaaucuaaucuuuccuugcaguaauaauuuuacuuaggguacuucaacacuaaccuuggccuagcauucacugaaaaaugaacuaaugacgcaggccuuauguauacgguauucuggggaaaaugcaacuccuuagaaugaacugggauaaaaugugaggauuaaaaucagaauuaccaaacaggaucaugaggagaaaagucuuuucauuuuccauccgcacacuauucugccuucacugggccagcauuaauauggucucugcuuuagaaaggcuuugacuuucccgcuauuauccuagucuugcuuuaacacauacuuuauauuagaaugcguuccaggaagcauauggcauuagaacuaggucaaccauuaaccaaauaacaggaaacugcucugcagcgcacacccuucaaaagcuugcuuaaugagcuggcucuucagaauauguccuucagugagguugggacuaacaggacccauggguuucuuuaauacugcaaggucaccuaauaccuagaaggcuucugcacauaguagacuuucaaugaucuaaaucauuccauugaaauguucaagaacuaaagucaaaggugaagaaggauguuuucugaaucugcuugaccaucuucaaagaacaugacuaucauccugguuccguugcuucauccuuccaauuuuguuaaauugauaggaaacacuacauacucaucauuuuuuuccauaacguuuuucccuauauuccuugaggcuuccauaccaccaauuuacccuacaaaauacaugccaccauccauuuagacuuaauaggucaaagaaagucuuggaaaaagaccugucuuccucuuucacauaaaaccgcaaaugaguuuccuccagaaccaauggccuugaaucacugaauauucgaguuugaauuuuucuuauccaauguuucagacucaauucuaugaaauuuaacucuauaaugcacugaagaucauucaggaucauacuagucaaaugucauccucacauuaguaucuuucaaaagcuaccgacaaacaaauuuuccuuggcuucuuuaaccuagacuguuagacauucuuacuucaaaauguacauaauauggauuguagagauggguaguuuucuuugauugagaacuuacauuaacuuucauuuuuuaauugaaugcuauaaaucuagcgauguuucaggcagaaaugacugcucagaagcaacuaagagacuauucuguuucagauauguaggcacuuuuaaggaacagauauuuaggagcaauaugacauuuuuaaaaaugcuagguuugguuuacagacuccauacauuuugacuguguacaucuguuuuaggcauugcucaaggcacuagugagcaagggagacucagccugccuuucuguagcuucuagucuaguccuguucaggaacucauuaugaaacaaaucagugguuggccuucaaaguugaucagcuaaauuuuaacugaauaagaucuuuuucccugaaaccagucaauaaggcugccugcacaccaacaugaagaguugcacacuggacuagaggugauagaaaaaaggcuuguaagacauuaaaacuguuaagacauuuggauucuagauaaucaaauagcuuacaucugugcuauuccuggaaaauuucagguuuacuauagaggaguuagucguguagcaauagucaaaacaaaaaaccagaacuucaucuaaggaauuuaauauauaaucuauuauagaauguucaagauagcacaaacagaggguaagguacuuugcuucccuuuuaccagauuuuggagucauguuucauaggggagcacacuggcuuugaaaagccaccauauaauaaaaaauauugcucagccucuuuagccaagaagguauauguuugucaauuuuaccaguacaagcuucaaggagcccucaauugggauuucauguaaaacucagguauauucugacuucuaaucagauagucacuguuuaacagugcucuaccuauagaaaguguuuaauacaaacucaaagaugggaggaaagaaaauuaggauuuuuugugugucuacuauaugucaagcucugcaccagagauuucuuuucaugauuuccuuuauuccucaaaagaacuuuacaaaguggauuuuuuuuccagauagggaaauuggggaccaaagauuaaaucauucccucaaggucacccaguuacucacugacucugaggucuacgaucuuuccacuauacaccauggcccucaccaccaagguccucacaggccuaccaauacugacagaaaagggucccccuucgauguguccucugcgcuagaaucaagugcuccucccucauaugagggcacgcugcugcucccaacauaauaaucuccaagccuaguguuugaaaagauggucuagaguuucucagagggcccaaacacugaugauggagcagggucaagccaguuccuaagauacgaagcaagaugaacucagcagguccuccugccaacuguccucguccuuacucaucuggcgaagcaugccaaggccugccuggaaugacgcaggaaagggucaccaugggugauccuauaccccuccaaauuguuacaaaauaaaagcucagugcugagacaggcuggcuccuugaaaaccugccaauauuguuuuguaggaaucagaauucuuaaagaaacuauuuguaucuaucaaccucagaguuaaacccacgagguacagaguaacguacagguauaaaggucaaaggucuaggaauguguggacccaauccaucuugggaguccagguccccacacugccuacuagacauuccuuuuuaauucacaaaggaaccaaaauguuuuacuuuucccuuauacugaaguucugacuacaaacacauuuaaauagagaaauauaggugaguaucaguuauaaaaggcccaacuuaaaccauuaauaaaaauauaucccaacaaccacucuuucuauucuagcagcuccacaaaacugacaccagaaaggcaggaucacugaaauuuagagcuacuuaacauaaacaaacacaaaguccacacuuggguuaggagauguggcuaauuuuagaugaguguuuuacacgggaugaaauggagccuuggacuucucacugguuuaaugcagcccucguaccuacauuuagccaacaccacuucaaaguuuucucaacuauggaaaacaagugguaagguagcugaaagaaggaauucauuucugcacuguuaaguucucacaggcaaacuguucagucugucccagcuccuggacugcacaggcccagacagaaucaugagcugaugcagagaagauuucagcauucgggaauaucugaagagucaggcuuugcagugcuuccacugaucagcaucugaggcaaguauucauucaagagaggcugugaaaauccuccugagcgggcggcagaaauugagagggcucuuggugguuacgagcaacucuguuugucccauuccuaggaaagcucuggaauacuccaugccuugaaugcauauagaacacagucucagauauuagaaacaauucaacuaucauguucaacugcuacaaggauccacgauuccaagagucagugaguugcucucucucccuuuaacacagcugugaaguccacugaauauccagccaaguguacuugugaauuucuuccccucucaugccagugagaggaccugguuucagccuagugguaugauguacuugcucaucagcuuucagguuuaacaagggaaaacaaucuaccccucaaauuguagaagcuuucuuuccaggggaacuagacaauccugauggcucucuccaguuacauagcaauuauauaauugcuaagcuucugcagaaucacuggaaccauucugcaggcuucuaccaacuacagcugcagcacaauguuccgagaugauugcaggcuuugaauggauggccggucucaaaucugagcacaaagggacauacaaugggauuccaucucaagcacaaagaugcuccugccuaaugaagcccuuucuccuccucccagucugugcaguaaacucuuuccuuugcccgcccuacauguguguggaaugugguuuacucuguuuaugcugacagguuccaaaagaggcagaaaaaucagcugaaguuuugccauggaccaugcacaagguaaucauuuaacacauaaugugaaagcuccagaagaggacaagagacaaggugggggguggggggggggguggaaagcaucucucuaggcuuccugcacuggcaugaaaugacugcuucccuuccuucugccagcuccaauccuucauguugacauuacacauccuguacuguagauccacccccaugcugcugcuugcccagcugaauuaucuccugcgucacagcggugguaacagaacugcuggcucggcagaccugaaagcaccauuucaaugcuuaaugcauucagcaacuggacacauuaccagugcgucagggcugguuuguggcccucucagcagccaugcaauacuugaccuaaccuucugcuaaccagauggucuguuugccucuugggaccaaaccauuaaacuuuacuuuauuaaauucuauccaaauguggggacaguuuacagcagcaugucugguucaucuccaacaggguugcuaagaugaaaaugaccuaaaaauaacuggaaacucuacuucacaccaacagagaacaagauauuuuggaguaaauauuuaaaucaucugccagauuacgaaccacagcagcacugacuauaugguuagcagauuauauuguaaauauauacacacaaagacguagaaaugaaugcaucuaaacaggaauccacuacccacagccuaagccacucuucaccauccccuggcuccaggcuauuugaauguggcugaggacaccuaucuccaucauaaucacucaauuaccaaaacaaagagccuaacacaacugugauagagagaucucauauccccuggguuugaccaccuaggcauacuguagccgugcuuaguacucacucaaaaggaggagcucaguaaguguucaaugaaugaauagacguaugggcacauauuccuuaaauaaacagcuucuauaaaacacaugaagacacuaaauuauuuccaacucuaucaucccacaacugcuaacuaagcaugcaaaaccaggcauuggaugaauggcaagagcaugccaucuguaccagaggcauuggguggccccuaauugaucauugcaaaugaacgguagagauggccauuuauugggccccuggcagggugcugaaugcuuuacauacauuaugccucucaggcuucaccagaaagagaauuccacuuuaaagauaagaaacuggagcagaggagcauuaugagcuugacccagguucacaaagcuaggaaguggcaggcaggggagugaauucaggucauaccccacagccaaucacuuucccacuacucuguagucacaaauaagcaaggauccuacaugucacgaacugaacacaugugacaguagcauucccaaauacaucucuuaaggaaguaaacaacuggacaaccuucccacucccagucuuuuagggguccuagggagucugggguucagcuccuacucuuucaucccauauuucuuacuguauugagggcauucuguacuaauaaccacugccacagccacagcuacaucucuacuccuuuaguuuugaguucuacccuuugaagaccaaaaaucucucauuuaggagaauccuagagauuugaacaccaguaaauaaacacaagguuuuucuuuccuccucaaauagcucuggacaaaguuagaguggcaacucuaaaguuuauuuauaauuaaaaaauaguaacauucuggcuggacgcaguggcuuacaccugcaagcccaacacuuugggaggccgaggugggcagaucacuugaacuccuguucaagaccagcguggccaacaugcugaaaccccaucucuacuaaaaauuagccaggcaugguggugcaugccuguagucccagcuacucgggaggcugagguggaggaaucacuugaacccaggaggccgggcuuacagugugcuugagaucaugccacugcacuccagccugggcaacagcgcaagaucuuaucucaaaaauaguaauaauaaugauaauaauaauaauaacaacaacauuccaaugacauauuuauuucucuggaaauuucccaaauguaaaaaaaaaaaaaaaaaaaaaaaaaaucaugaguaguuugcuuguacaggugaaaaaucacuauaugguuuuaccaaagaaccacuuacauguucuucaucuuucccacuaacauucacaccaccaccaccacaccaccaccaccaccaauaaagcuaccaaugaauguccuuuuggccagacccaauaagguaagucugguuaggcccuaccaacaccauuccacguuuucuacauuuuaaaauaucaucuacccuuaaaacacucuaaaauuagucuccuuacccgugaggucucaaagcaucugauauuauaguacauuaguaagaccaaguagauguggacuauugaaauaaacauuugcacagagaaaaccaaagcauuucuaagccaggcuauggggcaguccucaaacuggcuaagagauauguaugugaguagagcaacagugaggcagacaacauuuauauaaacagcacagccaauauuuucucugcaauaaggacaauuuucuucgacauaucauuuuugccagaaugaugccaaacaauaggaacaguaauaacaucuuucuucugaaaagcucagaaaacuucauguuuauuaaaaauuguuccccuacaacacuccagggaauagcucugcaaggucagguugaaggcguuguuaccauauaaauguacuuuuuccaagaggaaauggcaucauucucggguaguuuacaagcuccuacugaaugcacacacagcaauacagagugcugcuucauccacagaacaucaguugaagauguaauaaagucuagcugggaauggacaacugcagcaaagacuacucaucaguaaagggacacacagcacaaaauuaaacaagcaggauuccaaaagcugacuuuaagaccaagaacaaaauaccuaauauacugaccauagauaaauggggcaaagcccuggagaagaucucugccucaguuucucuaucagugaggaaggaagaaacuaucacuuucuuccuuccuggccauuaugagccaggacucuuagacacauauuauuuuuuaauccuuauguuaguucuacagauucaaauuauaauaauuucuauuuuacuggguaggaaaucauggggacagaaaggauaaaugacuuacucaaggucccacagcuaguaauggacagagacaaauuucagccucagcuuguguggccccaaagaguauauuccaccuacuacacaucacuuucuuaacagagaccccugcacagagaacugcauuuucaccccagaaauucuaagagaugacuauuugcacucuugauguuuuagagaaaaauaagugccuagagaguaucuaucuaucuaucuuucucuauguauagagauacauguguguacauauacauacauauacauauauacacauauaaagcaauauauacaguagcugaguuccuaguuguucuuaguugcucugaaguucagccauggugugcaaguuucaagugcauuauuuucccauauaacugcaugucagaaagggaagccugccaaaugacaaucuggcccagugauucacagugucacacugacauacccacacuguaucacuucugauacagguuguuguuaguauuuccuggaaaucauugacuucauuugggagauaaacaguaaacaacgucccuaguaaugacacguucuuuuuuauacuagaauacacuggcagcaaauuucauaauuuggaggaaaggaaggggugauauaaaguuaaaaguucucgauuaacaguucccucaaaucuuagugaucauguugcuaaggcauuaucuuaaacacagaugacucucuuuuucguuuuaagauuaugccuuauaaaguaaaagaucuauucaaaugaaucauauucaaucgacuuaacagguuucaugugcugagguaaauaacaauccagccaauuugggauuuuuauccuucaagauuccuauugcugauuuaugaaagcuuugcaguuauacuugaccccuaaaaacuuaagaauuucuuuuucuguagacaccaacacaagcuauacaauaugugcauggucacagacaaaauaauauugccacgaccuuucuacuaagaugggggaaagaucauggaaagggggcaagaggggaagaaagaacaggcagaagcacauuggaaacaucagauauuuaccguugagaagcugcuucaaauaagauuccuaacacuuaccuaugcuggggucaauuuugauaauuguaguugaugucuagaaaugggguuaugaauauaauuaucaugaagcagcaauugggcaaucaccaccuaauuaagcccacugacuagauuaucuuguuuuccccuaauaaucaccuaacauuuaacacuuguuaauuucaggaccuaugggugauguucauucauuauuaacaagcuacagccacuggucagaaaagaaugggugagguauucugaaacacugagucaaccauggggcagggaugaauuucacaaacagcugacaucuguucuucaacaccacuucaguucucaggccugcaaaauugcuaauuggaggcaaagccacgggagaagauggaaugaaugacaaaaacuuccacacaaguggaaggauacaauuccaccuccuuaaauacgugcuauuuuaugugaucuauacaguguacuuuuuaaauuaucauagaaucugucuuugaaaaugugguuuucuuuucaagagaaugaaugauuccuuugccaggccugcauacauaaacuuucuacguuuaccuccuuagaacauaucccaagcuuccucuccuauggagccccucaaauugaauguguucgcaaauucccaguucucacuguauccacaaagauauguugacccaguucaccuuguuuccugcaaagcaguuccugaggguagccuggguagguuuccucaaagaauuaaaaggaaaacugaagaaacccauugagaacuggucuuugagacaggcugcucucugagggauuauccuagaaugcuaggcccuacugccuagggucacaguuuacgcuguccaaggcugaauggagucccuauuccucuaaauuagaaauucugcccagagaacaacacgcuucaguuccauuuuacucucuuuaacuacacaguucaauuguucacuuuauauauuuuuucuaagccuuuuuucuauuuuaguccuuuaucuaagaaaauaacgguuuuuauaaauuugguagauaaugauauggaugagaaguaaaaauggaugacucuguggccuucucuaguacacuuuauaaacaggacauguguuuauccuucuacgaagguuuugauuaugggucugucuggagaccagagaucaacuggauagauccauagcaauguuaggauuuuauaaaaccaccacuaguuucuugggggcugaagagucuauucagcaacuaauguccaaccaccauuugcagaaaagcuacucucucggauaccguagggauaucuggaucugcuccaucucccuuagcacagugugucacucuauuagggacauuugugcucauccaugaacuuccuuacuaucuugugauguuucagagacaggcaaauaaaaccaaagcacucaucacaucuccaugaucuaaauagagcacauggugaucacaaaaagggguggaggggguaucggcacccacacuuuuaagagaaucugcaccauguuccaaaaaugaccauuaaagaauagaacuaauuuucaaacaucugcguagcuuuugagaacauuucucaggcugauaguaaccagagccaauacagggcacugaggcuucaaaaggggcccuaugaagaaaaaaaguacaacaccuuuucuacaaaaaaaaaaagucaccagcauaucuuccugccauaacagguagguggcuccuuuuuuucugaguuugauauaauuuuaaaauguuuauuuccuaaaguguccccuacauggugucuugcuuuuuuucccuaucaucuccucuacaauucagaaaagggcgcucuuaaguuaaacacacuuccucaagcuauugcaauaaguuauaucucucauaucaaauaauauauuacaauuaauuuuccauuauucucagauuuccuucuagaacuccaaggauauacuccuggcauaagcaacuggaagagauaaaccaucaagaacauaagcuauuagcagacuaaguaauaaccaaggccgggucccaucagcugagagccaggccucuggaggcaguccccacuccaugugaauccuggcucccccacuuugcagccucaugacuuuggcuaaauuacuuuaccucccuaaaccucaguuuccucuaccguaugaacagucccugguucauauuaaauguuaaaaaaaaauaaaaaccguuguccaguauuaacuaugagucaguccacgagggaagacagcauuuuuuaagguccuaugugguauucccacucuauagaguuggcagauuuuuuugaugaagcaaucauauuuauuuucuauuguucuuacccaguauuagaacagacaauauucaauugacagcagaaaggggggaaguucuugcaacugaacuccgauauuuaaauuaaaauggucuuuucugaggccgggcaugguggcucaugccuguagucguagcacuuuggaaggccgaggcaggcagauugccugagcucaggaguucgagaccagccuggacaacacagugaaaccccgucucuacuaaaauacaagaaauuagcugggcaugguggcuugugccuguagucccagcuacuugggaggcugagucaggagaauugcuugaaccugggaggcagcaguugcuuaaguggagaucgugccacugcacuccagccugggagacagagcaaaacugucuccaaaaagaaaagaaaaaagaaaauggucucuucuacaaagacucccuucucacuuauuguuaucaaauacuaauuagucuucagagaagacuauuuaagauagaaaccacugaagagaaaagauucugggugauaaguacuuguagcugguaucuaucuuuggucaucuucagcuauaacccagcauucaaauuguaccccaaacgaaggacccuccaucaggcccauggcaaucuggguugaaugauuggugcucaauugcugacuaauuagucauaacacagagggaugauguaauuagggauuagaauggcuaaacauucuggaccacaguggccuuauuuuggauuuuaaaaugcugggacuggaaggacagaccagccugugacgcuuggcucaagucaauggcugaaacccaaacugacgccagguaguagucauaguccauuccuuuccccucugaaaaggcaugucuuuguucuucauuucuucuaacacccaggguguagguagagaagcucuauggaucacuucagagaggacuaucacauuuucuguccauuaauaaugcagcuguuuucugcugugcucuauucucuacuucguucguuuuccaggaaaaucuccaccuaggccuacuuaaccaguucccuugaguuuccaucuguccuuuaucagaaaggcuguaauuguaaccccaaagucacauaaauuguccuccaaacccaauucuauuuuuuacaauaggaacuggccaaagaauguguaccugagcacuggucuucauauuucacauguguuagguaccaaauuacaaggucuuuuucuacuugcuauaaucgcuuucuuaaaagcaaugccuuacuucuuccuguaggaucuuccccaguggacagacuucuucaauuuggcuagucaauuauuuuccugcuucucuucuuuuccuucucccauccaaccagucacuccuucccagcaaauuuccacuauaaaauuacagcaaugcuuuagccuacuuuccuguuagcuuuaacaaccuugucuauuuucuacuugugcugaugcuacuguuugcuuuucugacaggcuaauccacguauccuuucaaggccuaacuucccuaccaugauagcagcuggagcucuaauucacaggugccuuccaaagcuuuucauuagcaauagaaaugagaugguuuagaaacucauuucuuaaucugcagguaaguauuggaaccuuugugcagcaaacaucuuucaaguaucccacauugugccacugaacaauuauuuuuggaggaauaaguacaauguuaaggcacauuugcaguguuaacggggagaauuuucccuuagaggacaucggcucccaccccccagccucuggcauuucccaguucaaaagagaaacacucagcugacaugagcaaaacugaagaauaauggcauuaccuucuuaaaucugaacaggaaaaagaagaauuccaaaauuuggaggccuuagcguguguucugguucaacugcucagacgagaacuuaagagugaguuuggccuuccccagcugggcucuguggcggcuaagcucucuccacaaauccugggcuuuauuacuucugacacaguugucucaccugggccuacagcuccuuuugugcuccaaccaagcugaacccaaagguaagacuucgcuuccucaucuugggcaaaugcuuaauuuccuacuaagugauccuaaaacauucuaaucaggaucuauugguuccuaguagaauuuucuccauuuuuccugguguggucuuuguuaaaauuugucuaugugaaggucuagcaaauaacuuccugaauuacacaguucucaucuucaaguauuuauuuuuugaacaaauaaguaccugucaaacuuccuuucacccuaaagaacagggucuacucuuugaauaagguuggggguaagauguggacaggcgcagcacaaguauuuuauuaauauccagaagcaacaugcagugaacugaacaagcaaacacaugaaagcaaggaaaucaauaccaaaauacccaugaccuggcacacaaaaaaaaccuucccuccaagaauaacucaagaaaaaaugucuccagcuaggaauuaggcaagaaugcuuugaagacaccaaguaaugugcucaccagaaguaaaaggcaaugcauuuguaggugacaauacuagcaccuccucacaccacaccacucuauccuuuguccuucuaagccgugaaaauaauuaacuuuguguuggaaucacacauccaaacacuuuaaaaauccuguacgugcuucagcugaugagaauaggaggacuuagaaaaaagauaaauuuuaugauagcauuuccaagcacaaaauguaaauccaaauugcuuccaauggauuucccuuuuaucagugugugcaguucuccaaaugcaaaguucaaggggaaaaaaaaaauccaaaagagcuuccuagcauacugcaaauacaaucuaaauucauaaaaacccauuuucccacauuuggaaacuucuccugggucuuauaaauccaagagacaguucaacuuacaauuaucuucucuccaaugcccucccaacccaaacuuuuuuuucuuccuuuaguacuggcaugcaaaccaugcuguuuuaacuucuuuccuguucucccaguucuucuggaacauuuuauuuucgacagucaacucauuuggaggagugccacacugagguucaacuguuuacagcguuaacuguguuucugccagaaguccacauccagcacuaccuucuccagacugccuccuggauuaaaaauugaugcauucguuuggaaggagcuuagaaaauguggaaacuuccaaacaucacucuucuucuuuacaaaaucacuuuugcucauccaagaagagacagaaguggaaacccauugcacccuuccuuacaggacugucccauugcucaugguuaaaugucuguguuguuaaaagucaucuuaaggaugauuucauguauacugggaaaaugggaaaagguuagccauuagucugcaagagaguugggcuccaagaagauacacggagggcacauuuugaaugaguaagaacauuggaaaaccaccaguaauuguuucagacuggauuucacccucucagccauucaucaguauuacaaaauggcaucucugaaaggagccaauuuaaaucugcaccacguugcaaaauagauccucagaguccaauugugggcacuauuguaaguugcaauagacucacacaaacuuccaaagaagggcauuugagaagggcucccaagcccuuggaugauggaaugagagaugagagcaggaaagaugaaaagaaaaguacagcuacaaacccgggagcuaacacuuuacugaaugucacaugaacaaaauugggcucuggaucuaugaaugaaaccacgcucaacccugggcuccccaacguguuaaauccaacuaagaaaaauccauacuccugcccacuaguguaugaguacagaguuucucagaaagcugugggcccuggagaagagagcagcuauuucacaacccucaacaaucaaaugcaaugggguaguggaaagggcacuaggcuggagucggccgaccugaguucuaggccuggcucgguuacaacugaacuuucugaccuugugcaagucacuucaugucuuugugccaguuuccucuucaguauaaugcaaguggaaggaggagacuucaucuaaaugaucuagggccuaaaacaacuagcuucuaaguuggaaguucugccuggugaauauuaaauaacuaauaguccuuacuuacaguguacauauuugucacuuuuaaaauaauuuugguaauuucugcaugagaaauaauauuuuugcuccucaccccgaaacuucaguuuucacucccuacucccuagaguucuuccacauaacacuaagugccucuuuuccuuucuuucuuauuuuuguaagcaaccuuccccaaacuaagacuugugcuauuaaaagagcuuagaacuucccauuuccuugcaagggcuaaaauuaaacuguccauuccuuagggcccaacauaacaucugccagaugucuuggcauaucacacaaggagaggaauuuucuucuagcauuaucuacucuccucucuguuuucucauaaucaauuaauaggucaccaacaccuagcuaauguuucucucaaagccaucauacuccauaaguaugugaaacucacaagauacuugcuuuuacacacacugauuuuuuuuuuuuuucaguucacuggauuuuagcuuucagucauggaaauagucucccuccacuucugcugaauauaccaaucaucccagucauacauucauguuagauccuuagcaguaagaguccauuauguaucuccuauuugugacugcggcauuaugaaacagcaucucuguucuccaauuaucaauuuagaauaucugauacaguuuugucaauuucaugaugcagugaaguguaagucugaaaaaggcacauaccauaaagaagauaaguaagguuaccuuaaccaaguaauugcaacaucaaggaauaauuuaagacagacuagacccuauuaaacuccaucacacagaaaaaaggacucuuucccauugcaacuuuaccauuccuuucuuucaggaaaaccgaccacaaguacucuaaaguccauuaguagaguuggauuuuuuuucuucugcugucuuccggaagauucauuaggaagagcagauaaguuuguuuuuuuuuuuuucucuaaaaguugucuccaacuccaaagaguaagggggaaaaaacaauuccucggggaauauggucaaugaauuagacugacauaaauccaauaugagaaauauuaugcaaugugaggauccaacaagaauuuuuuuauggcaggaugcaucauagcucgcaaauauuucuccaugauuucucccugugauauauuagagccauggcaaaaaauuugcauaauaagccacaugaacuugucucauaaacaaaaaugaucuuugagcuuugacauuaaaugaaaaugucugauuuaauacuuuuuauuucucucauggugguuuauucaaaauacuugucuuaauucaaauggguaugucuagaaaaauucaaaaaaccauguccuuaaauauuaugguguuugccaugcuggugaagggcaucagagauggaugugucuuagauaaccaguuagaaugcauuuccaaauuccaagaugccucuuaaauaccuauuuuuucccuuccagaaaaguucaacucuaagacgccaacacauuugguugcaaaguaaaaaauguggagagucaaacagcuggacugacaaccagauugucagauguuuccccccugcugaaaugagcaaaugaaccaauuguccugcuaucaauaacaauaaaaaaagauaucaugaaaguuuguuucaagaucaauauauaauguacuuauguuuacauaaacauacaugguuaauuagauguaaaauuaucugguaauuacuuuuccaaauaacucuuuauccauugcaacugaacuucccaguuuggacacccaguuuggugcauccauuuaugcauuagcaaauuuaaauauaauauuggcgaaauuucacuuaagagcaaaaguaaugguaucaaaagauaauguucaaaaaugaauaauaaaaguuaugauuccaaguaggauuuuuuuuaagugcucuuggagaggccuagguuuuucauaaaggagcagagaucuaacagaaguauuuuuaaauaagcauacacgucaacugaaaccauacauuuuugucugcacaaacaugguuuuacuucauugaccauggacaauuaucagcuaaagaaccauguauuuccccucuccuuucacaccccucagaagaacaauaacccucaauuaaugacacaacaguuugguuugaaaaaugugauguugucauauacagcacugugcauuuacugagugacagugcuaccagcuacucaacagaauauaauuacaucuggaaucuaaaaccacuucaauauguacaaaaauauuuuagacauaaggaacuuuacacaaaaaaaucugacacauaaugagaaagcaaagcaagaaaaaugcuguuguaaguugcucaccaauguguuccuuauuucuguugaagcugguaccuuucuauauuucuucuuaguugaaagcaagguccaauuagccuccuuagaauauauuaacugguucugaaucuccuccaaguuuucauuccaccguggagcccuccucaccuaucuucaacaguucaucuaaaauucuuccaacaucuucccucauccucaagauggcuaccucaccuaauggaaaagcaacaucuucaugguuggcuuuuaaaaauuccugaagcauuucgggauuuaguucuuugcuugggucaauuauguacauucucuaaaacuaauaugugaagagcucccaucaauguguguggacuaggguagcacuggguccuuuuuucaaauuauccucacaaaaugucuuccuacaugauuaauaaauuccucccaauuaaaaaggugaagauaccuggacauaagguuuucucaacugacaucauguuuuuaaaauuuguuuccauagcgacauuguuaagaagacauacugauauuucugaagacuuaagaguacuucagaacacagaaaaaauuagccgacggaaagggaaaggggaaacaaagaaacugaaagaaggccuaacauacaaauggaacgaccugaagagaaauggagaaccuggagaaacugguguuagccagucuuagaguuccucugagaucuugcaggauuauucuuauuauuuuuuauauuugcagaaaucaacucaaaucagacaauaaagucuugcaaugcaucaaaacaugaugauaaccaaacccuagaacucaaaaaaaucucagcuuagggccaucaccaucuucacaaggaggaaaucacauuuccuggugacuuucaggagaccuggagcagcuuaaaguugugugaagaccucaguggaacuguuuuaagguuuuugccuugccuuuccugaaggaggucaaaacccuucagguccacucaaaaggagaaaaaaaauuccaaaaguuuacuuuaaaauggaaacaaacgccucaauaacuugugaaagcacucuuugguggagaaaaaucugaggaacccuuaaaagcccucauuuccuugcauaaugaauagacagugaggaaccaccacaagguuucccucuggaaagagagaaggaguaggcaagcaagccuccuccuccuccagccaucaccaacagagcuucaaaauggagacauccauaauuuuauaaacacuucucaucucagcuuugucuccuggaaacccgcucuccuccauuuucugguggaguuacaacaugacacggcuuaccugacucaguucccagcucuuaaccaaacuagucacuuccuccaaaaaccugcaagcaaccuccagaaacaaaaccaaagcaaaccaaacagccaacacagacacucagacacagcccccgggagcccugggagaaagccccaacugguuggucuuuccccaucccagacgcgugcuuaaaaaugaaacuuuuuuuuuucuugguuggggaggaauauaaaaggaacuccaggcagccucccucccucccucucuguagguuagaagccacaaugaaaagaaaacgaggguuccuucaggaauggugaacagccuggagaaugaacgugagaaggagcuuuguguuuuggagucuggacuggaaccaaagcagacagcuugcaaauggaggacagggagauaaagaaagggaaagaggggcugcuccaauggggggcggcugcggcuuccccucgugccuggaaggagggcagaccccugggaacugcaccaggagugagacgcccccccaggccccugccuuccuuucucccuuccucagaggagagccaagcguguguaauggcuucuccucuccagaaaccguuguccuccuccaccagacgcuucugaaccuccagccuggagacagcuccucagccgcuccugaaccugcgccccccacccggccggugccccccgcuccucgccucucuguucaccagcagcaccggcaccagcagcugcagcagccaccccccgacacaucccgaccccgcaucccaacuucggggagagggagagagagagagagagagagagagagagagagagagagagagagagagagagagagagagagagagagagccaaauaccugaggaagaggggggcugccaauccgcacggcuuugccaucgggcgggggacaggcagacagaagggggaaaggaaggagagggacagagaaagaaagaggucaacccgcucaggucggggccgcucgcacggagcucucccuccucugacccucgcucgcucccucuggcucucggcucaggucuccggccucccgcccuccgccccccucugucccuacuccuguccccacacucggagcauccguccuaagccuccagcucucuucucacucaucuuucauuuucucuucucuucauagaacuacacgaaauuaauuaagccaccgcgcucacuccccccagcaggagcagcagccagcaggaaaagcacagccaccuccacugccaccacuaccaccuucuccuccucuuccuccuccuccucuuccucccucgcuucuccuccuccucuuccuccucccccuccugcucucccuccucccccuccuccucuucucucucgcuucuucuccucuuccaacagccaguccaugcaggggacuuccucuccuccccgcuccuccaacccuccuuggccgaaugaaugagcgcguuugugccuccaccaccccgcgcucucuuccccggagcacucggaccaccccgaggugguuguuaauugcaguaacuuacagaagaagcgucccggcgccgggaggugcuucggguucuccagccccaccgccuccuuauccucuuucucuuucuccucuuccugcucggguuauuguuguggaaguuguuugggagucucaugugcuucugccgggucucagcaauggaggaucgccaucuucccugccuuccucggcuccucagacucgcugcagcugcagaugaccugagauauccgucucucucccucucucucucucucccucccucccucucccucucacucuc

SEQ ID NO: 13974 - RNA, 4921 nt, Homo sapiens
cauuauucagauaaaauauuauagguuuauuuaaaacuuaauucucaccuugaguaugcaaaauacaaacuccacaaaauguucauuuuacuuuguaguuuacaaauauacaaaauagacguuugcuuaaauuuauauuacauauuuauuaaggcaaggaacuauauagaaaaacacauuuguucugcuuaaggcauacuugggaauaaaccauuguacaaauuauugcacaucugaaaccacagugcauaacagacugucugcauaaaaaugcuaaagaaguaaaccagguauauuaccugacuuaggucauaaauguugaucggaagacaaauauagauuuuccuugucaaaguaugcagcaguuugaaaacuuuggcuuccuuguuugguaccuuuagaaccaagacucaccaagcaccaucauuuaggcuauuuaaacauguuuucuguaccugaauuucuuccucuucuucuaacaucauaauaauggcuuuuagaagguaaagagaauacaaggugaucuuuuaugcuuauauugcaucaauacacaauucaagggaauucuggucuucccucccccaacucacggauauaauuuauacccugauauccacaacuuccagucacccccuuggcauuuuguaaguccaggaauauucaagucggauuuagaauuggaaugauagaagauccagucacagaccccaucuguucuuugauuuuugucuuuuggauuccucauuuuuccugauuauccacucacaagaugacucaguugggaacuugaccaugauuguagugcuuucuggcugggcuccuucccucaucgggaagacagugugaaaaguaaaaaauacugaauucucuucuggcagugugggucauauccacugucugggauuuaaaaaugccucuucauguguaaggcgaggugguccgaccuggaaaaugcucggucgcauuuuuggcacuggaacgggcggugccccguguguuuacgguagugccuggucaguucaucugagcgggcgaauuuccauccacagccgucccagucacagugguaagguuucucaccuguaaagguaaaagaaaaaaaaaauugacgcuauugcuauaucaaagaaucgccccuuuuaaaaacugaaggccagauaguaaaccaacucugacccuauccuaaagaaauccaggaaugucuuuauaccacugaagggguguauugaauuccauaucauaaacagaaauacauuccgugcuuaaguauuuggucuuguuuuuagggggucaguuaagcacacaaccaccaccuacaccuauacuaauguuucaccaaaaacacacaaacaccaccuaaaccuauacuaauguuucauuugagucaaggcaucucagugguggaaaugaaauuuggaaauugugauugguagugugcccaaaccaugcaaucuuauuccuacuacgacuggggauaaaaagccacagguggcuacuuuuuuuuucuuuaccuuuacguuacugaaugcugcaccuaaacgacuuuggguaccuacuuacauugacauggaaaugcucugcagugacaacccuaaaucagaaucuucccagcaauuuugaccaucauauucuuggaauuuaaaauaaaaccuucugcuugugggggaaaaaaaauaaaaauguaaaucaaaacgaacaaaaaauaaaaaauaaaaaaguaagaccgaauuguuacgaccagaauucaaaauaacaaaaagggagggugaaccugggaagggaacauuaaaaaacgauuuuuuuaaaaaagccaucaugcuuuugcauagcaaaguauaauuucuugauuauaaugccaagcuaggagaggcccacagaccgcggggaaucuccugccuuuuaaaagccuaacaaaauugcacauucaaacacagauaccauccaucaagcaaaaggcuccugggcagaaaaguaggcgccgguuugcuguucucuccagugaucccggagaucaaggcgauagacugcccugggaagccaaggaggcacugaggaguguccacugguagccuauggggcuggaagcuaaccugggaagucaaggaggcacugaggaguguccacugguagccuauggggcuggaagcuaaccccccucccuucugcaguuugucccccuaccuguguggguucgcaggugugccuugagaugggaacucuuuguguagguuuugccgcagcccgcguaaucacaaguguggguggcgguccuuuuccggggccacgaucgucuuccccucuuuggcuugggcuccucuggcaugcaggaaccggguggcaugagcucuaggggugaagaagguggggugagcaucaucccgugugucccgaaguggggccagcacacacagggcuccccagcccgagcuacaaauccccgggacugaccuugguaauggagcggcgggacuugcggcugcaucugaucgggcaggaaggauggguaauugggccccggguggggauggaagccgggaggaagcggcagggcagggugacagucccugcugcucagcacuuccucaagacccagggucgggguaguccugcuggggagcugccgccccagggggaagucgugugcagccggccgguggccauugcugagaggggguccagcgcccaagugggugcacgaagagaccgccuccugcuugaucuuggggcacgugcgcggcggcccgccguuguagggcgccaccaccaccggguggcugccgucagggcugccuuugcugacgcugaugaccgacgggcugccguacucgcugccaggggcgcucagcgacgccuucagcacgaacuugcccaucagcccgccaccuggcggcugcggcugcugcggcggaauguacaccggguccaauucuggccgcaggagcucggccacgaagccgcccgaggggcucacgucguugauguccgccagguugaagggagccgucggagggggagcggacucccugccauagaggaggccuccgcccgugccgcccggcgccacgcccgggucguucccggcccggaucggauaggugaagcugcagguggagggcgcgcuggcagggccgcugcucgacggcgacgacgaagaggaggcugacgcugacgaggacacgguggcggccacugacuccggaggaugggucagcgaauuggagagaauaaaguccagguccaggagaucguugaacuccucggucucucuccgagguaggggcgccagguugcuaccgccgcaagccgcaccggcuccgccgcucuccaggucuguggccacggucgccgccgccaggucauaggggcggccgggaagcacugggggaagucgcuucaugugggagagcuccucccgccagcgcugcggggacagggcgggagagaccugucaguggugguccccuguugccacccgacauacugacgugcuggcgggccacgcgcgacugcaccgcccagacauggggacuggucaggcaggaagcacccgggaacccagggcgccagcgcugcaaucucggcccacucccgggucgaagaagaggugaugcgucuguauugcggguguuauguccugucugcccaauugcgugugagcgagcgccgcggcuggucccucccccuccaggucccguggacguccccggaauuggcacaccgaggcucucucggugcgcucucgccacggggccgccuacgcgcuaaacucacucuggcccagccagugucuggggacgcggccaccucccgcccgguggcccgagagcgcccgcccuaccgacagcgcgcccggggacuggugaagacccggcuugcgccccaggcggcuccgcagugcucgcaccacgggcauacacagcugagccaaggacacggaagcuaucccgggaagguugcggaguccgcgcgguggccgcuccuuacccucguucaguggcucuuggugaccccaaggcuccgcccgcccccaccacacccacgaaaacccaccgggcguucccggcggcccggagcgauacucacguuauucggggcaccugcuugacgcagugucuucucccuucccgccgggccagacgcgaacguggagaaagaugggagcagcgcgucgcugacagccaugucagacucgccagguggcugccugcgagcaaggcagggagcggagacaggagagucaggggcggcuuucggccgucguuccggcgcgucccaccgguccucaccccucccugcucccagcgccgcgcgccucaccuaccucauuaaugugggggcccagaagguccucggcagcccgaagcagcuggggcaccugaaccccaaagucaacgaagagaagaaacgaagccaaaacccaaaaccccaaauuggccgagauccuucuucuuuggauuaaauauaacuuggaagcgucuuuuuuaaaaaguuccuuuguauacaaaaguucuuagaaaaguuguaaacgcaaaaauagacaaucagcaaggcgaguaaguagguccgguggccgggcugcgcucucuuccacucagcagcgucccccaccacugucgcggucgccucgagugcugccgugggcgcaggggcuguggccggggcggugggcgggcggugccgccaggugagacuggcugccguggcgcggagcugcgaacuggucggcggcgcaaggcgcggacuccggugaguuguguggagcgcgcgcggccaugggcgcgggccacgggcgggugggaggguggggggccagaggggcgggggagggucacucggcggcucccggugccgccgccgcccgccaccgccucugcuccccgcgcgcccgcagacacguucguucucucuggucgggaaacug

SEQ ID NO: 13975 - RNA, 65846 nt, Homo sapiens
ccgccuggugacgucacucccgcgccgcacucccagugcugcggcugccuaguugacgcacccauugagucgcuggcuucuuugcagcgcuucagcguuuuccccuggagggcgccuccauccuuggaggccuagugccgucggagagagagcgggagccgcggacagagacgcgugcgcaauucggagccgacucugggugcggacugugggagcugacucuggguagccggcugcgcguggcuggggaggcgaggccggacgcaccucuguuuggggguccucagguaagcgauccauccaggguaggggcacgggaguggaccucuccgccggcgguguccgggugaaggagacccggagccuccucugccugcugcgggccggggacuggagugcgggcugcaccaccucuuuccuagagccuuaaauucuuuuugcagccuugccaccugcuccaucgggggcgcugggaggcgcgacagcccagggaugccugcugccccuccagccggacuuaacccagccucuugauugcuugcaggggguugauaauaacgcugaaagcgagaguauuaauucacgauggaaggcggcgguuaauagaggcucgggugcuguggugcggguccuuucucgcgugugagacuuuuucguggaggugguguccucugugcuucuccaucuaacgugguguuuuacguggcuuucucucccguuaacgaugaucuccguggagacaguggcugaguaaucuucagaucccaguacuuagcaagugcucagucgguguuggauguaggccacaaaccggaucguaaagaauucaacuguauauugacagccacggaacuaaucaaugaauagauccguaugaagaguaagcaaaaaggcagcaaagacaguuuuucagcuuggggacauagaguagaaauggucuguccccaaauagugggaacugucauuugggggaagaauagcaaguucuuugcuuuccaggucgcauuugaugugcaugugagacaugcuugugauucuaucaggagguugaaaauguggguuuagugguaaguuugggcuaauucagucagggcuaggcauuuaggccuaaucagcguauuggugaucuaccugguauauguaaucaugcaugugaugucuagccaagagguggauagucgaaggagcaagggaagaaaaugaagcaguuaucaggaaauuaagagagaauccacgauugaccuuugguguggagggaucuuuagcacauuuaagaacugcgaagaguuugaaucaguggaggcaggaagguuggagguugcagauguccaagaaagaguacuaauaggccuagguccuguggcaauauggaggauauuccuuuccuagccuggaaagaaguggagggaagucuuccuccgagaagauaagggaauaaggcugaugggugugaaauuucagagaaacuaguuuugaggcguuuuuaugauguuuaaagaugaaaaacgcagccaggcacgguggcucaggccuguaaucccagcacuuugggaggcagaggcggguggaucacuugagguuaggaguucaagaacagccuggccaacauggugaaacccugucucuacuaaaaauacaaaaauuaacugggcauggugccgggcgccuguaaucccagcuacuccggaggcugaggcaggagaaucgcuugaacccgggaggcagauguugcggugagccgagaucgcgccauugcaccccagccugggcaauaagagcgaaacuccgucucaaaaaacaaaaaaaccugcaugauauguuagagguucaaguaauuucuagcaguucuugaauauaauugucaccaaaacuuacuaaaaucauugucuuccucacuuccaucauauauaaacuuaccuuucucuuaucccacauuauauauuauauaauuccuaugacacuugacauuaucuucuguguacuauuaggauugauucaucuuuauucuuucuaugucauacauauguggggugccaagaugagagaagucuccuuggauuaaagugacaauaagaccggugugguccuuguaauugcuaccccuaacauaaguuagggacuuacaaucauaagccuuaaagggaucugaauauaaauaacuagcacaguaacauuuuuuuccccuacuuagguaauguuaugcauuuaagcaagccugauuuugccagaccaaaguagaugucuuguuuagcacucuuuucucacguuuuauauuguccugggaaaagccuggccagaagaacaaaguuacuggaaguaguuaugucaggucaucaggguccuugaaauguuggucaucauuuugaaguaaauuguugucaugucccaguauuuucucuuccccuuuagaacaguaaaugcuuuucuaucuuugauuucaguuuuuuuaugaauguauaaaaccaguuuauaaaugaauagaccuggugaauauuaaagucauuucagauucucuucaacugccaguauauaaaaauggauuuucaaauagugcuaaucagugggauacccuuuuguuuuuccucaugauuuuauaaagauguccuaauaugcaaaaauaaaauguuuccccauucauuuguucuuucaacuuucccaaaggaauaacugauauuacaucuuuuuugaagaaaacauucuaaaguugagaaucuugccucuccuaaaaagaacauaaaauagguuucagaauuccuaauuuguagaccauaacuguauagagugggucagguugcugcuauaauccauacauggguguguacucagagagguaaguuuuuucuuuucuugguuauucugauucugacuaccacuucuucacccccugaaucauuucauuuaaauaaauauggucauuuaucacuauuaagcuauuuauuuuucucuuagagauuaaugauucaucaagggauaguuguacuugucucgugggaaucacuucaucaugcgaaaucugaaauuauuucggacccuggaguucagggauauucaagguccagggaauccucagugcuucucucuccgaacugaacaggggacggugcucauugguucagaacauggccugauagaaguagacccugucucaagagaaguaaguuacugauguagaaugccagcauguggguaugacccuugauuucucuucuuccaaauuucuuuccccacauggucuuucuuuauaucuuauugaauuuauauccucccaaauaaacaucuuuugcuucauauauaugccauguuagacauagcuuaaaucguaauccuucuuuaacucugcugcuauuuuaaccuaagucaguagaacucugaccuuacuuuuugagugugugccguacuuuuuacccucuuugucaugcaaauucuguuuauaagagugguuuuuuuuuuuuuuuuuuuugagacggagucucgcucugucacccaggcuggagugcaguggugugaucguggcucacugcaagcuccgccuccccggguucacaccauucuccugccucagccucccgagaagcugggacuacaggcgcccgccaccgcgcccggcuaauuuuuuguauuuuuaguagaugugcgguuucaccguguuagccaggauggucuugaucuccugaccucgugauccgccugccucagcgcccggccaagagugguuuuuaauugggaaugaacacgaaaguugcccauggagcuuucuaaaaguuugagcccacaucucaugucaacuaaaucagaaucuuuaguguuggcuccuaacuauauguacuuuaaaaaccucuguggguugguuuugauauggucccuugauuauguucuucuacuaauacauuuuaggcaguuacauccuuuagugccuuuuccccauacuauagaaaucuuagaaaagcauagcuauuagcaucauauuuuaguggacaauuuuaaagagaccaggcuuauuguuuuuguuuuuguguuuguuuggcaaaaaggucacauuaccuauuuuucuuguuagagaugacagaguagugauauuucucaaaugaaaguuuggauuuucaucuagaaaaaauauuuuugaaagcuuuuauguaauaaaagaagcauuaaaaaguauuucuggaaauguuaucaauuauucuugaaaguagacuggguuaauuugcuuguguuuacuuuggugaaaggugaaaaaugaaguuucuuugguggcagaaggcuuucucccagaggauggaaguggccgcauuguugguguucaggacuugcuggaucaggagucuguguguguggccacagccucuggagacgucauacucugcagucucagcacacaacagguaaguggaagacuccagugaggggggagucucaagcauccucaaauagguuacuugcuauuuguggaaguuuucaaaucaguagccauaauaguuacacuuuugcuaauuaauuuuugcauuauauauuucuuuauuuaaaaaauuguuaacauggcuuuaucuauauguuaagauucuucuaaaacugaguuuugucugcugcaucuauuaaucagagugaucagaauguuccaaaugagaauauauuuuuuuaaaaguuaaaacuggcuauucuuaugugguguagaucaccucuuaucagacccucaucuugaguugcaaccuuuguuucucaauuuaggaagucuuuguuuaucugacuuagauuuucuguuaugaauguugauuggcuaaauuuagagucccugaagucuaggcacuaaaguaaauacauugucauuaccugcacaugugaugacugccaguagagcuagacuucaagcaauugcuucuuucucuacuuuaguguauaguugaguuucugauuucuauccucaccuucuuaacagcaaggguuucaaauuacacuuggcugauucuuuaaaucuucuuccauuacuucauuaguugugaucuccuuaacauugauuaugucacagaaguuagaguauuacuaauaguaggauaaugauagcagcuuacauuuauuaacuaucaugugccuggcacuuuuuaaagugcuuuucaugcaaauuuauuuaaucuucaccaugaccuuaugcaguagguuguuguuuccuauucuucagaagaggcaguuaaggcacagagugcuuaaguaauuagaccagggucacacaguaaucaaaugggguuugacccuagcagucuaaaucuggcaccucugcucuuaaccauuccauuuaguacaaucauaaaccuuuacuugcaguucauggugggaaauaucaaacuugucauauacagcuuguuuuuuuuucguauuugaaagauagaugcuuuuacuuuccaaacauuuuguagcauuguuuccugguuacugagcucuuccagucuauuuaucuucauuuaauggugcugauucugcccuuuaguggcuucucaauugucugaaagguagagcccacuauugugccuuauaagccccuuucacuaucuguuccccacauuccuuuuuagccucauccccccauuguuccuguguguacguaaaccuuauguuuuaguugcagcugauuuuuaacugcucuuuuuucuggcuuugugccucuacacuguguuuucuuccuggucucucuuuccuguccuuauuaccacucuuugaaacacgucagaaaaacuuuuucuggacuuugggccacuugucauucccugugcugagacgcauuuugcuuuccagagaucuuggucauugcuguuauccucuguagggucuucuuuuaucucccucgugagacagcucugggaagaaaaagauauuuauuucuaaucccugugccuaauaacaggucuauucucuugauauccauuacugaagaaauguuuguugaguaaguucuuguuuuaauuuuuaaauauaaauuuuuaauuuuuaugaguacauaguagguacauauauuuaugggcuacaugagauguucugauacaggcaugcagugcaaaauaaccacaucauggagaauaggauauccaucccaucaagcguuuauccuuuguguuacaaacaauccaauuacagucuuuuaguuauuuuaaaaugugcaauuacuguugacuguaguuaccuuguugugcuaucaaauagcaggucuuauuuauucuauuuuuuuuuguaccuauuaaccaucccaacuucccucagccccucacuacccuucccagccucugguaaccauccuuguacucucuguguccgugaguucaauuguuuugauuuuuagaucgcacaaauaagugagaacaugugauguuugucuuuuugugucugguuuauuucacuuaauguaaucaucuccaguuccaucuauguuguugcagaugacaggaucuuauucuuuuuuuauggcugaauaguacuccauuguguauaguaccacaauuucuuuauccagucauccauugauggacacuuagguugcuuccaaaucuuagcuauugugaacagagcugcaacaaacaugagagugcagauaucucuuccauauacugaugucuuuucguuuuguuuuuuuaauuguuuugauugaaguugcagucaguuuuuacugagaugcuaguguuugaaucucucuuuucaauuuucucugucucagcuggaguguguugggaguguagccagugguaucucuguuaugaguuggaguccugaccaagagcuggugcuucuugccacagguaagcuuguuacuggugccucacuggcuuuuuuaaaacauuauuccagaugucuuacaggcuucaucagcuuuaggcugcuugaauuucaaaaaauuucuuugaaccaguauaauaccaauuaugaaccaguauaauaccaauuauguauguguguguguauauauauauaaaacguagagugauuuuuuuuuggugacugaaguuuugccucuuagucuaucauuauaaaaaguuguuucauguaacuuuuuaagucuuugggaguaagaaacaaagucauaaaacuuggggaggcugcuaaguccccaguuagaguuaaaaaugucagcaauauguauuuuaacuuauucuaagaguugcuguauggacacauucuaaaagcccuucuuggguucuguugcuguuuuuccccuuuaagucucaucauuccagaugaguuuaguaaaccagcuccacugaugacauuuauauuuagagguaucuuggggacaaggaguguugaaguuaguggaggagggcuuuguggacuuuuaaguucaacuguacacacauuaauagcugagcauaagcaccaggugacuuaucuagggaaagcuuuuugggguuuuuugucauuguuguuuuuuuaagucaaagcauuuuggaugaauucugucugcucuguucagacuaacuccagcuccuuagcuuacagugccauagguacuuaggaauggcaaauuuguuacaugaaaacaaaaucauuuuuguuuguguuucucuaaggucaacagacccugauuaugaugacaaaagauuuugagccaauccuggagcagcagauccaucaggaugauuuuggugaaaguaaguauagcuuugugcaauauuuugugaccuacguuucuucccauuuuugaccauuuccuugugcacuaauagccaugucauuaggccaaagaacugugaaaguuaaacccccagcuauuaaaugucuauuagcccaguuccuucagcccaucccaaaucuuaaaaggccuacugaugccucuccaggucugaggguuuaaggucacuuagauaguuauuacccaaacccuaggaaagucuuaggcugggcuuucagugaaagggacuguacaagguaguauuucugggauacaguuuuagggagaagaaaagaagaaagauggaauagaaggcugguuuuuguuacuacgauuagauccaaucugcauuuccaugggaacaaucagauuauuuucuugcuaaaaucuagccaaggucaucugggcauuaaggcuguggggguauugaagggcagugcaggagaagagagacgcuuauuaagcauaagcuuuggccaucuugaagucacaaaguagcuggccugauugaagagggauggggaagaagauguuccaacuucuguuauggucuaacuuccugccuucuugcuccaucaacucugagaaaucauuuagacaacuucuacccauuuauuuacaaauaauguauuuguucagaaauaauuuuggagggcugggcacaguggcucaugccuguaaucccagcacuuuuggaggaugaggcaggaggauugcuugagcccaggaguuugauacuagccuaggcaacguagggagacccagcaucuacaaagaauuuaaaaauuagcugggcuuggugguaucagcacaguaaugacaugaugugcagguacugggguagcauaagggaaggaaacgaguaacuagagagggaugauuuauuuccccuaggaggccaacuugagcugagucucagcugaauugguguuggguaggugagggauaaggguggggaguagucagcugaauugguauugggcaggugagggauaaggguuuggaguagucagcugaauugguauuggguaggugagggauaaggguggggaacaguccaagcaagugaauguguccauuucaaguguccauuucaagggaggguuauuucauagaaacauuguggguuacucagggaacugugaguaauucagcauugcugaaguggcagaaugugaguguagaaugaaauaaauggaacagauuugauugaguuuguaguagggaauauggacauugaguuauaguugaucagccauuacaaguuuugaugauaagagguuuaaagagauuuauuuaauagaaagauggcucgugauggcauauuuuuguuguuuuuguguguggagagggaagagaugagaggcagggugaucagguaggagguugcuacaggaauccagaugaaagauaaggaagguuuguguggggcuagaagcaggaaucauucaggaaaaaacuugauucacaaugaggaugggaguacauuuuuuagaauuagcugggaaacuuuuuuagaauauaugugcaugauuccccuucugcccuaggccaguuugagaaauaccaauuuagaaagugaaauaaauaggcuuugcguauguaaggugaauaagaaaaaguugagcaggacuccagccagaaccucagguguugggaauaaagaugccaguaacagggaagauggagaagugcuggucuguaagggguggguggugagaucuguuuuggauuuguugaaggaccauaugugauugccauguggaguaugcaaauauaaggcugaagcucaggagaggccagagcuauggacugagaguaguggguauguaggaaauucugacaguuuugggaacagauggacugucucagggagcagaugcuguacaggaagagucuagaauccaggguggaacucuggggcauccagcuuugaggacagucagagagagaguaacagcacacaguauacuuugggaugggaaagugcucugggccugguguuucccacugacuuuuucacacaaauccuaaugcaguaaaucaaaggaaauguaggccaaguuaagaucuuaggucucagaaauguguuucucaguacaaaaaaaaaaaaaucauucuauggagugaugaauauuuuuccucuauccuggggucaguagacuuguucugaaaagggcuaggucaugaauauguucagcuuugcaggcuguaugaucuguguugcagcugcucaauucuaauguugaggugugaaaguuauacaugauacauaagcacaucuauguuccaguaaacguuuguuuguaaaagcagauguaggcuguaguuuugcaaaucccugcuguaaccgcaucauuucuugucuuccauuggaaaaguucucuuucuucauuccuugguccuuaaucuuucuguggaaacuugcagauagaagccuggggguuugcaccaggauagucacuaccauuuguacgcagcagcaauugagguacuguagcacuuggaugugagcagacaggaaauggucauauggacccauaauuuauaggaauugcaaacagcccugcuucaucagaaucagaaucaauggcaggaggaaaguauuggguccuggauuaggugauguuuucaggaccaucuuuauugugcuucuugcaaauggauccuaccuccaggaacagaaggguuguguuguuucagcaacucugccuaauaguuuauauaagagaaguguuacgaucuagaaagaaccccagucagccuggaaggcagaagaccuguguucuaacuuuuggcuccaccauuagggagggucucaaucucuaagucuaugugaggagcuguuuugugaccugcagccccucuaucaccagugagagcuugcaaucagaauuuuauucccaguucucaucuugggguuuuauguuccggacauauuuuguaaacucuuuauguuucauucuucuuacuuauaaggugagggugagaucgcugacuugugucaucaaagaaacuuggaauauguaagauggcaguaaaaugcuuuccaaaauaaggaagggcauuucaaauucuucaaagucacugcugcauauaauaugaaauggguuuuguuuguuuguuuugagaugggggucucgcuguguuacccaggcuagagagugcaguaguacaaucagggcucacugcagccuugaacuccuggguucaagugauccuccuacuuuagucucuugaguagcugggaccacaggugugugccaucauguccagcuuauuuuguauacuuuuuguagagaugggugucucccuauguugcccaggcuggucucgaacuccuggacucaagugauccuccugccucagccucccaaaguguugggacuauaggcaugagccaccaugcccagccugaaacauagguuucucaaauauugacugcuggucaauuuauugagaggcguuagaggaccugaguaauugccaaugacuaacuucaugaagaauagcagugaaacuguuuuuguuucauuucauguggcuuauuaguugucuugccaauuguucuguaggcaaguuuaucacuguuggaugggguaggaaggagacacaguuccauggaucagaaggcagacaagcagcuuuucagaugcaaaugguaaguuugguuugauggauaaaaagccuugacuggaacaaauguaaguuugccacccaccaggaacucuuugguguccacuuagaugccaguaaugaacaguucucuucugcuuuaguaaaacugccuagaaccuucaggaaaugaaucccucuagaaagauccuuuuuuuccuuguuauugccaaguugcuuugugauuuauuuucauaguagcaaauaauuauaaccaauauucaucacccaguuuaaaaaauaaaacaucacagacaaaggaaacccccuguguaucccgucccgaugucccuccccuuccucuccagagagagcugccauccuucauucacaugcauguucucauacuuuucccauauauguguauauuagauauuuuucuuuuucuguuggaugaaacucuuuguuuuccuuacuucuggauuggaaaauucugaagaccauauaaugaugucuugaugacucaaggcaggacuuuuuaaucuucuaauguaggcggggcggccccugaaggcagagguguguggacacaagaagagugcagacucuuggggcaccuggggaaguaguguccgugucacauuaaauucauuuaaacucuuauauuuuauuuuaauuuauacaauaugaauauuuuuuaaaacuaugaauugaaaaguauuacccuugaguaaaauuaaugccccaagaagaugugccauauuuacccucuggcacacuaccaaguacccccaggggcauuacagaucucuguuagaaaaguacagauuacauuauccucauaacauuuagaagcuaugagaccuuggcagggaaguuuccuaauguuucugagccucaguauucucuguaaaguggacaacauaaugucuccuuacaaggguugagaugggcagguaauagcauauauaaaacagcuaucauagcaucagcacaguguaggcacucaaaugguaguugcugcuuuuguuuuaguagacaaauaauuuuugaaacuuuuuaaagcguaguuuuuauuucaaaacaacuuuauugugaguaaaauaugcauagugggucuaauuuaacauucugaaagcuauugacuuauuagaacaguaaaggauuauuagagggcagaaacauggaguaaguacucugagacacaaccuugcuucuuugggggugauccacuacaacugcccagcuuuggacaagugguuuucaugucccccugauuuuuaagugauuuuuuuuuuuuuuggcaggacuuaaaagguauccuugacuaaacaggaacuugaccaaguaaauaguuggugcaauuugaauauucuuucuugcuauaagcaacaaguaaauuaugguacagcuuucuaagaccauaucuuuucgauuuaaaaauagcacuuuacucauacauguuaugacauggguaaaccucauaaagauuaugcuaagugaaagaagccagucauaaaagaucacauauaauaugaucccauuuguaugaagugcccagaaggggcaaauccacagaggcagaaaguagaguagugguuggguagggcuguggggugggguggggaaggggugacugcuaauggauaugggguuucuuuuggggaugaugaaaaugcucaaaauuuagauuauggugauggcuauucaacuuuguaaauauacuuuaaaaacauugauucuuaccacugaguuuaaacaaccaaaaaaaaaucccaaggugcauugaauuguguacuucaaaugggugaaccuuaauaauauguaaauuauaucccaguaaagguguuaaaaaauaguacuuuaaaggaaucuaugguaguuuugaaaauaaggcaguuuuccauacuuuguuaaacucuggagaagaugacacuuuacuacugguaccugcuagaguaagacuuaucuaguauuaacaaaauuaggguuuauuaaugguauaggaugauccagguaaugggggaaaaaaaccgagcauccuguuaucuaauguacuauccaguaaacuacucuagcuuuuuuucaugaacuuuuucuaaaggcuuucuagggccucgucuugguuugaaaguucacagcuacccuucagaaaagaaaacaaaaauccauggaguaggcagauacaaguacucaugugagcauaauuuacuuugauuuuuuaaguuguguuauucuagcccucagccuguucccugccugggcucuccuagugcccaguaacacugauucaagagguugcauuuagcugggcacaguggcugaugccugcaaucccagcacuuugggaggccaaguugggcagaucaccugaggucaggaguucaagaccagcauguccaacauggugaaauccuaucucuacuaaaaauacaaaaauuagccaggcaugguggcagaugccuguaaucucagcuacuugagaagcuaagguaguagaaucacuuguaccugggaggcagagguugcggugagccaagauugugccacugcacuccagccugggccauaaagcaagacuccgucucaaaaaaaaaaaaaaaaaaauugggugagagggaggaauugaggaggauaccaaggguugggccugaacaaauggaagcauaauuauauguagaaauuucuaugagcuacucuucuagaauagaugacucaauaauacccugcuugccaucuacguuuucuguccuuaauuauuuccaguucuauuucauauaaugccuauuucaggccuuaacccuucaguaaaggagguuugguuucuauacccuaggacaguuucauugagaauaaauuuuguuaggcuaccuauguauucccuacugugcagacuacaguacaguacuagcagaauucuuaggcuguuacuagaauaugaugaugaaugcccggguggucaucugucucccacccgguagaguuggcuucaggauugagauacacguggcccuggaggagacguuucuucccgucaugcugcagaaugagaacauuuccauguuuucgucauugucugcugcugccuuuaccaccucuguggcuccucccuauucaccuuguucacaucuuaacucaucugugcccuguugugaagcuuacacaauauguaaacaaaacucuacccuguuggacaaauggaacacuuguuuccuuguuguaguuaccugauagguuccuuagcucauuauauucaggaucuagaucuguagcucuuuuccucuuuugcuguucucagaggccacuuuuuuuuuuuuuaaugccgaaaggaggauuuuguuuguuuuacauuuuuuucuucuuuuugaugauuucugcguucuaagaaccaacccuuggaugguuucugauucuagaggcaggcuuucaaaguagcuuaaaccucuuaaaaaacaucuguaucuaguggucugaggcuuguuugauucugggauacuuaaggucccccaguaauauugguguuuguuccccuuuuuagcaugagucugcuuugcccugggaugaccauagaccacaaguuaccuggcggggggauggacaguuuuuugcugugaguguuguuugcccagaaacagguauggaaauauauugcaguuaaacaacaauaaaaaauuuuuaucuuauuaaaauuaaggaaaauuuucuuucuuuugcuuugaguaggguauuaauuauacauaugaggcaaggaugugcugcuuuaaaugugaaaugagguuagaguuaagaauuagaagaguccuuugaggccauuugguccauccuccuaccugguggacacaaauuuguaacaaaauuaaucuaauuggcuauguaaaaccauggcaguuuuuauuuguaaggaagguguuugaauaguucugaauugacaacuuuuaucauaauguuuuaaguguguauguguguuugacuccacucccgcacaggggcucggaaggucagaguguggaaccgagaguuugcuuugcagucaaccagugagccuguggcaggacugggaccagcccuggcuuggaagugagugggagaagaaaccuuagagaaauucuuggaaccagaguagagguggugguacacauggauacagaugauacagauguuuguguaacacaaaaggauuuuuacguuucuucauuugguuauaaggcuguaucuaucuuuguuucuucuuuuuuuuuuuucuuauucccugaagucugaauucaacucgaauaguagauuuuacgcuucuucacagauuucauuguuccaaggccgcauauauuuugcauuccuaacucuuaaaaggcugugguuuuaaggcaggguauauaugaagccauuguacagagcagaaaaugguguuuagaagggaaggcccaguuugcaaggcucuguggggcaaauggugcuuuuguggaaauuagggaaagagccuccuuccuuggcacaaaauuccuacagcagaggaucugcuugccaaggagcaugcaggcuggauucagacccugcucuuuccuuccauucuccuccuuggcccaguacccuugugcagguuacaauuugccugucauauguggcugccugauuuuagauagaagauguaucuccucuguuucggugauaucuguuguauguagaccucuuguuucccaccaguaucugaaugguauuauaugauagagcagaagagaaauguauuugaauuaaaacccuagagacaaauaugaauaagaugaggcaauuaagauguuuucaacauuuggugaagucuuaaaaaagaccuacuggagcauagaauauuugcugaaguuguauaauggaaggagaaauagauuuugauuuuuaggacauuauaccuggaaugguuuagauaacuuauuauuuuuaaagucauccaaaugcaauguaaauauguaagguuuugugggcaaauggagccucuguguaaaacaggaaaaggcacucuuuccucugggcaaguacagucccacagugggaugaaccgcucgccgagagacaagggacacaugggauuuaaaacuuccuuggauaaagauauucauuaauucguucauucauucauucauguuugcuggaaaaaaaacucuucuggauuuuaucuauucuuuaguuaggugagcuuucgauauuguaacacucugaguuugcuuuaagacccucaggcaguuugauugcaucuacacaagauaaacccaaccagcaggauauuguguuuuuugagaaaaauggacuccuucauggacacuuuacacuucccuuccuuaaagaugagguuaagguaagugccugaguuuguuucacccucgaauguagaggacuuuccauagcuauagagggaauuuuuuuuuuuuuuuuuugagauggaguuucauucuuguugcccagguuggagugcgauagugcaaucucgguucacugcaaccuccgccuccuagguucaagugauucuccugccucagccucccgaguagcugggauuacaggcuugcgccaccacagccagcuaauuuuguauuuuuaguagagacgggguuucuccguguuggucaggcuggucucaaaccccugaccucaggugauccacccgccucugccucccaaagugcugggauuacaggcgugagccaccacgccuggccuauagaggggauuuauauuugauauggauauauaaauaguagcuuuagaguaaauaguaauaaaaaugguggcuuccuagaacugauuuuuauuuaauaaaauauuguuuuuccagugauuuugcaaauaauagcauuugucccccaccuuagauaaaacagaaguaggaaauaaaaaugcuaguuuuuauuguuuauuuugacaaaagcauaauuuuuccaguaaugaagauguuuuucauuuauaacauuuaaaucuuaagugguuuguauaccauuaagauucuugcugaagugagaacacaucaaaugguaucucuguguaaaauuuuaaacauccuaaguugagagacgaguuuaaugaacucccauguaacuauuacucacuuucaguagauaccaacauuuugcaaaacuauuuucaucgguccgcaacucuuuggccuauacauauauauacuuacauauauuuuuauuuccuggaguuuuaauucuagaaaucauauuuucaauauuuauuuauaacaguuaaggacauuuuucuuuacauaaccauaauucuauuauuacaucuuaucucuguguugucuaacacccaguccauauuccaguuucucugauugucuaaaaaugucaccuuguauuugguuaaguuucuuaagucucuuuuaaucuuuaagcauaauguauuucuuuuuuuuaaguccucuacauaauaaugacauauuuuacagauuuguuuaaugccucuguagguuagugauuuacagcuagggaugagcucagguagugggauuauuugauuugagagaggaaauacagcuauuauaaagauuuggaaguaaauccauaacugaaagccaaugacagaucuuuuuucccuucuagguaaaugacuugcucuggaaugcagauuccucugugcuugcagucuggcuggaagaccuucagagagaagaaagcuccauuccgaaaaccugugguaagacagcuguaguaccccagccuucugccccauaaaacguaguugaaaguagacagguaugggauuuccuucaucccuucuacuuagucccuuaguagaaucaaagaugcugaaguggguagguggaaaugggggugguuagguuuugauugauuguggauuucagucauguauugguugggguucucuagagaaacaaauaauacauauauauaauucgucccucaguauucucgggggauuaguucuaggauugcccauggacgccaaaauccacacauggucaaguccugcagucaacccugcagaacacucagauaugaaaagucagccuuuuguauacuuggguuuugcauuccucaaguaccauauuuuugaugugcguuugguugcggguauagaauccacaauaugaagggccgacuguauucauugaaaaaaauacgaauauaaauggaccuguguaguucaagccuguguuguucaagggucagcuguacuuacauagagagacggugagagagggaauaggguggggcgggagggagagagaguaauagaguguggauagauuuacuuuaaaagauuagcuaauguaggggauggcaaguuugaaauuugugggggcagguuggcaggcuggaaauucagguaagaauugauguugcugucuugaguaugaaaucuguagggcaggcuggaaacuuagggaggauuucuguuacagccuuaaggcagaauuucuucuuuucugcgaagccucaguuuuugcuuuuaaggucuucagcugaaugaaugggaccuucccacauuauggggaauaaucugcuuuccuuauagucagccgauuauaaauauuaaucacaucuacagaauaccuucacagcaacaucuggaguuuagcagauagcugggugccauagccuagccaacuugacacaauaaaauuaacuguuguaagucaucacgugcuuucccuagugcaugguauuaccacagaaaaaacacuaaccaaaggaauucuguggacgugaaagaagauuuagauuaagcguaaaaguaagaauauuuuuauagcuuuuaaaauguauaagugugugguuuuaaguauuaaauaauacuugaaaauguuagaaaauaagaugagaaaaaaaucucauaguucuaccacuucguaauaaucacuauucaaauuuucuugucuucuagguuuuucauguauauaucucaguauagcuaucaucuuguuuuuguuaaaaguguaguagguaugggccaggugcgguggcucaugcacuuugggggcccagcacuuugggaggccgaggcgggcggaucacgaggucaggagaucgagaccauccuggcuaacacgguguaaccccaucucuacuaaaaauacaaaaaauuagcugggcgugguggcaggcgccuguagucccagcuacucaggaggcugaggcaggagaauggugugaaccuggaggaggcggagcuugcagugaauggagaucgugccacugcacuccagccuuggcgacagagugagacugucucaaaacaaaacaaaaaaaaguguaggugugauacaucugcaucauuuuaaauugcuguauaauacucguuuauucucguucauuaaaucucaugcuguuagacauuuacaguuuugucauuucucauuauuguaaacagcaaugcaugguacauuuuuguucauaaaucuuuuuacuugauuauuuucuaaguagcuuucaaacucuuuaaucaguagaacccccccccccuuuuuuuuuuuuuuuggagacggagucucucucuuucccccaggcuggagugcaguggcccgaucucggucacugcaagcucugccucccggguucacuccauuuuccugccucagcuucccgaguagcugggucuacaggcgcccgccaccaagccuggcuaauuuuuuguauuuuugguagaggcaggguuucaccgcguuagccaggauggucucgaucuccaucucgugaucugcccgucucggccucccaaagugcugggauuacaggcgugagccaccgugcccggccucaguagaacccuuuuaacugcaauguuaagaaacucauuauucauucaacacaauaguucuuaacccuggccacaccuuuagaaaaaaaaugauauucaggcuucaucucaagaguucaguucaguguguuggaauggagauuauacguaaguauuuaauuaaaaaccaaaagcccccaagugauuuuaaacagccgcaguugagaaccaccgauuaaccagugugucaagggauggcacugugauaugcugagcauaaaaauauugcacaggaugaaacccugucucuacuaaaaaugcaaaaauuaguccggcgugguggugcgcgccuguaguccuagcuacucgggaggcugagacaagggaaucgcuugaacugggaggcagagguugccgugagccgagauugagccacugcacuccagcaugggugacagagugagacuccaucucaaaaacauguauauauauauauacacacacacacacauugcacaagaacagccacaacaucugugcucacagaacaucagcauguggucuaacuucaaaguguuguaauaaugcgguuugagacuagguuauguuugcugugaucacuaaguuaagcauuagugagcaaggagauugagaaaauccuuaauauaaauaauauuucuuaauauaacuauaauuccuaauauaacuaaggucuuaauuuauaugucaucuguuuaguaaagguugguuuuggcaugauuaagucuugcuugcuuaauagauguuggaaggauaauuucaugcuuaucuucuuuggacagcugaaucaggauuaauacccagauagccuugaacauaagugcuugcaaagcaccugaaagaaaauaagcaucuuaagcccaauacaacacaaugaugcuagucuagaucuuggauuaaguguuuuaauacuuuuacucuaauugccaaguuaucuucuuccuaaaucuucaugagaaaacccacuaaaagaaugcuuuuuccugguagccuuccauugugaucauaaaguuuggaaguaaaguugaaaauaaacaugugggccaggcacgguggcucaggccuguaaucucagcacuuugggaggccgaggcaggcggaucacaaggucaggagaucaagaccauccuggcuaacacggugaaaccauguuucuacuaaaaauacaaaaaaaaaaaauuagccgggugugguggugggcgccuguaguccuagcuacucgagaggcugaggcaggagaauggcaugaacccgggagauggagcuugcagugagccgagauugcgccacugcacuccagccuggccggcagagcgagacucugugucaauaaaaaaaaaaaaaaaacgaaaauaaacauaugaauaaaaguuaaaaauagaaaaaaaacaagaaaauaaacauauauuucugaccuuauugauucuugauauuuuaucugcauggaaagcuauuuuuuggcaguuauuauuguucuuauuuuagagacgaggcugagcaggaaggguccuuugaaaaagaaaagauugcccuugaaccccucuggcaagugggaugaagucugcuucccagccucuaacggccuucuuuucauuuucccuugcaguucagcucuggacuguuggaaacuaucacugguaucucaagcaaaguuuauccuucagcaccugugggaagagcaagauugugucucugaugugggacccugugaccccauaccggcugcauguucucugucagggcuggcauuaccucgccuaugauuggcacuggacgacugaccggagcgugggagauaauucaagugacuuguccaauguggcugucauugauggaaguaagcuccugggaaguguguccaugagccugcaagggguccugagccuagggccugcagauguggugguuugacuggaacaguggggaaucuuuauuuguuuuggcuguuuggguuacuuguuuuuuuauugaaugggauauaaggugggguauguucucuccugagaaccauuguccccccucccccaccaguuuccuguuauacugcaucuguggccuucacacguuuacuugccuggccuuugaagacacugaaaacuuugacucuagguagagaggaugacaacaguacagucuugugggauuggguguguuagcuuuaucuguuugcccugacacagauuuauaauugacccuuauaccaccccacuuguguugcuuuguuuccugauacaaaugcuugcugauauauaccucuccaguauguucaguucaugcauaaacguuugccuaauaugaagauuagguuuauauuuuauaaugagguagaagguuuuuuuaggggguggggugggaagggcaagacugaagagugaaguagucaccuuaaugaauaguuucauugcugauaugaaagggagcacuggcuucuaagauuguaaugugaggugguauauuaauucauauucuguguaauauucuacauaauacugauuuuauagucauguauucuauauagagaacuuaaucagaucugcguuauuaccaaauccacacauaggaaagugcuuuaaggauuuugaaaguauuaauucccuugguuuaguguggcuugguugcaggcccagguuuaaagcuagaggucugaccucuuggccuuuuugccuuagucccuggcaccugaaacuccagguacugagauggacuccccuaggccuagaggugacaauagccaauuauggacagaacccaugacauuuccccaucccacacuguuuuuagacuuguuccugagaaaaacauugaaaguuauuuuuuugugaauugccauuauuguuuagauauacugugauguucagauggcuuaucuuacaaauugaauaucccuaggucuaauccucuucuuucuuuuucacugcagacaggguguuggugacagucuuccggcagacugugguuccgccucccaugugcaccuaccaacugcuguucccacacccugugaaucaagucacauucuuagcacacccucaaaagaguaaugaccuugcuguucuagaugccaguaaccagauuucuguuuauaaaugugguauguuauaaaacuuuugccaagauguucugaaucaagucccuucuacuccuacauaaaagcaaauuauaguuugguguugccauaggucuaguguuucucaaaauuuuuaagucugcaguugauaucauuaucauuaugauauuuaauugccuuggguuuuuguuuuuuuuuuuuuuaauccuauacugguuuguacgagccauuccuuuucccuuacugacuugaagagucaguuauuuaagaauaacauuggacucuggaaauaacauaguauguuauacauuguuaacauguuuuacucuuuucauagccuuuacacauauuuucaguugaucucaucccuccuaggagcugugucagagaugggguuuuccucuuuuguagaugagggaacacagugucagagguuuuguaauuuguuugaacaagaauggacaaggaccucaacacagguguucuagcuccuaauccacuuguccugccacagccccauugcugucaguucuucauuacuuuccugaugugcuggagaaucugaaauuuguuuuuacuugugaguucugugguuaugucauaaauucugcuggcauauggcaguguuagccuuguuuucaaauaucuuuugaauucucagaaaaagccuagauaguugccaagagagaauaaucaaaauuaauuaauuuaaaugggaaguccuuacuuucauaucagcuuuucuguuaagucagcagcccacuguguacauggauccuaucuggauguaucaccaguuucucugauuauaguuucaguguguaaaaugcuguuacaguccuccuuaaacuuuucaaaauagcuuuaaaaaaaagugcaaauauguucauugucaaggcaaaaagaaucagauguaagcuuuugugggacuuaacuguaugaugcuaaugaguuuauaugucacuuuaugauguaugguauguuuuguucugcauucacuuaaaaaauagcuuuauaucauucaucuauuuaaaguguacaauucaaugguuuauauguguguguaugaauauauauacauauguauauguauauauauguauauucacagaguuguacagccaucaccacgaucaauuuuaggacguuuuuaucuccucagaaugaaacccuguaccacccugcauucauuuuacuugagagaaaacucccugugaugagauaggacagguugagagcuccacuuuugaaagauuguucggcaucaauaugugggguuggccauaggucaggggcaccuggaggcagagauucuaguuaggagaagcuguugucaaguguccaggcaggagcuagcaagagcuugagccagagcaguguucauagaaauggaaagaagagaaagaucauaacaaauccaugaaguaaaaacccugagaaguuaaagaacccacuggggagaguuuggauauaagagaaucuggaaaaagagaucuuggacuggaacaggucagggcuccgugcccaaguggaagggaaauuaagaacuuggagucaagugguagacauuugagugguguggagacaaguucguugccaaaguuuucaaagaugguguuugaugcauccugaguaucacuccuuuuucccccucauugcuucuugauuguuuauuauaugccaggcuuuuuucuaguacuuggcuuguuguacuagaaaacuaguuguacuuugucuacaacuuguuguucuagguguagacaaaagauaucaauuaaauaugaucuaucagauggcaagugcuguggagaaaaauuaagcaaaauaagggguagggagagcuuaaggauaaggguuuacagggggaaggugucuuuccuauuuagugugaucccaaaggccucucugugaaggugacauugaagcagagaccuggugagaaucacagugggagccacgcagacaucugggguaagagcgucccaagcauucuaugcuugaaggcaaagaagaaaaaagaaagagcguuccaagcagaguaaaaagcaaccaccgaagugccuguuguguuuaggaaauagccaggaggccaggguggcugcagcagagcaaaggaggggaagguggugggugaguucagaguggugaugggaaucugcucuuguagggccuugcggcuuuuacuccgagugagauaggagccaccagagggcuuagaacagaggagugcaguguucuggcugaauuuuuuaaaggcuugcauuggcugcugugcagugaauaaacuggaugaagaauagaaagaaaaugucuuuuaagcaggugcuuaggacuuuggagaauuugaggauauugagaggugguugaagacaguggaggaaauuguccacagcacugggcugagaggguagccccuucaccuggucuugcugagauguggccuuugucagggaagauuaugacugauguguucuuaagaggaaagcagaaauuuuaaggagguugagaugugauuauuuucuagauugcuguuugccuucuagaacucauuaauugcagacaccauccccuuaguauuaggugaaaucuuauaauuuacgaugauaauauuugcauuuuuguuuuccaggugauuguccaagugcugacccuacagugaaacugggagcuguggguggaaguggauuuaaaguuugccuuagaacuccucauuuggaaaagagauacaaguagguucuuaauuaucuugggcuucugggaacagaaucagccagcaugcaguccuaaauucagccaucugauaacaguucuaugccuguugcugaguggaacaagaaauaaagacaacacccaggcccugacuuucggaucugauuggagaagccagucauguaguuugucugaaugccauauaauuugauagguagcaggagagcaugaguuguaagccagccuaggaccuacucccaauagcgcuugguucuccaggaaaaaucaugugggaaagauggagaugacaaugauaaggcggagcugcauucucuuacauaaauggggauguauggguuguuaacauggaugaccuaaugcagccucugucuuugcuccaucccagaaucuagaacuucugggugcugugcuuugaggcuccugggauggaaaucagaaugcauucuuccauugaaacaguauuguaaacaauuggauguuauugaauaccucagguacacuauaggcauuugcaaaaugaccuagaaaccaaauuauaaugccacaucugugagagaacuuuuuuaaaaaguaccacuuauugaguacuuacagauuaaaaaaacaaaguguagagguuagguaacuuacccaaggucauggaccugguaacuagagaauuuaggguuugauucuauucuguuugauaaguccauguucuucauuacuaaacuacucugccuccagggaacauuuauuguuagauuaauagaaauaauuaacugaguacaacaaauagcagaauuuaauaaauaauguuucuuaaauauaugugauauauuuaauaaauacagcagaaguguucaaccucuguaugauuuugaggcugccuguauaaugcuuaguaguuuuuaaagagcauuuacaugcauuauuucacuucauagacuugaaaccacuagaguagagauagaggacaaauuagaaaguaugaggcaguuuagaauauaguuucauuuaaaaaaaauugauggggauaaugccaauucgucugagauuucacagaagacaugaguacucaucgugaucuuggggaagggauagguuugggguuggcaaagaauugggaacauugggucugguggggaagaaagugucagugaaaaccagaggugggacugauccuccaugggauacucuaugugaaugcaauggagagccugaguccggggagagauguuugaggaggaagaucaggcuagugaccaacuucuucagugggagcugcggauuugccaccugaucuaaaaggcaggaaguagccauugucgguuccuacgugaggugacaagaacagugcgcuggucagguguauaaaugcuaccaaagaaugcauuagagacauggagaccaucucucaagcuagucagucaguuuaaugugaggugcuuaggaaaggacccauucuacugcaagugacauaccugccagagccugguuugaaugcugguaagucauggcaguggaaaagcucugggguucauuaguguagggacuagggcugguaauuuucuuguguagucaguuuccucaaguguucucuucaaauuuaaagauuucaggguaugagaaauuuagggaaaauauaaaaacguauucuuaagccagacaaagauuaauuuuagauuuuguaguauuugguaguaucucagguuuugucccuccaaauaauuaggaguggacuguauacaagaugcuucagucuuccuucauccaggaacgucucagugguuuuuaaguuuuauucaugucuuggauauucuucaauauuuacaauagaauccaguuugagaauaaugaagaucaagauguaaacccgcugaaacuaggccuucucacuuggauugaagaagacgucuuccuggcuguaagccacagugaguucagcccccggucugucauucaccauuugacugcagcuucuucugagauggaugaagagcauggacagcucaaugucagguauugcaguuuuucccuguacuccacauguuaagcaaauggaguuagguuuuugucuuuuaugagcauacaacuuuugacuucuauugaucaagguugaggagcaguagcuuucuuguuagacacacuuaacaagaagguuaagucuaguuaugagccaugucaaaauaacagaccaaaaauauaucaaaaaguggugaaaaauaggauaaauauuaguagaugaagcaacuuuuuaaagauauguuaaauauuuuaauuuagcaucuacccacauuuuuccagcgugauuguuauauguuauaauugauuuuaauaacugucaagcauaauuagaguggcuaauucucaugggcuaaugugaugggaagaaauuuuguauaaaugcagucaugcgcauauauguguguguguguguguguguguguguguguauacauaccuuuucuauguuuagauacacaaauacuugacaugguauuacaauugccuguaguauucuguaaaguaacaugcuguccagguuuguagccugguagcaauaggccauaccccauaggcuagggguguaguaggcuacaccaccuagguuuguguaaguacucuaugauguuugcacaaugaugaaaucaccuaacaacacauuucucagacguauccccaucguuaaaugaugcauaauugcacauauaugcuuuguuuugauguggugacuucaaaaugcuucuuccagccuccucuucuauauauccuauuuuguaccugacuacauuuaccauuagaaagucucuauucuucuuugcugaaauuucacuguucucugggccugaguuuuguuuugauuccugacuauaucuucauuauguaacagguuucaguuaaugaaugcucuucuguguaauguaagcccuguuguauaguugauagcauuuucuagccaguucccagaacuccuuguuuccagugucaauacuuggcaccuuuguccacugacacuaauccccagauuaauuuguaauuaaagcccuacuggugagauuucugagaaacguuguugcaaaauuaggaaccuuuccuuuauauauauacauuacauaaauuuauagacauaaaacauuuuaaugcagucauuugcugcuacucuuugacucauagucuuucgugauauuuugaaaaagccuuuuguuaacaugucuaaaugcagaauauguucuagaaauauguagcacuuaaaguaagccauuagauuaccuuuugaaaagcggagcaauuuacuaaguuucuacuucuucagauuugaaauucuucaucauuagcuuguagaggcaaaagcuugaugcagucaucucauuugcuguaaaggaaaugagaagucauuuacaguauauuucuacugcuuugacuuuuauuucucaaaaagacuguuuuguucauauaaaauauuaaugcuuuugaggacuacaaagucccucgauuuaguuuacauuuacuuuagcuuauacuuuguaaaaaauacucuucuaaaugcuuugucuguuuuagcuuacuuauuucucauaauaccucuguaaaguauaugccauuugcaccaucauuuuacagaugagacaacuaagacauggagcaguuagauaacuugccugagaucaugcagguggagccaggaucaaaucccagcgagucuagcuccagaguuuguucucuucuugacagauaauuuauccucacaaaauuugaagcauuuguagaggaauucccuauuguuauaauguuuaguuuuuuuguagauugguuaaaaacuuugaauuaaauguuagcauuaacaucauuugcuuuuaucacuacuucuuugucucuuuuuucuuuuuuuaaucacuaccucuuccuccucuuuugagaaauucugcuuccguggcuaugguccaagcuacuugagaaggugaggugggaggaucacuugagccuaggagguugagauugcggugagcugugauugugucaacugcauuucaaccugggcaacagagcaagacacuguccaaaaaaaaaaaaaaaaauagugaaauuuuacuucgcuccauugacucagggaaaaaauguaauggugauaacaaauucccuucaucucauuagugaaaauccacaauuuuccaucaaucgauaugauagugauagagauauugagugugcucauuuuccuacagaccagcugcuuuaacuauuuuaagcagacagaaaugauauugguaccauccaugucuaaugaaggcaauacuuuguaauaaguugcaguaaguuguggccagaagaggaaugaugacuucacaguguaaacaacuaccuuauuggguuuguggaaaauggugucauguagcagauguggcuuuaucugggcuuugguuuggaguaguuuuaucuauucaucuaaccgucugucucuaaguguauaaguguguguguguguguguguguguguguauaguauuggguguguauauauguauuuugucuacauuguauugaaguagguagugcagcaucaaaaggaaauuguugauuuucaaaaucagugaaaugucacuauuuuugagaaaaauggucuguuuacacucccuucuccuuuuuuuugucaguucaucugcagcgguggauggggucauaaucagucuauguugcaauuccaagaccaagucaguaguauuacagcuggcugauggccagauauuuaaguaccuuuggggugaguaucaagguguuaggaaagcauguuaugacuuacauagaugcuuaguucuuaagaacauguacuuguaucuugucaguucaauauugauugucaggucuuuuaacuacccuggaaaacccuaagcuuuagaguggaauuggcaaguguauucuacuccuguuuccucuuuuaaugaacuaacguacucuuaaaaaagugauugaugacuaucgcagggacaaaaaaccaaacaccgcauguucucacucauaggugggaacugaacagugagaacacuuggacacaggaaggagaacaucacacaccugggccugucguggggugggggaggguggagggauagcauuaggagauauaccuaauguaaaugacaaguuaaugggugcagcacaccaacauggcacauguauacauauguaacaaaccugcacauugugcacauguacccuagaacuuaaaguauaauaaaaauauauauauaaauaaauaaugccagcauuagagaaaaaaagugauugaaauugcauguuaaguguuuuagcaaauguugauguugaugguuuuuugcaaagagcgcaucagcuauuugugaacuagaucugugaaucuugcagagucaccuucucuggcuauuaaaccauggaagaacucugguggauuuccuguucgguuuccuuauccaugcacccagaccgaauuggccaugauuggagaagagguaggugaacacggagcaggaaauuuacuuaaaguaguuacccagggacugauggcauuaaguagaaagagcgugggcuuuggagguggacuugggucuccacuaaaugccuagacaauagugggaaaugaucucacuuucauaagccacaccuuauucaucuauaaaaugggaaaaucaguaucugucuaucaggguucagaagacuaaaugagauaauauaugugauuagcaaccuuuuaucccuaguuguacaaaucauucaaaguuaauuuuauuuaggaggggaaacagaaaugugaucuugagaauaguuuuaguagauuuuuauucaacacauacuagaaugccuauaauugugguggaugguagaaugcaguggcuggaaaacaaaaccgcuugacuaauuccugcucuucuggaacuugugaucuauuaauuucaauguaaugauucccuuuguugggagugugauggaaauggacagaguauacugguagagaauacugagauguuugagggguaauuugaggaugguggcuaugagaaugggaguccugcaucuggugguccaggaaggccucucggaggcagugaugugugugcugagaugugaagaaaaagaaggcucugucuccaggcagaaggaacaacaaacuccuugagcuuagcaagagcucaucuuauucaagggacuggauggaaguauuguggcuggagcucagugacagucauaggagggaauuuggguucuuuaauugaacaaagauuagaaacuucuugugauuuuuaauaacagaguaauguguucugcuucaugguuuggacagugauucuggcugcccagaagagacuugauuggagagugacgagacuggaauaugggaucaacaccgguugaguggaguuagugaggggaaaaaggagauggguuugagauauguguaggagauggagaugucagggcucacugauggauuggauggcuucacauuccauuuugcacuggaccagccacgucuuagguaucuaucuuuaguccugauuacaggaacuuaggugugaaaucauagggugguagaacuaugugauagaaaagguagguuuaacugauuugagauagaauugcuugugauuucaguuuuauuucuuugcaggaauguguccuuggucugacugacaggugucgcuuuuucaucaaugacauugagguaucaaggcuugguuugguguuggauccuuuucacaguguuagcuccgaguaaucuagcuagcuuucacccaugccucucuggccuucucuugcagguugcgucaaauaucacgucauuugcaguauaugaugaguuuuuauuguugacaacccauucccauaccugccaguguuuuugccugagggaugcuucauuuaaaaguaaguuuucaauguauaaaacagaaauggucccuucuccaaugucuuuuggagucuugaugacuuuuugaauucuucauuuauuuuggcuuuuuaucaaggaguccuaggcuggagaaaaucuuuagaguuauuuuacuuagacccuaaucucaacauaauaucucaguuaaaucauucugcacuuuaguaaagacauccaaggaagggaguuccuuccuuaagcagcacauucuaaaguuaaaaacuuuucaggaaauuuuauuauguaacugaucuaauauuuuauuuggaauuacuauguagauccccaauguuuuaccuucuguguagucuuuucccacugugcccacccuccacuguacaucugcgcuccaucuagugguuuguaggauauuggcugcauuuugucuucuguuccaugcccuaucuaucucuguguguguggcguguauguguguguggcguguauguguguguggcguguauguguguguggcguguauguguguguggcguguauguguguguggcguguauguguguguggcguguauguguguguggcguguauguguguguggcguguauguguguguggcguguauguguguguggcguguauguguguguggcguguauguguguguggcguguauguguguguguguuccuuauucuaaaaagccaacuuauuuucuuugcuuccaacuuggaaauagggaaucuuucuuucauugauaugauuauaguacacugauaaugcuaagaaauagagaaguugccccaauucuuaacuguguuucuccacaucauuugagaagcuguguaugugaaugugcaugagggcucuguaagagagagggcaaguuccagggaugagcguguucaucagcagggcugauagucuugagguucagugggagagcuaaggcacaugguuguuauuuguucucuucuauuucacauaaugugugcgguuucaauugcaguuaauggagaguggcuuguugugauaauuaaggcuuauuaguuaaugguguguuuagcauuacaggccggccugagcagcaaucaugugucccauggggaaguucugcggaaaguggagagggguucacggauugucacuguugugccccaggacacaaagcuuguauuacagguaagcugguuuuucagacaagauagauagucugauugucauucagccaaguaccaagcauaauucuugcagguuguauuuuaggcuuucuuauucuuuguaucguuuauuguaaaccuuuccuugauaguuuucuguuagcuuuauucaaaggaguguugauacaggcugugaccauaaggcucaaagcgaaacuuuucuugaaagucaagauaaauauagagaacaacaagauucugcuaaaagugugcugauuuuagagaguugugguaauucucugugaagaguuagguaaaaugguguauccuggcuauuuaaauguuuucuacuuaauuaaaaauguuacugcuuuaauuuauuuaagaugccaaggggaaacuuagaaguuguucaucaucgagcccugguuuuagcucagauucggaagugguuggacaaguaagugccauuguacuguuugcgacuaguuagcuugugauuuaugugugaagacaauaaguauuuuauuacaauuucgagaacuuaaaauuaugaaaagcccucauuaccuauaucaucaaucagauucuuagaggcucuuuuuuuuuuuuuuaacuuuuuuacuuuaaugcaguauuuuguaguggagauuccuagcagaaagaaucgugacacucaucauauaaaggagggcuucucuuaaccugagggaacacauguggguuuuagguggccugugaacccagggagauuguacacaccaaaccuugucuuuguguauuuauucaaguagaaagcccacagcuuucaauagauuuacagcggggccuaugacccagaaaagccugagcuacucuugugaaggaaaugacugauuuucugaaccuauuuggaggaaacuuuguauuggaaagaucuauacuaauguuuuguuuaaaaaguagaccugaauuccaugaugauuuucuuuguuuuuuuuuugagacagagucuugcucugucacccaggcuggaguacaguggcgcaaucucggcuuacugcaaccucugccuucuggguucaagcaauccucccacuucagccucccgcauagcuaggauuacaggugugcaccacgccuggcuaauuuuuuuuuuuguauuuucaguagagacaggguuucaccauguuggccaggcuggucucaaacuccugaccucaaguguucugcccaccucggccucccaaagugcuaggauuacaggugugaaccaccgugcccgggcuucuguaaugauuuucuguuguauguaugugaagauguaguucucagacagucaugaugacuaaauuacaccuuuuaagaagguaaaugaaugugguaccugauuuuuuuauucuguaauuucagaguagaaauccagugauagcagcuuggcauuggggcuguaaucugauuauaacugguuuguaucauaaugaaaauaugcugggcccauggagcucaguuuuugugaauaucuuuucuauucuuucucugucuucucacagacuuauguuuaaagaggcauuugaaugcaugagaaagcugagaaucaaucucaaucugauuuaugaucauaacccuaagguaacuuucuaagcugucauuuacucuagcuuacuuuguacuuaaacuaauaugaucugaacgaagauguuuuguccuuuuuuugguagguguuucuuggaaauguggaaaccuucauuaaacagauagauucugugaaucauauuaacuuguuuuuuacagaauugaaguaaguauuuugaauaauucauguguaucuuuuccauaguuuucucucuucuuguuaaggaaaucaagcauaaauagcuagagaagaaaaauuccuuacuguucauuuuuaaaaauugcuauaacucuuagaugccaguugguuuuuugcucuuuuccguucuuuuuaaaacagccuguuuaaaacuauguccuuaaaacaugucauucagaauuauuauuucacuugauuuuuagguauacauauaaaacuacuuguuuuuccuaggagacugaaaucaaauggcaucuuucucucugaugaucuuuccccucaacuuuuuaaugaaacacuuucaaaauagagaaaaguugagagaauuguccaguaagcaaccuauauauaccccaccuggauucgccaguuuauauuuuucuguauacacauucucauucucuauaaucuguccauccaucauucaucuuguuuguagacaaauugcuaagugaguuguagacaucaguccacucuaccaccuguacuucuccuuguauaucauuaacuagagggcauucuuuguguauggguugguuuuguuguguuuuuucaggucauauuuaucuacagugaaauguccaaaucuuaagugugccacuuagugaguuuuggcaaauguacacuucauguaaccugaaccucugucaaguuagagggcauuuacuccuuuucagaaagcugcuucagauuccuuucaaucagucccugucccauuccccaggcaacuacucuucugaauuuuuuaccauaaaucaguuuugccuguucaagaacuucaccuaaauggaagcauacaguauuacucuucugcauaaagcuguuuucauucagcauauugucuugagauucaucuguguuuuuauauguaucacuaguucauucuuuuuuuauuggucaguaguaugccguuguguaaauacaccacuauuugcuuauucauuccccuguugcuggacauguggauuguacuacccuguuuggggcuaaugugacuaaaacaucuacaaacauuuguauaagucuuuuguggacauguuuuauuucucaauauuuuuauaauucaacucuuuuccaaaagucauuuuuauuuaucaucaucagcaugccagguguauguuaguaauuugaucgcugggcuacauguucuguugaugaccauuccauacacaccuguucuuagagaagaagaugucacgaagaccauguacccugcaccaguuaccagcagugucuaccuguccagggauccugacgggaauaaaauagaccuugucugcgaugcuaugagagcagucauggagagcauaaauccucauaaguauguaugcugucaccagguggcauccuuugaaaaaccgaaguguguaguuguccuuguccagccuacuuaccuuucucauucugguguucuucacuuauuaccucagauacugccuauccauacuuacaucucauguaaagaagacaaccccagaacuggaaauuguacugcaaaaaguacacgagcuucaagguagagauccgcucacagagaaagugcuuaagguggccgugacugcuacuagucuucugcaggugacaaucaccaugucauugccacaccacagauuuaacaugugacuuuuuaguugccauuuuaagacccuugucaguuuuuuucagugcugcccucuaaagcauauauaaaaguaucagaaguauauauucuucugauguccaguucuauugagaaaaauuuauugucuuuuugguuauguuguuaggucuguggauuuuuuccccaaaugauuguguucuguuuuguuuucuaaacacuguuaggaaaugcucccucugauccugaugcugugagugcugaagaggccuugaaauauuugcugcaucugguagauguuaaugaauuauaugaucauucucuuggcaccuaugacuuugauuugguccucaugguagcugagaagucacagaagguauguggaguucuuacuuuuaugccauuugguucuuguuuauauaaugauagugugaaacccugcuucugguagugcaguagcuuuucugcuaucacucugugagugcagggcuggagacagaucugugaguuucuagggcccacauuccuaagccccugugcuuaugaaaguguuuugauugugagguugaagaagugaaguaaaauugcauggcuuuuuuuuguuucuuuuuuuuugagacggagucucacucagucgcccaggcuggagugcaguggugcgaucucggcuuacugcaaguuccaccucccguguucacgccauucuccugccucagccucucuaguagcugggacuacaggugcccaucaccacgcccggcuaauuuuuuguauuuuuaguagagacaggguuucacuguguuagccaggauggucuccaucuccugaccucgugauccgccuaccucagucucccaaagugcuggaauuacaggugugggccaccaugugcggccuaaaauuacaugguuauuuuuaagaugaugggcauaugugugagcuaauuucuucucuuauaaaggaaauguaacaagugguucauguuccacuccgguucuuucucacauggcucuuuuuucuaguggagggugggcacauggagcacagaaggcucauggccuccuuuccuauguugguacauuugcuaugaucaaaaacuuugaacaccacugguaugcauauuuuuuauuuauuuuuuugcagccucagucucuuccccaugaccucuccaaaaaugaaaaucggauccuucaucucucugcuuaaaauacuucaugagcucccauuguuccgaggauauaauucagaagccauaauacugcuuaaaaacccuuccuugaccuggccucuguguaucuuuccauucucacuucuugguauugucuuuuuuuccucugcccauggaggaaagacaaugcuuuugucccccuucccuugccccucaccaccacaugccuuggugggcagcauuacuucugccauccaugggcuuugacugcuuccacccucaccauuccccuggcuaauucucacuaaucuagguuaaaggaugccaagguggccucuucccaguaagccauucaugcuucccuccagggacugggugaggugacccuccuauaugcuucuguugcacacagugccuaccccugcagacuacagugugucuuuaucuagagugcgguauuuauuuauuuauuuuugagacaaggucgggcucuaucacccgggcuggagugcaguggcaccaucuuggcucacugcaaccuacgccuccuaggcucaagcaaucucaccucagcuuacaggcgugcaccaccaugcccggcuaaguuuugaauuuuuuuuguugagacgggguuucgccauguugcccaggcuggucucaaacuugugagcugaagcaauccaucugccucggccucccagagugcugggaaugagcacuuaauuauuuguugucuuggguuuucuuccuauguuguucuuacauguauuuauccugucagcccagggaaauugcauuaaaaacaggaaacaccucuccauuaggaagaaaaacaauuugcuuacagggcauggcauagagcuggagaugauagugccaauaaauacuagguuggcagggucucagaguuuuguguccaacucaguauaauuuuauguuuguuuuaaugugaucauuucaggagagcauggaaugucaugaaaacagcaccaagagcaaugucuuagacuuuuaggagaaacuuagaugcauuuguugaauaucuucuagacugaaaccuuauuucccuuauuagccuaugaaauaaaugauacugugagacuuaguuaaggaaguuacuauuauuccaaguguaacuuauuaauauccguaugugaaagcauuuuugccaaagcuuguuugauguucagcugacccuugcacaacgugaguuucaacugugcgaguuugaacuguguggguuuaucuaaauguggaucucucucaaacacaguuggcccuuuguguccacggcuucugcauccacaaucaguguggaucaaaaguacaauauuugcaggauuugaaacuugcagauacagagggccaacauuuuguguauccaggcuccauggggucaaauguaggacugggguaugcuuggauuuugguauccuugggguguccuggaaccaauuccccauagauacugggggacaacuguaguuugauuuuauauauuauauaauaugcaguuaauauauaauacacauuuaaaaauuauguagcuuuggguuuauugcuauauguaaaugcuaguuucuauuccuauauaugaauaucacaaguaauaaaguucucauuaaucauuuuuuuaggaucccaaagaauaucuuccauuucuuaauacacuuaagaaaauggaaacuaauuaucagcgguuuacuauagacaaauacuugaaacgauaugaaaaagccauuggccaccucagcaaaugugguaaguguggggauuaguauguuuaucucuacuucagaucuucuuuggaacuaggcaagguauaaauuaaacuguuaguuuagacagugacugauuucacuucccacuccugaaaacucuaacaauuauguaugcucacguuauuuuguccuguguucugaaaagcugaagguaaucacuuuuaaugaacuggaggagcucccuagguaagaacgucaaguagauccuuuuuugguuaagaaugagcaccugugaaguuaacuucagugucucagaaucaaaauugguugucaguucuuccuucucaugcuguuugcagacaugucagggaaacucugcuugucuggagagagugaugaggccaccuccccgugcccugcaagacgcaguuuuaauugacagugauggggugccaguuguucuucccaugcuggaacaguugugauucuuuacugaggacugaugggggaaaggaagaaucaccuggggugcauguuaagccuucagcugcuggcauccuuggagaaucugauucagguggucugggauaggacugaggcgugcaugugucuaauaagcuucccaggugaugucuuuucaaggaggcugagaaaacacugggcuggaaagcugggacucuuaaguaggaugcugaucccaaucagugcugcucuugccucagaaucugcaguggugcucauuaaaaauucaaauuccaggaucccauucuucagauucucugauuauuuaggucuuaaaaaguuccucauuuauuuuguuuggugaccauugguauaaaugaaguccauuaugcuucccaugucuuaagccugucuuugugugaaucuuuuuccugcaggaccugaguacuucccagaaugcuuaaacuugauaaaagauaaaaacuuguauaacgaagcucugaaguuauauucaccaagcucacaacaguaccagguaugugguaugugaaaaugaggcucuccugguuuugcuuuuugcuuuaguaggaaaggagugaggauccuaaguucauaacaccauccuuggcuucaaaauuuaucuuaaaacuaauuagccucaauuugaacuucuuaucugggagaaugguccugaccuguucucugauuccucaucuggaauaccacagcaccuuccucgugggguucccugcuucuuucccaccccuccucuagcccaaccuuacugcuguaagucugauuauccuaacaaguacagaucuuucccauauauuucagcauaaagggaaauuuuuguuugcuugaaaaagcaucccuuuagcuuuuuuuauauaccacacacuuugcuucuaaguuaaauguguuauaugauccucuuaacagccucauagggugcuguacacaauuuguagaugaggaagcaacuugccugaggauccagagcuacaaagugcuggaccugggauacagagcccaggcugccugaccacccugcccaugccauuaaccaccacucuaccaugccaccagcaucaccauuuucaguuuguccucagacaauauacacaucuuucuuugaucaagccccugccagcuucuuuagcaccagcuucugccacuguccacauucccaguuacuuguagguaguucuacagaugucacaucgugugauuccucugucauuucucuacccaccagccuuccuuuagccccauuuguccaucagaacccuuggguuacuccugaaugccauuccuggaccaggcgccaaacacugagcccccagagcagccugcccucgccuuggugauugcauuugucaaacugcugauuagcugguuugucgccuccaccaggcugugggcuccuuaagggcagggacuccauguuguauuccucucugaaucucuggcuaacauccagccuggagaaucgaggauuuggccaguggcuaccucuuugcccuuguuuucuguucucuuccacacucucucugcucuagucacacuggccguccuguuacuccucagaccugcuauacacauuccugcugcauggccauggugccuucucugcccucugccuggugcccccuaucucaucacgugguuuauucuccugacagccauuagagcucacacucccugagagcugcaaggagacuguccucugucccuuuacucacguuugccauuaugcuauagacuauauuuugucccuaaguccauccucuguuacuauaagagcagcaacuugguggugguucuuauaugguuuuucauuuguuugguuuuauuuuuugccuugcuguaguauccauacugcccagaauggugcauauguaguuaagaguaauuauuuguugagugaauaaauggcacauccucaguaagguuuugaaugaaaaaaugacuguacuaacugaucaacuguaagauuuucccagguaauucuuucaagggaguuccaaguauaggaacuaaggcagcuacacuggagcuuuagagaaaugauugucauauuuccuccucaguccuaaaucuccucuugucacaggauaucagcauugcuuauggggagcaccugaugcaggagcacauguaugagccagcggggcucauguuugcccguugcggugcccacgagaaagcucucucagccuuucugacauguggcaacuggaagcaagcccucuguguggcagcccagcuuaacuuuaccaaagaccagcuggugggccucggcagaacucuggcagguaaguacaaucauuuauauguuuacaucuacaaagguuuuaaaaaauuuauuucuuuuguuugguaauuuugcaaauaaauuuagggcagaauacucugagacagucuuguucucacugauaaaaauuaauuuagaaugcuuuaaaggauaagcuacuacagcaagagucccagaaugcaguggcccaauauggaaagaaguuuauuucucucucccauagggauuuauaggcccuuccguuguguggcucugcaaccuuuuaggcagaugguuguagcuggguuaucuccacagcuguggggaaggaaggagaguggggagaaguuagaaucaugguaaaacauuuaccuuuaaguuggaaaugaccuggauggaaguuaaacuaucaccuucuauuccaucucggccacgccauguagcuggaugggcugugcccuguaagaagguaaagaugaauuuuuggauggguccauucuguuauagacaguagguuguuggaauagccaggaaugagguggggaaaauaaaaggccaaaugucgaagcauucugaaagcaaaggcaguuuagcugcgucagggacaaggguugcccgaaccagaggcgaggcugguaccaggggcucuaguaccagaguggaggaaaggguaaggacaccuaugaaaagagaugagcagaagcucuggucaucucagcagugcuugaaguaaagcaaugacugguauauuuuuuucccuaacuuguaaauauuguugagaucucaaagaaaaaaauaaaaagcaguccuaaaaaaauuccaaacucuauccuguuaaauuuuguuaaauuuauguaccaguccuucuuugucauuugcaguauucuuuuuuucuugggauuauaccaguguaugggauuaucacuuuucuuuuucugguuauuagccuuucccaaaucccuccguuuccaugcuggccucuuuuuacaaaugucgagaauuccuuauuucaggccuuuuaguuauucguucggucuccauuguuccuuucugcuuuagaaauuuaugauauugguuguuuauaccuucuaucucuguucuuggaucucuucuauucuuuacagcucuuagcuugcuauuucccaugucuuaugagggaguauuucuaguuuuucucagauguuuagcaaaaguagguggggagggcaguggucaaagauguuugagaaauguuacacacuggagucacucuguguguacauuuaacguaggcaguuuacacaagagagcaaaagaaagguaacuauuuaaauaguggaggugauuuuaccuacuuuuuuuagugauauaugcacuggagugagcaugcaaugagagaccggaaucuaccagcuccuucgaaagccuuggguucucugugccucucauugugguuuaucucaauugggcugagagugauucuaggaucuaaagacacugcaugacucaaacauaagucagcuaccuccaucuagugcucaaccaaagaaauaguggucucuuacuguuaagggacgaagugguuuagugagagauaccaggucauuuucccauauacaugcuuuggaagcaucuuucaaggcuaauuuuggcuguauaugauuuucaauuccugugcuaaauuuagauucuagcugccauuuaagauaggacucugugguguauauaccuauucccucacagaaauucagaaaguacauaguuucauacauaauaaagacauauuaaagaagcacuugagcuaaaguaucuguuuaacuuuguagucaacugcugcuuauugucucuacaggaaagcugguugagcagaggaagcacauugaugcggccaugguuuuggaagagugugcccagguaaacucaauuccucccuucuaaaccccccagucagcaagaaaggucuucucaauuguaucuuagugaucaugaaaguuaaaggaacugugcauaauuguuaaguccagagauaguguuugccccagaggucuuaucuugcuggcuugacuuggaaaucuaaauuuaguacaucucuaaguuuggugagguagaauaugaaggugcucuacuuuaacauaccacugguuugaccuugguagaaaguacuuaauuacaucucaagguagcugugcuuuuuaaaauugaguuugccaaaguagaaacaaugagaaaggaccauuauaaaacaggaucauugaaggcuacauacucuuggcuuuuacucucauucucccuauuggaaaugucucuuuuaccucagggaccuggagguacagcagauuauaaggauaaguacccauaugagcauuugguaguauuauaggauuuauuaugaaaauaauaaaacugcaguaacacuggccacagacuaacaguacacaggugcacaguugacaccagggauuauugccuuguagaguuuugaccuuugaugagagaguguuuuuuacaguuguuacugauagcacauuuauguaacuuaauugugcuuuaaaaauauuuaauugucucuuguguaauaacaguaagugaaagacgauaacuaaaauuuuauauaauuagauccuggagagaauauuuguugggugauugaauugaaaauaccagugaaugaaacauaccuaaaaggguagauagguuggguuggaaagauauaccacaucgaggguuaauuaaauggauaagaugucauuaucuuuuuuucuuuguaaaggaagauuaaugcauaaaauuauuuuguguaauuuacauacaauaaaauuauguguuguacaguuguauaauuuacauauaauaaagcuaauucaccaauuuuagaugaagaauucaguacauuuggacauauguuuguagcuguguaaccaccauugcacucaugaucuagaacauuucuaacacccccaaaaguucccuacuuccccuuuugcagucagccuucucccuccacugccagccuuuggcaaacugaucagucaguaaaguuucacauuaucuagaauuucauauaaacagaaccauaugguauguagucuuuuuaaucuggcuccuuucacucacauagugcauuggagaugcauccauguuguaguuuauuccuuuguauugcugaauaguaucccauuauauguauaugucagaauuuguugauuuaccaguugauguacauuuggauuguuuucaguuugggguuauuaugaauaacgcagccaugaacauucuagugcaggucuuuauggggacaggaguaggaaugccacaucccgugguaaguggauguuuaacuuuuuaggaagcugcagaacuaaucugcaguggccguaucauuuugcauuccccucagugauaugugagagugcuucagugacuccuauacucaccaacacuggguguauuacugugacacuagauguauuaucuauugcuacguaacaacuuaccuuaaaagcuggcagcuuaaaacaacagacccuauuaucccacuuuuucaaugggccaagaaucuuggcugggcuuagcuggggccucuggcucaggguccuuuacaaggcugcaauuaagguauuggccagggcuagagucaucucaaggcuugacuaguuuuuaauuucauuuucuaauguuuuauuacuaguauauagaaauauagcugaaguguuuugcagggaggcuguauaauugaccuuguauccugcaaccuugcuaaacucauuuauuaguucuagaagcucuuggguguauucucuaggauuuucuacaucaacaaacaugguuucuauaaauauaguuuuaugucuuucuuacaaucaauacuuuuuucuaucuguauugcauuuucuagggcuuccagugugguguugaauagaaguguuaagagugaacauccuugccuuuuuccugauauuggagaaaauucacuugucuuuuagcauuaagugucauguuugcuuuuuuaaaauuuuauucuauauuauuuuauuuuugagacagagucuugcucugucacccaggcuggagugcaguggugugaucucagcucacuacaaccuugaccuccuaggcucaagcgauccucccaccucagccuccugaguagcugggacugcaggaacaugccaccaugccuggcuaauuuuuguauuuuuuguagggaugggguuuugccauguugcccaggcuggucuugaacuguuggauucaagcaauucgccugucucagccucccaaagugcugggauuacaggcaugagccuccgugccuggccugauauuugcuuuuuuuuuuuuuuuuaaugcucucuauugcagaguuggcaaacuacaaccugugacaaauccagcaugccaccuguuuuuguaaauaaagcuuuauuggagcauagccaugcucauuaguuuacaucuuguguauggcugcuuuaacacuacagcagcagaguuagaguugugacacagauaguuuggcccauaaggccuauauuuacugucuaaucuuuuacaggaaaaauuugccaauuccugcccucuugguuugaggaaauucccuucuguuccuuguucugagaguuuguaucaugaauggguguuaaauuuugucaaaugcauuuucaacuaugaaggguuuuguuuuuagacgagugauaugggggacuaggugauugauuuucuacuguuaaaccaaccuugcaucucuggguucaaccccacuugguauuauagauuuauuacccuuuuucucuuguggcagauuagaucuacuaaaauuuucuugaggauuuuuguguuuguguucaugagggauauuguaguuuuuucgugucuuugccauguuuuggguaucaggauaaugcugcugucauugaggggugacaaaaaugaggggugguguccuuuacacuucuguuuucuggaggauuucauguagaauugguaugagagucuagcuuaugguuaaaaaccuaugugugauguuucagaccugaccauaaacaauuacagacuuuaccuaggaggccacauggggaaaagcugcccucccuacaccagacuuggcguacugccaaugcauuacaguuucuaaagggaguugcagucaaggacucagggcccccuguuagucaugcucuuguaacaguauuugcauugagaguccuggcacuuucauucuuaggucucucuaucugaggccaugggccaaggucuucuucaggcaccucugccaaggccuguuuaugcaagaaggaguggaaaaaccuugacauuuuuuuccacugugacucacuacccaguacuuuuccacccuuagcccccuuccuuugcacccauacccccaagauccaucaaacugcuaaagccuuuuuuuccaagcuccuucaacagugaaccaacccucaugucuguguggauccagcugacucuugacuagugaguuguuccuugggaaaaaauggaacagagagaguuggugcuuucccugguuuuagccucuugcuuauaccaaugcaaugccugaaggcuuaauucauuuuugacuuguugcuuugaucagcuacuccaacaccugacagcucagcucuuucucccagcucuugggagauauuuuuuucuuuaaauguuuaguagaauauaccaguaaggccaucucggccaggaguuuucuuuaaugaaagcuuuuccacuauuaguucaguuacuuuaguagacauuagccuauucaaguuuaucugugucuucuggaaugagcauugguaguuuaugucuuucaaguaauuuguucauuucaucuaaauugucagauuuauugguaugaaguguuuauaguauucucuuauuuuacuguccguagggucuauggugauguccugucuuucauucuagauauugaugugucuucuuuuuucugauuauucuggccagagguuuaucaauuuuauugaucuuauuaaagaaugaacuguuucauuguuuuucucuaugauuuuucuguauucuauaucauucuuuuuuuauuauuuuauuauuuuauuugcucuuuauuuuucuaguuucuuaaggugauggcuuacuuuuauuuuuuucuuauuuuuuucuuuuguuguuguuguuuuuuuaaagaaacagggucccacucuugcucaggcuggagugcaguggcacgaucaugguucacugcagucucaaacuccuacauucaagcuguccuccccccucagccuccagaguaguugggauuacaggugcaugccaccaugccuggcuaauuuuuaauuuuuuuuguagagaugggguguuacuaguugcccacgcuggucugaaacuccuggccucaagugaucccuccaccucugccucccaaagugcugggauuccauguguaagccacugugccugaccaaggugauggcuuaaagcuauugauuugagaugauuccuuacuuuauaguuuaagcauauaaugccauaauuuuccucaagcaccguuuuaguuauguuauacaaauuuugaaauguuuuguuuucauuuccuaauuucccuugugauuucuuuauugaaccuuggcuuauuuagaaguauguuuaacuugcagauauuggagauuugccagccaucuuuuuguuauuaauuucuacuuuaauuuuguugugauuagagaacauacauuuuauuaauuuaaauuuauaauuuauuuuaauuuauaauauggucuguuuuacagaauguuguguguguauuugaaaauaauaugaaagcuacuauuauuggauggaguguucuauaaaugucaguuagauuagguugaucaugcuguucuagcuuuuuauauccuuauugauuuccucacuacuugcucuaucaaugacugggaaaguguugaagucucccaguauuugucuauuucuccuuugauucuaccaguguuugcuuaauguauuuugaagcucuguuauaggugcauacauguuuaugaguauguuauagauguauucauuuugauauccuucuuucucuguuacuauuccuaauucugaauuugacuuuaauguuauuaauauaauucuuccagcuuucucuugguuagucuuuucauugcauaucuuuuucuauccuuuuacuuuuaaucuagcugaauguagucuuuauuuugaaagugcguuccuuguugauagcauuauugguucuuuuuuuuuuuuaaaucuaauuugacaaucucugucuuuuaauuggaggguuuagacauuugcauugaaugugauuaccaauauaguuagauuuaaaccuacagucuugcuguuugcuuuuuguuuguuucauugauccuuuguuucuuguuuuuuucuuuuuuugcuuuccuuuggauuuaguauuuuucauaauuccauuuuaccuccacuguuggcuuauuagcuauacuucuucauuucaguauuuuagugguugcuguaggauuuauaauaaauaucauuaacugaccauaucuucagauaaucguauacuacuucauauauaguguaaaaaccuuacaagaguauucacuccauaauacuuuguuauugcuuuugcuuuaagugaucaaugauuguuuaaggaaauuuuuuaaugaccuuucauguuuauucuuuuuuuuuuuuuccaaaagauucaguauuuuccgaguuuucaaaaacugcuggccacucaaaguggaucaacaaaaauuuaagagcuaaaacuguaaaacucuugaaggcugggcacagagguucaugccugugauuccagcacuuugagaagcugaggugggacaaucacuugagcccagggguuugagaccagccuggguaacauagaaagaccuuguuucuacaaaaaauaaaaacacaauuagccaggcauggcggugugcaccuguagucccaacuucuugggaggccaagguggcaggauuuccugagccuguaaguuugagacugcagugagcugaguucacgccacugcacuucagccuggacaacagaacaagacccugucucaaaaccagaacgaaacuauaaaacucuuagaagaaaacagggcuaaaucuucaugacuuuggauuuggcaauggaugguuagaauuaauaccaaaaacacaaucaauaaauugauaaauuggauuuaauaaaaauuaagaacuuuuguguaucaaggacauugucaagaaugugaaaagacagcauauagaauggaagaagauauuugcaaauccuauaucugauaaagguuuaauauccagaauauguaaggaacuccugcagcucaacaacagaaagccaguuaaaucaauuuugaaaugagcaaacgccuguaaacccagcugcuuggcagauugagacaggaggauugcuugaggcuaggaguucaagaccaaccuggacaacauagugagacccugucuaaaaacauuuuuuuaauuagcugggugugguggcauauuccuguagucccagcuacaugggagaccgaggcaggaggaucacuuggggccaggcagucaaggcugccgugagcugugauuaugccacugcaucccagccugggcgacagagugagacccugucugagaaaaaaaaaaaaaaaagaacaaaaaaaaauuuagaagauugcuauucuagucuacuauuuuuucaaaggguggucuuguuaacaauucuggagcccaccuaaaccugcuaaaucaaacuugguaguaaagcuggggagaugggcaugucuaacagacguuucuggugguuuugauguccaggcgugcagagagaugaugcuuaccuuguguuuugucauuauuuucaggauuuacaccccuuccuugucuuuuguaucaauauuuauggagucaugaacucuaggauaggcaugauguugagaacuaggaguucuccccuggccagggagauagaggcaggucugugguuaguuuuguaguuggcugugaugacaucugacaugcucucuucacuuguugucuucuuccuguucccuugucaggauuaugaagaagcugugcucuugcuguuagaaggagcugccugggaagaagcuuugaggcugguaagaaucuuguaaauccucuggauguugggugcuaagcagagagagcaagcaagggauuccaggucaguuggaaucucuugucuucugagguucaugaaauaaguagaaauaggucagguuccuggcuuaaggaaaagcgguguuuuuaaaaucauuuuuaucauucuugauaauaauuugaaauauuacugucuuuuacugaaaugaauugaauuuccuuggcugccuuguaggaggccuguuuuucaggaaaauauucugauuaccucugaaaguaauccaugucuuucuaaguaucuuaacucuccagugacuagaaguuuuccuuccuaaaauuauuguguuuuuccuucuagguauacaaauauaacagacuggauauuauagaaaccaacguaaagccuuccauuuuagaaggugaggguuccauuuuagauagaauuccucauuuggaagaaggugaggagagagagaugagagagucuccuccuauuuacuguguuuucuuaauaauaugucauguagacucaaucaaaauuaccaccuggauauaauauuuaauucucacuagaauuuuuaaauaugcugaacuauuaaaugguaacaaaauauuuaaauguuagaaaccugugaucaaauaugauuaagaaucuuuguauuuggaaauaguaaacuugaauaugaacuauauuagauaauaauauaacacugauaaauuucuggcauuuaauaaucauguugugguuauauaagauaauauccuauuauucucaagagauaaaugcugaaauauuuaggaaugaaggaucauaucucugccuuacucuuaaaagguuccacaaaaguauuaaugaauguguguaugcaugcagagaaacaggaagcaaaaaaaugucaaaauguuaguaauugguaaaucaaaguaaaggguauauguguguucauugaacucuuacaacuuuuauguagguuucaacguuucaaaguauuuuuuaaaaguuaccuuuucaaaugaaguuugugguucuuagagaacauaugaauauuaccaguucuagaauacucagauggucacugugaccucuuaaaagcaaaguggagaaggacaucaguuugacuuauagaaaccuuagggagugguugauuuuaaguucugcauuuuuaugcacaucuacccuguaaguaacgucuggccuuucugacauuuacauguaugcacauucuuaccuugucugcacccccuuccuccauccuaauuaaaacguugcugggguacuuuuuaugucauucacuuuagguaccucuaacuggguacugaaaacaucauuccucaucuauaauaaucuaaccagcucuuacuuagauuuucaccacuaaugagaaccuuucuuagauaaaugccgauaauucaucuacauaggcccaaaaccuauuaauaaaaugcauccuuggauaguaguauuuugcuuuuuuaaaauguauucuacuaguguuauuuuucucuuguguauuuuuccauuggacaauauuuauuagauacauuuuuuccacauccaugggcauuuugauggauguuuagccagaaacauuuagguaauuuucuucuuauuuuuguuaacugagcuccccuccccuacccccccuuuuuuuguuuguuuguuuuguuuguuuguuuguuuugccaauccucccuugcuuuagguaucaagucuucguucaggugauuuuacaaguucagugguagcgcauauucugggauaauguugaugaacucuaagaucuggaaucucagucucuaauuuguuaaugcuuauuaaggaaaaagagcucgcuuggaaaaccuaguaaccucuuucuuuuugcugaauuuuaacccuccuucacugcuccccgccuuuaguuuuuucucuuugcuuaaaccucaugcucaaacuauuuuccauucugcaucuccagcccagaaaaauuauauggcauuucuggacucucagacagccacauucagucgccacaagaaacguuuauugguaguucgagagcucaaggagcaagcccagcaggcaggucugggugaguaucugcgugaaggccaucgacgugcgggggcagugggguuggguaacgccacacauugucuagauugcuuggugauccgccugcaaucugauuacugugccaugggcaagugugaggcuucuguggagccccuucagggcccucugugucuguguuuguguguuggugaagggcaggaccaagcaugaauggggagagcucugccagacauucccaccuacccccauucacccagagcagcugaccacuuccgugucuaacaaaaugaguuuccucauuuccagaaaaaaguucaggaaacuacugauuuacauuaguaauuacuguauuuaauauuaucucauucauuuugagaucaacuuugcaaucauuuucauccauccuuugauaugcaccaguugacucuaguuaguucauuuaccgcccugaaaguaaacccacacauuagcaggcaguguuuucaucggcuucugguucuucuuuucuagaugaugagguaccccacgggcaagagucagaccucuucucugaaacuagcagugucgugaguggcagugagaugaguggcaaauacucccauaguaacuccaggauaucagcguacguaucacauugauucagcacauugacuauauccugggcauauagggaaaguggaagcaaauagauugguuuucuacugggacgguguagugggaguggggagaauauucuucagcgcuguguggaaguuguucagacacuuucccagcauaucugagacauuaaacuuggcauuggaagguuuucuuccucagccuuguggcuuguguguuuucccauuccccacgaggcaguuccuccccugaaugcucaguuuauauuaacaucugauuuuauuuuuugaacaaauguugugacuaaauuauaggcacugaaaaaaugaaaagauaagcuucuucaauucaaaaucaggauuggaagagaccauaaauguaaaauaagucauaacacuuuuaccaaauauaguaauuugucagaaauauuuauucagcacucauaugguaggugcaguagauguuaccaaaaacuuauaaggagauaugaguuauaagaguuuauagucuugcuugggauguguaaagcaaugcaagauuauauauucaaacugaauuuugcuuuaggaauuuaaaauggagaucugugaaguuguguggggucaucagcaacugcaagaaaguagccaggcaagguagcacaugccuguaguccuagcuacucaggaggcuuaaaaauaucuguguaauuucuaacaggagaucauccaagaaucgccgaaaagcggagcggaagaagcacagccucaaagaaggcaguccgcuggaggaccuggcccuccuggaggcacugagugaaguggugcagaacacugaaaaccugaaagguauauucucaguccugaugaugauuccugaccacaaacaauagugaauaggcaguacagacaggcagaguucaguaggugauuaagcuaccauuuucccaauuugaggaaagaugagaacuuuuagcaggaagggucaugucugcacacauuccugaagcagcccuucuuagcugguaacugagaagccuuccuccauuuggcaucccccuaacugaacugggagagaugcuuaggccaggauaaagaauugugggacacugcuuucugcguaggccccccagcgugcuugauuuucuuuuuguaguacauguguuuaauuauuccagcauuugggaagaaaaaagauaaugugggagaaaggaccugcagugggaucauagaaauuuuuggcuuuggauagaagcuauguaugauucugucaauggagcugggaauauaacuuaccacucuuucaaauuucuucucucuagaugaaguauaccauauuuuaaagguacucuuucucuuugaguuugaugaacaaggaagggaauuacagaaggccuuugaagauacgcugcaguugauggaaaggucacuuccagaaauuuggacucuuacuuaccagcagaauucagcuaccccgguaaguuuucucagagacggugugcauuuuuuucaucauuuucauggguuauuguauucacacaaucuccaagucaaaaaguuuuccuguucuuaaaacauaagaugccauaguuaaauuaucuuagauuuauguguaagcugucaguaagauuugauauuugccuguagagugacuaguauaccuuggcauagguuaaauggacugucauuuuccuuucuggaugaaguagcugucauggagaaaaugggaaagucacaugauugcuccuggccuucaaugagguuggaguggggagagaugggggaagauggggucagagacggccucucacuuuccuuucagaacucagggaugggaucaggcuuuaaagggaccccaggcaauugcuuuuccuuuuguuuuaugaaaaauuugacuugucacuucuauguuguuaugauggacuuugcggguuguguuuaaggcugaaucagcuuuguaucgcagaauucuaguauauugucaucuguuuauuauuuauaccucuguucacucucuuauacuucaagucuauuguuaagaguuuuuauuuggauucaaaaaggcugguguaucagucaagaucuagaaaggaaaacaaaagccuaucuauuauuuuaucacagaauuuaauauauggauuuguuaaauaaguauuagaggacuaaacaaggcaaaagggaaauacagaggaaggacauugagauaguaacuguaggaagcagcuuuacccucuagcugagggaacaggaggaguuguugggaauuauuagaauuuagaagccuggaaguggggcccuguagagcuggcucuugaaccucugagaggagggugccagccagcuaauccuggcauuucugagggagcugguuccaagcguacagaaguaaauggaaacuggaaggaacagcugcugcugggggaaaagccagccggucgggccagguguggugguggcucacgccuguaaucccagcacuuugggaggccaaggcaggcggaucaccugaagucaggaguucgugacuaauguggccaacauggagaagccccgucucuacuaaaaauacaaaauuacccgggcaugguggcgcaugccuguaaucccagcuacucaggaggcugaggcaagagaaucgcuugaaccugggagacagagguugugaugagccaagaucgugccauuguacuccaaccugggcagcaagagcgaaucuccguuuaaaaaaaaaaaaaaaaaagccagccaaucacggaagaaaucuagaaaucuuuuguucauccuccagcuuuguacucccccucugguguucacuguaggcaggacaugaugggaagccagcagcaaggaagaauaucuuucaggugcccagccccagcaccacaagcaguggauagaaggguggguuggagcugagagauuacaaaucagcucaguguuuagaaacacauacgcuuaucaugucuugauuuccucauuuagaaaugggcauaagacuucucugugugcuucaauagaaugcuuugaagguuaaauaagaggguguguguaaaagcacuuuacaaaccguugaaauaaaagcaacuaggaaucagggccccagaacuucuugaauuuauuauaauagguauuucuuagaagaaaugugaucaucaucuucaaaacuguaguacuuuugaagauaauuguuuuuguuuuuugagacagggucucacucuguugcucaggcuggagugcagugaucaccgcucacugcagcauccaccgccccgggcucaggugauccucccaccucagccucuugaguagcugggacuacaggcgcaugccacaacaccugguuaauuuucaaauuuucuguagagacagggugucaccaaguuguccccgcuggucuugaacaacuccugggcucaaguggucugcccaccucaccucuccaaagugcugggacuauaggcaucagccaccaugcccggcuugaagauaauaauuuauaauaccacucccaugagugaucuucucuucugaucacauauucacauuaaggucuauuuuauuuuauuuuuuucuugcucugucacccaggcuagagugcagugacaguaugaucaaucauggcuuggugcagccucgaaugccugggcuaaagcaguccucccaccgcagucuccugaguaauugggaccacaggugcacaccaccaugcccagcuaauuuuaaaauuuuuuccuagacauggggagagggagucuugcuguguugcccaagcuggucuugaacuccuggccucaagugauccuccugccuuggccucccaaagugcugagauuacagguguaagccaccaugccucccacauuaaguucuaagacaucaauuuuaugauugugguuuugauuggugaaguaugguugugguaugugcaggauaccgugagugacuucucauggcauugcucuugagagugugccaccaagggucugcacuaaccaggggugugcccagaggcucgcugcaggcuugaaauuccugcggagucuuguguuuuaccuggagcacaugugcacaguuuccauucugcuccauaguaugcacauguuuguauuuauuucaaccuaaaaauguuuguuucccauaacucuuugcguauaauugauacucuacguauuuguagccucuuuuacucuuuucccuuuccucagggagugguuugcucauuuagaaaaggccaagauauaucacuguagaguuucguuucuuuucuuuuccuccaccccccaucuuuaccuuguucugggagaaaggagaauuagaagucugaguugcagcuggagaaacuggcaaauuaaaaucacauugggaaagagaauuacuguguuucacaccauaccaguagaaaugacaggcuguuuucuggggguagggauuuggccuuugguauuggcagucuugagaaguauuagauaaucuuugcugauacagucuauuuucuccucagguucuaggucccaauucuacugcaaauaguaucauggcaucuuaucagcaacagaagacuucgguuccuguucuugguuaguauuuuuucucauuuaauauuacaauacuaagcagaaggacuaucuuucuguaaguauugagaagaucagcaguauaaggagagauuggauacaauuuuucacuacaaaaaauugacuacaauucuuccucaauucuaagaccgcaucuuuaguaugaucaguuucaugcuucuagcggugggggaccuggugcaggaaaauccagcaugaccauuguauguguaauuuuuaaaaauauuuauguggcauaugcuuguucauaaaggcacaccacaguuccaguuucagucuaaacugucuacauuuacauauacaucaaaagauucuucugaagcaucauuacuggcuauuggcaguuaugcuuugcaucuugggggcauuuucauaaaccuugcuuaugagugggaccuuuuuauuauguuuaggauugacaauauaauuugaaggcaaauccaaagaauauuagcauuuuauacauauuuccuguuuaguuaugcaugaaguguuuuauuuguugaggggagaugauucucaauuagauuacuuauaucccuaaaaauuaaaaacccuaagcgcuuucuuuugaaaguugguuagaaacauuugaugagucagcuugggacuuucaguauuugcccuuacuuauaguuggaucaaugaagcaucuuagcuuugaaaagugaaugauaguuucuaaaauaauuggcaguuuuaacugcuauuauuugcauuucuagcaugugacaagcaacuuucugaaauuuuuuuucaccgaagugcuacacuguaauagcauuuugaugacauuugaaguagccuguggggauucaaauuaaguuugacuuuaacagcuuauguugcuaccaggaagaacagcuaccuuccaucccagcuaaacucauacauccagacuguaacuacuguauuccuagcuccucuucugucuagagaauggcaagguucuuuugguaucaguuucgacauauccacuuauuccuuuuuuuuucuuaaguuuuuucauuuagaaaaaaaaacagauggggucuuaauauguugcccaggcuggucucagccuccuggucucaagugauccuccugccucggccucccaaagugcugggauuacaggcgucugccccugugcccagcccacuuauuucccagaugcuaggaacuuacauuagaccugaggccauuuggucauuguuuauuuugugcuguaguccaauccaguugugauuucugccuccuguguuccucguugcuggccugaugcugaccuucagguuaggucagucccaucauuccccaggguauucuagauggcuuucccacuucaaagagcacuuucuuguuuuccagcugagccuuaaagacacucuguaauauuugagagccccucauuaucugaguguuuauuaucauuacccuugugguuucaaggauguauaggaaaagguaaguuccuauaauucaaaaauugccacugaugaacuaaucacaaaauuagugccacucaaauauuacucagcugccccuccccagcuaacaauaguuaaguauauuggcacauccccacaagugaaaucaaugacuugaugggucauuucugauuguuuccugcuuugaugcaauacaauaucaugcagaucaauugcaagucuugcaaaaauuuaguauuacauaaaauagauuaaaaugauauuggaaaaguacuugaaucacagcuggguuggacuuguugcaauugaugacaaaauaagugcuucaaaugauuuugacuaucaaaggauugagagagguccuuagaaaaauugaaaagcccucaaguuauuuuuauaaaaauggccuuuuuugugugcugugaaauccacauauggaaaugugaaauaugucauguccugcugucauauaauuugucagaauaauuacuuucuugcccaaaagucuguacuuuguguuuauuucaaguuaagucuagaaucaaauauaguuguaguuaugccuaauuuuaaaaaaugagauagagcacauuauuuuuguaacuaguuuuuuuuuuuuuuuuuuuuuuuuuuuuuuuuuuucagacagagucuugcucuguggcccaggcgggagugcaguggcgcaaucucggcucacugcaagcuccgccucccggguucacgccauucuccugccucacccuccugaguagcugggacuacaggcgcccgccaucacgcccggcuaauuuuuuuguauuuuuaguagagacgggguuucaccguguuagccaggauggucucgaucuccugaccucgugauccacccgccucggccucccaaagugcugggauuacaagcgugagccaccgcgcccggccuguaacuaguuuuuuuaagauaaagucuuauuccaacuuuaauuggaauuuaugaaauaccuuguugauagugaauuuauuuaaguagccuuuuuucaguauugauauucuuauaucuuuauggcaccauuuaguggagagaaauguaaacaaacauaaagauguaguauuaaaucauaacugcauaaaauuaacuguaguauguacugcacuacuguaauaauuuuguagcuaccuccuguugcuauuguggugagugagcucaaguguuaccaauaucugcuuaaaaugccaugugccgcuaaccaucuccacaugagcagcacaugagagucuccauuaauugcauauggcagcgaaaagugaucucuugcauugucguguauuuuuuaucacguuuaauguaauaucguaaaccuuaaauaacaccaugagaccuauaggaaguaccacaaguguugcucccaggaagcagagaaaagucauaacauuacaagaaaaaguugacuugcucgauauguacuauagauugaggucugcagcuguaguugcccaccacuucaagauaaaugaacccagugcaaggacuauuauaaaagaaaaggaaauuuaugaagcugucacugcaguuaugccagcaggcaugaaaaccuuguacuuuuugcaaaauaccuuuuuauguuguauugaagaugcagcuuuuaugugggugcaggauugcuaugagaaaggcauaccuauacaacuauuaugauuugagaaaaagcacagucauuguaugagaacuuaaagcaaaaagaugaaggaucaaagcuggagaauuuaaugccagcaaaggaugguuugauaauuuuagaaagagguuuggcuuuguaaaugucuggauaauaggaaaagcagcuccugccauccaggaggcagcagcaaaggcagucagguuuaugaucaggacugcccuuaucuguaaagcugcuaacccccgagccuggaagggaaaagauuaacaccagcugccaggcuuuugguuguaccauacaacaagaaggcuuggacaaggagaacacuuuuucuggauugguuccauugucgauuugucccugaaguuaaguaguaucuugccaguaaggggacugccuuuuaaaguucuuuugauacuggagaaugcccgaggccaccccaaacuccaugaguucaacaccgaagacauugaagugaucuacuugcccccaaacacacaucucuaauucagccucuagaucagggugucauaaggaccuuuaaggcucguuacaaacaguacucuauagaaaggauugucaaauguauggaaaagaaccuugacagaacaugaaagucugaaagaauuacaccaucaaugaugccaucauuguuauagaaaaagcugugaaagccaucaagcccaggacaauaaauuccugcuagagaaaacuguguccagaugugcaugacuucacaggcuuuacgacagccaaucaaggaaaucaugaaaaagauuguggaucuggcacaaaaaaaaaaaaaaaaaaaaaaaauggugcaugaaggauuucaagauaggaaucuuggagaaauucaagaggugauagacaucacaccggaggaauuaacagaagaugacuugauggagaugaguacuuccaaaccagcgccagacaaugaggaagauuacauaaaagaagcagugccagaaaauaaauugacauuuguuccaaagguuccaauuauucaagacugccuuuggcuucuuuuacaacauggaugauucuauguuaugggcacugaaacuaaaagaaacuguggaaggauugguaccuuagagaaaugaaaaagcaaaaacaucagaaauuaugguguauuucuguaaaguuagugacacugagugugcccaccucucuugccuccucuuuaaccuccccuaccuguuucaucucuaccaccccugagacagcaagaccaaccccuccacuuccuccucuacuucagccuacucaacguggagaugacaaagaugaagaccuuuaugaugauccacuuccauuuaaugaauaguaaauauuguuuucuuuaugauuuucuuaauauuuucuuuucucuagcuuacuuuauuguaggaauguaguauauaauacauauaacauacaaaacauuuguuaacugacuuuuuaugcugccaauacacugccgaacaacaguaagcuauugguacuugaguuuuggagauucagaaguuaaacauggggccaggugugguggcucacaccuguaaucccagcacuuugggaggcugagguggguggaacgagaccaggaguuuugagaguagccugggcagcauggugaaaccuugucucuacagaaauuagccagguauggugguguacacuuguagucccagcuacuugggaggcugaggcaggagaaucgcuugaacccagggggucgaggcugcagugagucaugaucgugccacugcacuccaaccugggcaacaaaaugagacccugucucaaaaaaagaaaaaaaaaagguauaugcagauuuuugacugugcagggggguccgcacccauaacccuacauucaaggaucaacuguaauuuuucaugccugcauggcucauauguacagauuuacugcuggaaguuuaucauaaauaaugcugaaaaagaaaauccuuauauauacauauuuucuccuaucucugcuugcaguauaugauuccugguuagaaaagaaacuuaacaaaucuaagugaaagagugccugggaguuuuagguuacaaugacagaaucuuuuccuaacccucucucuccauucacuuuuuuuaaagcaggggcaucuuuauugaucaacauguuugucgaaguuucaucauaaaguaguuccuguccauuaacuucacuuacugaauaugugcuaucacauuuugcuauuccuuaaaaauugagcuagacuuuacauauagugaaaugcagagauuucagguguacaauuugaugaguuuuaauaaauguauacagccaugugacugcugccaccaccccucccaccaguuugaaauacagaacauucuuccacuuugaaucacugggugagcaugccugagguugaaaugcagucccuccucucagggcggggccuccagguuguguuugcucugaccuggagguugcagggguagcagacacaugaacucuggcucugauggucuuauugcugcaaacuccaccugccuaguuuguuuaguuuagaguuacugccucagcgcccuccaacaagaguaugucugucacaauuucccuuccuuucuugcuuuuagaugcugagcuuuuuauaccaccaaagaucaacagaagaacccaguggaagcugagccugcuagacugagugacugcaguuaggagggauccgacagagaagaccauuuccacucauuccuguuguccuaccaccccuugcucuuugagggcuggcuauugagaacuggaaagaguaaaaugauaacuuaccuuagcauugccaagaacuucagcagacaacaagcaauucuauuuauuuuauguuguguauacaucuugaucauuagcaagacauuaagcuuuaaccauuauggcaccauuuugugagaaugauuguucuuucacuugggcuguuugagagcauaauuaugguaaucaugagauuaauguuucaugauuucuaccuccaaagugugaagacaaguaaaacaauguuucuaaauugucuuauuuuguuggcggagaagauuacaauggcuauuagugcuacauuuggucaaauguaaucacuuaaauagcuucuugucaccuuaaacuaaagcagaauaaaaaguauccuuugaaauuauaagcccuccuuugcugacagcuauuauuuuguaacaucuuaccaggucaugugcuuucaguuauaacugggcugagccuccuauaauuacaaugucuauagggacuguuuuacugccuguguauuuucugcuagagaguuagcaauguuagagcuagaacagauuagaauuucuaaacaguaucaugcacaguuggugugagugaucagugugcauuguauggcaugcaugguugugaauuauucucuguucuccaaauacuguuucuuuaacucagauauuuuuguuagugucuaggccacuucauuuauuuuucgucaugguacuuu

SEQ ID NO: 13976 - RNA, 36949 nt, Homo sapiens
cccucaagacagcgauucugaaguuucucagaaccgaagcccgcaccaagaguaagaaacucguguuguuuuauuucuggguauuugcuuuuuggcuguugcggaauuugcucagguccagguugccauuugagaggaaccaagagcuggugccugcagccagcucccacaggugccuucugccaggauaagaacauaaaucagacucuaccuuuucacccggaagacggucuaugugccuggggucuagagcuuguacuucuuuuuguccacgacaaagacuuccuagucacuaaguacuuguuagucucuugaauuagucuccucuccagcucacaagcaaagcccaguuuaaucauucccuguucuggagguacagacucuagggccaugcuaacucugauuucucuagauuauuaaaguuuuaccaucacaugauuucaaaucauuggaaauaugcuugcuucuaaaagccuucuccgaacaacaggguucugagggguuuuguuuucaauuaauaguuaguauaaagaaacaaacguuagaacaucucuaauuuucuuugagaaauuuuuuguuaaauuuuuauguccuaccucccccaccccgcuuuuuuaacgugacagaguucccucauagcucaaggacagaaaaaaugucuguccugaaagaugguugagugcuuuuguuauucaauaggauauauuuaacccauuuguuucccuuuuugccuugguuaccagggaguucagaacugcacauuaggcucaauuguauucacuucccucagcccagauuucuuguauaggaccuucucuuccucauuugccuuuguuauaugggucuuuuuuuucuuauuuuaauggauucauaguuacauaucuguacguuuugggguaaacucgcaaaucauuuuuuuaaguagguaagacauagauuauaaauuagguuaaagcaugauaguaaaggaucaacuguuaggaaaucaaccauagucauuggguaucuauucuguuaagccccauacuauuucuaaaauauaguaagauaauggccccccuaacagcugaggauuagcaagcaggcacguuaguuaaucuguaaauuuuuuaccacuguagcuauuaggcugaaagcaucaaaugcacccugauuggacuccaggcauuugcaggugaauugcaaaucuccuucccauuuguaugugaggcugcuaccucuccucuguccuugcccacagcaaacaugguuuccaguuuaucuguguucuuaacaccucugguuaaauaaucccuguggucauucuuuccuugugaccugagcuuggaugaugcuuuugcuaaaugauugcuaucucuuguuccaacuugcagccugcugccccuuugucagggcuacaguggaugauugugaguuccuuugugugacuuuguagcuuuucaaaccacaagcacaucuagaaauacaaagcaggagugcaggcaugcgugacuagagccguuuugagucugcagugggggcucugcggcuuuggcaaaaggagaaaacgguuuagggaagcguuggagggcucugggaagcccacucacaccugcugcgucagagcuuccuguggugguuugcagucccaucacagaauuguacagcaucuaaaccuucccuguccaguacagcagccaccagccccaguugucuauucagauuuaaauuaauuaaaauaauaaaaauguaggcauucaguuccucagucacaugagccucauuugaauugcuugacagccacacaggaguguuggccuccaucuuggacagcacagauacagcccauucccaucacugcagaaaguguugucagcagcacucaucuagacuaacacguuuauuccaucguucauuuaaagggugaaccccuagaauaucuacaagcgaaaagugcauuuuucacacagaauucaugugggaguagguuuggaaucaucaccuugcuugcagucugggcgcuccacaccacucacccagcugcucaucuguggcauggggcagguggauagccucugagugcccucacagcccagcacccucugucucuuuaugcaaucagugccagguggggagggaugcauucuguccaaugacaugcaggcacuuuagagggcuugcauucauucccaaguccagcggcacacuuuauacauccuuggcuggucauugaggggaacaccggagcaaaucagagaaguuguuucaggagccuccaggccagcugggcaaauagcacauuaucagccuacgcugccacacuccagggcucugucacuuuggugaaaggaaaaggggggcuuagggaacaguacgugcccuacaucagauuuuccuccuguggucugcagucccaucacagagcaucuagaccuucauaguccaauacagcagccaccagcuccauaggacuauuuacauuccaguucauuaaaauuaaauaagauuuaaaauucacuccuucaagcacuguuugauguaagugauuucuggcccugcuuguuccuauacauugcacaaugagucuucuugaaaccccuccuugagaccuuguaaagugugucaucuuggggcucuuuuuaucuugcagcuaaauguuaagaauagcaaauaacagugguucaaaggcaggcuuccuugugggguuuuaccaggugcacugacaauagacaugucagggggucaaguuagugacugugcucugcaagugggaugaacagccagaaaagcagcccccaccaccucuguuaggugggagaccucuuccugccggugggaagccacuuugugcugggucuucagaggaggcuggcccuccugagggucugggaacccccauugcuccagguaagaaguacagacuggucuguaccuggugagagaaaaaaagaaaaaaaaaaaaaccuguugguuaguuucugugaguauuugcaaaauguuuacaaaauauuugacauguuuuauacagcagauuuguguuaagaggcaaaaagaagcauucugucagagaaaucggaugaauaauaucacagacagugaggaggguuccuuuuaagaagaagaauuaagugcgauguucuguacucguuuaaaaaagaagaaagagagaaagaaaaagagcgguuagauuuggcuguaaacccagaguggcgcagcucaggcugccugagugccaucuuagcggaugagucacuugcugguuuguuccguauuuauagcagcacagcaaaguuuaugauuauaguuaugaauccuuggcaguuugcuuugugcccaaguaggcugcacucuuuuguugcucccaagguucuaucagccauuguguguuccuuucccugcuuccgaaugaagaccaaauucugcagagaaguaaguuucuuucauggcagaaaugaaaaagcuaccacucuccacccagauaaaagggagagaauguucccuaaagaaagagacaugcagaacagaaacugggggaaacacauuguagagcaguuuagaguuguauuagaaaaacuuucugguugcuauuuuaucacaguugucuugaugggucaccagcaugacacccuccgaguggauggggcuucaugccugcauaacuucuucgcuguuugccucuuuccuuagagccugccuucuuccaugggauuuggggcagccauuguuuuuuauuucaaaaauucugugcuggccagccauaguggcucauaccuauaaucccaguacuuugggaggccaugcuggucagauugcuugaucccaggaguucaaaaccagccugggcaacauggcaaaaccccauuucuacaaaaaaaugcaaaaauuaggcgggcacgauguugucugcguguuguccuggcugcucgggagguugagaugagagaaucacuugagcccaggaggucgaggcugcagugagcuguggucgcaccccugcacuccaggcugggcauuggagugagacccugucaaaaaaaaaaaaaagaaacaaaaaaacaaaaaacaaaaaacuucuguucauuggaaggaaccugggggauccccuucuucagcuuuggcggcaguguaggaauucccccagcccugagagcccugcgagcaauggagaguccccuacagugcagcugugugcucugucguuagacagcccaggugcccacuguucuucccaagcugugcuggaagccuccuugacgcugacccagcaucaagguuccugccuugaacucucaggacaacacagauggugucuguucccaguuccaccugccagccuugguuacuguuccuuaagauagacaauuccaauguagucacuuuccacccaucacccucguaaccaccauucuccaagugcaaaugagccuucuagaggguggcacuagaucugaauguggaggaaggaucugcauaccauucuacaugucccccucggaggacaccaggcagggacaggguuuuguucagaguguuugugucccuuuuccuugaaccuugccuucuuguuugaguccacuugcguguagaugucucucagauaccugaaacccaauaugauccaaucucagcuccucauguugguguccagcccauggcuguuccugugucuugguaaggggggccauuguuucaguacuucccaguuugcaccuauuugaaacaucagucgucccucacuccuccuuuucuuucacugucccuaugccauuucucaucguguugauucuaccucccagacaucucuuacauuugacuccuccaccauccccacugcacugcccccaugcagccaccaucgucucuugcacagucuagcucagucauauccaaaucguuccccugucuuuggugucaccuccuuccacaccaugcuucacaagaauagcaaauuuaucauucugaaauacacauccaagaaugucacuuccugcuuaaauaccuuuucucugcuuuuucagcauuuccugccuuuaccugugcuacugcuuuuguuuguguguuuguuauuaucaguguuuugccagaaugccuuuuuucccacuugacuaccuguucaaacuccuauuaauucaucuuucaaacucaagcucaagugcaccugcuccaggaagccucuccuggccuuacacaguacccuagacaucugagcaucuccacuguaacaugauaauauuauuacuugguuaauuguauuucuucuccuuuggacagugaauucuuugagggcagggauagugcccuauucaccucuccuuccuuaaaaccugacaugguuauuuggcauuuaauagacauucagugacuauuuggauggauggauggauggauggauggauggauggauggauggauggaugguuggauggacggacggauggacggauggacggacggacggacggacagacggacaaaugguuagaugaaacuagauggggccccgagauacaaacuccuaaguuuucacaaugggaugcccccucugccacuuccacaucauguguccauaucacaugagcaacaucacaccauauuuaucuguaccccaagaacucaaacauauuuacuuugacaaguuugguaacugucaccugugagcaggacuaugugguaggugccccugcagggcaucugucaaugagaaauucuccucagagaauucagggaugaauugaccgagguuuagcaagugcuuucuugccagugaggugucugauaucuauaggggaagccuagacagauucaugaucuguuguuccagcaggaaagacugugagcucauaaagcaccauaccugaaccauauccccucugccacuuugaucuugugcccuuggcauuuauuacagccccagaugagcuguuuccuguggugacugucuccacaucauaaaaauguguauuggaagacagucuucuuucuguuacucaaggacccuuaugugaggagccaugugggaaauuucuccaggaauuuuauucagaagaaacugugcccucugggugaacugguaugaguuccucuagcgccgugcuauuccagcuguggccacaggccagcagcugcagcaccugagagcuggucggaaugcagaaucucagacccacacaggccugccgaaucauacucugcauucagcaggaccccagcugguuccugugcacagcacauucucagaagcucugaucuugcagaugagaaccauuuaacucgccuucacuuugcaccugagcuuccagauuccugaguaaauuccuugcucuuuuagaguaacucacccaaucaccucgggugauccucuugguaccuugccaagaggcuuuauucuucauucacucagcauuucaguugaguacucccugugugccugguccuguguuccgaguacuaggagaggaacagaaagagcacuagggucuccugaccuugagaagcucccaaaacagggccccuguuccaucacaccacaauuugagagcaggacuuugccuccuuucacaggcggcggggcggggaggucuuuaauuuucuaggguuuagggagagcuucgugcgggagugucucuuucaugggaguguuucuuucugaugccugcugccuuuacaguucagaagcauguguuuucuggagggugaauacuuguuugucugccugauggucagucugugucucacauuucucugucucugccccuuucucccuaagaaccaggauguggucagucccacacuggcucuuccauggugucuuccccguccugccucagggacaaaccucuucugcuccuuccucccccuugucauuggcuccaucccauccucaccaucuucuugcaucccucauccugccccuuucuucacuccacuuguggaauucauggggcaacuccccugcgcuccucagccgcacugcauucugcccagcgacagaggaggcacuagggcuuuggugccuucaccccuggccacccugugcuguggccagcugccacuuacucauugcaucuccucauuugauguccucuuccucgucugucuguccaucuugcacacugaacagaauaucaccgcgcccuacagagcaccuguguacacaguugagcaggccaaaaaucagccauuuguugaaauaaaugacuaagaguaaccccuccaacccugcuuagaaaauagguuagggcaggccgggcacgguggcucaugccuguaaucccagcacuuugggaggccgaggcgggcagaucacaaggucaagagaucgagaccauccugacuaacauggugaaaccccaucucuacuaaaaauacaaaaaaaaaaaaaauuagccaggcauugguggcaggugcuuguagucccagcuacaugggagacugaggcaggagaauggugugaaccuggcagguggagcuugagcuugcaaugagcugagacugugccacugcacuccagccugggcgacagggcaagacucugucucaaaaaaaaaaaaaaauagguuagggcauaaaaugacuuggaauauaguauuaguacuagcagcaauaguaauaguaguaguacuguugucauuuaguaccaugggcuaguuuagacagaccauugaguuuuaaaucaaaaaagaaaaauagggcuggggaugguggcucacaccuguaaucccagcgcuuagggaggccagugcaggaggauugcuugagaccaugaguucuagaccagccuaggcagcauagugagacccugugucuacaaaaaauuuuuaaaaggcugggcaugguggcucacaccuguaaucccagcacuuugggaggccgaggcagguggaucacgaggucaagagaucgagacuaucuuggccaacauggugaaacccugucucuacuaaaaauauaaaaaauuagccgggugugguggcgggcaccuguagucccaguuacucaggaggcugagguuggagaaucauuugaacccgggaggcggagguugcagugagccgagauugcaccacugcauuccagccuagcaacagagcgagacuuugacucaaaaaaaaaaaaaaauuaaaauuaguuggacauggcgaaugccuguggucccagcuacucaagagaccaagauaggaagaucucuugagucaggaaaucgaggcugcagugagcuguggucauguaauggcacuccagccugggcaacagagcuuuacccuaccucaaaagaaaaaaaaauggauugggggggugcagggagggagagagagggagacagagguagagacagagacagagacagacagaacgagaacuggaaauaccauuuuaacuuguuuuguaacugccaagcaguugcccuuucugccacugggugaugcucuuguaaacagugaaacccagcaaagaugccguauuuggggggaauuuuguaaagcuuccuuuuacguaagugaaagucaugcuuuuucaaucugaaaacuuguauacaacuucaauuccaaaauacucugucucugaaaugccuucccauccauaacacccuacccccaaccagccacuuggacaccauaaggccagacucuuguccuacuguaucgcuguguuucuccauuggucugucacugaauauuuuauucaaauagauugugauuaugaaucauucugugugacuaugauacagauuuuauauuuaaauuaggcucauuuaaacucacuaggagaaagagaagcaccaauuucauaaaaaauccauggauaagggcuugaaaugaaggucaagaaagaggcaguagcagcugucuuuugucuggguuucacugaaugacuuggucucugcgcuucuccccucacuucacuuuggaugagguuaggguggggcagagucuuagaauguaggagagccccauagucaucagcucuguaaggugucugugcugggccuguggcuccggaaggggcuggugugggugaugcagagacucaaggguccuguccuguacagugacagcagggaugguuaaucccugugacucugagggguuagaaauaggggucuuggaagugggcucugcauggucuggagagggaagaaaggcuuaggacgcacaucggucagguuucugucugcuaagccgggggaaagccaugugacccugggcaaguuacucagccucuccugaccucagcuucuucaucugugaacugggaguuagaacaaaugaccacaaaguucuguuccguuuucaucaucuguaacucucuaagacagcgcuguccagcaggacuuccugccguggugaaauguucucugacugcacugucucauacgggagccacuggccgcauauggcuagugagcaugugaaguauggcugguuucuugucuuaauuuauuuaaauuuaaguagccacauauaacuaguggcuaccauacuagacagugcagcuccacgauacagaagaaacuauauucgauagaggaaaauguaacaagaucucagcguggcaguucauggaugucacaggcaaaucaugccaacuaggaauaauauaaauucuccugaacgcacaacaacaacaguccuguuuccuuugaggaggcaagaguccuaugaagcagaaccauccgcagaagugagacagaaggaaaaaagcuuucagaagggaugggcugugcaucugcaugagcuugccuggcagagccugguucaguaaugaaaccaccagaggagcuggacacauuucccugucacccuucuaaagcagcggggaagggagcaaaguuuucagcaguuuccagauccacccugccuccuaucccuuuuccccaaaaccaugugacagugucuaggccagaugcggucagggguggucagugggcccuggguguacucaaaucccgcugacaaccuaugcagcugagguuccagggaaacauacagcccccagcugccaggccccuacagucaguaguguuugcucuaauaaaauauuaacccaguuauuaauaucuccuccuuccccaugaugaaggaguuuauccgagaacaauccggcacaaagcuaccugacccagaagucauccaguucugugucuccaucuucaaaugcuccaggcuccugcucaccugacggcguugaucagcagcucuuagaugacuuccacagggugaccaaagggggcuccaccgaggacgccagccaguacuacugugacaaggugagcgagcgcaggcagccgggugauccacacacccagggcuucccggccucuugugggcagcugaguagcucuaacuaaaugaaaauaucuuaucaccaacugcuggagagagaugugaugcaaaugaccacuuucaaaccguuuuccagaaugauaauggugacagcuacuuagucuugauccguaucacaccagaugaagauggaaaauuuggauuuaaucuuaagguauguuguguauuuauaaaggaaguuuugugcugggaagcaaucuuucaaugaguuuuuaauuugcauuacaaaugugcugcauuccugagcuacauaaggaaguugguucaacccucagaauugagaguuggggguuuuuuuuguuuuuguuugguuugagauauuugggguuuuuuuuguuuuuuuuuaaaaacucacuuuaucgcccaaaccuagagugcaguggcacgaucgcagcucacugcagcgcugaccuccccaggcucaggugauccucccaccucagcugggacuauagggaugcaccaccauacccagcuaauuuuuuucauauuuuuuguagagaugggguuucaccauguuguccaagcuggucucaaacaccuggcaaucuacucacuuuggccucccaaagugccgggauuacaggcgugaaccaccgcacccagccuagaauugagagguuuuuuuuaauguggccuuaacagcugccgaaggccaagugccugcucugugccuggcauuggcuauccacuagauucauagcaccuucuuaaguucugauaacaagugguaaggucaguauuuuuaaacccauuuugcaaaugaauacugagguucccagaaaugagggcacacaguuggcaaacagaucuacccacuucaggaaugcuauuaagagaaccccucagcauugcuaaagcugauaagagaaaaacaauucaaguucaaccugcagggccaccacucuccuccaggcaccuuuaagcaggaucugcaaacuaaacccacaggccaaaucccaucuguuucuguaacuaguuuuuuugguaacagccacagccauuuguuuacugguggguuaaugacugcagaguugagcaguugaaucagagcccucacucccacaaagccucucuggcccuuuacagaaaacguuuacucaucccuacucuaggacaaagugagggcagguggucgccuaccccccagcugccaucaugcacagccucaucugccccagcagcuguguugaggaccagcgcucacaggccagaugcgcucacagggugugcccccuucccaggccucgcucgccucugcugaaagccccuauauauauauauauaaagcccauauauauauauauuaaagcccauauauauauauaaagcccauauauauauauauauauauauuuuuuuuuuuuuuuuaauuauuauaaguucuaggguacaugugcacaacgugcagguuuguucuagcagcacucgaagacaugcuguggagucccucucugggggcaucugcguuuuuaaggaggagcuucucucugaguguaucuguuaguucauggacuguggggauggcagagggaggcuucugaacagaguccuggucagcccgcuggauccagaggggucaggaauuuguuccauauuucugaaaugacgugugauucgaaucagucauagugaaguuugaagccucccuguaccaaagacucacauuuauugguaccuccauguuguugaugcugugagcuacucguuuuuuuguuuguuuguuuguuuaacuuaaaaaacuuuguuuuguuuuuauuuuaaaauguuuacagggaggaguggaucaaaagaugccucuugugguaucaaggauaaacccagagucaccuguaaguaaauacauuccauguuauuccucguguuuguuuguuucccccuaauucuaacagguuucuguuucugaguccuguuucuuuuuuugccagagcaaagaaugugcuuagauauacaucaccauguuuucuauaaccuugcggcucaguguggucuuugaagccauagcacccauguuaccugggaccucauuagaaaugcagcaucucuggccucagcuuaggccugcugaaccggaaucugcauuuuuaacaagagccuugagugguuagugugcauucaauuuugagaaguccuuuucaagagaaggaaacuuaggcagucugcuguucugcucacucuaagugggcacgugggcccugugccucuucucaccaucuuuccaccagugccccuuuugucaucuguguaggccuccuaagaagagcauuugcuuuguuuuucuuucaaauuuauuuuauuguuuuuaggccaggcauaguggcucacaccuguaaucccagcacuuugggaggccgaggagggugaaucacuugaggccaggaguuugagaccaaccugccuggccaacagggugaaacccaucucuacaaaaaauacaaaaauuaucugggugugguggcacacaggugugaucccagcuacucaggaggcugaggcaggagaauuccuugaacccaggaggcagagguugcagugagcugagaucacgccgcuguacuccagccugagcgacagagugagacucugucucaaaaauaaaauaaauuuauuuuauuguuuuuaaaauaauaucaaguaauuuuuucguuuaauuuuuuuauugugcauacucaagguguacaacaugaugucuuguuauacauauaguacugcagucaaacaaauuaacauguucaucacuuuccauaguuaaccuauuuuucuuuuuuaagagacagggucucgcucuugcucugucacccaggcuggaaugcagugguaugaucacugcagccucaaacuaggcucaagcgauccuccugccucugccucccaagucgcugagaccacaggugugucccaccucaccuggcuccauaguuaccuuuuaaucaucugcuuuuuuaaagcaguaggagucacugugccuccuuacagugaaccacguugggauuuuacucugagguaguccuuaagcucuugucauuuaacuuuuguuacuguuuacaguuucuguaaauucagaaggcuuucuuuccugugcuguucaauucauugcuucucuccauaaugguuuuugccucuguugugaagcuuacaaaagcuuucaccuuugcaagacagauaaauacucaccucuagcuggcaaaucauuuccuaacaguacaucuaggaaacaaaaggcuggaaaugguauaguuauauuauaauaagugaagguugacuaccacggagaaauggcuucagcaauuuuuauauccuuauucugaaauguuucauaacuuauauucugagcaguacuucuuuauaucuuacaaccaucuaccauguccacauagcaguggaugcauuauacaaauaaugacaguacuacccgagggagagaaggcaaacuugaucauggucccaggugucugggagcagagcgagucagcguucuucccccaaggacuguguuaugguaacaggagaaacucgcuuuuccccaccacccaggcggacaccugcauuccuaagcugaacgaaggggaucaaaucguguuaaucaauggccgggacaucucagaacacacgcaugaccaaguggugauguucaucaaagccagccgggagucccacucacgggagcuggcccuggugaucaggaggagagguaauggccaccuggggggaggagccauagggaagcuguccuagccaagcugcgccugcuccagcccuuuaucugcucuugaaaauguugaguuuguagccaacauuugaaaaucaagaaucuucagguaauaaccgaauguuuggcuucucacuugaaaaaugugaagaucugcccccaggaggccuguccccauguggccagucuucuggggggagacagcgccccugcagccccuuuauacaggacaugagcccccagcucccaguuccucccaggcccagcgcagcccacaucacgcacucucuaaguggcaugacucugcagacauuugcauuuucagccccuucuuaaaggaucuggugauauuuuauucgugcguguuugauuuugucggggaggcagugaggagagcagggucugacugucucgggugauuccucacucugccucugcgggcugggggaccuugcagggguuacauaaccagucugugguucagcuggcucagguguggaggaggacagcaguggucccgacuucacaggguugcugugaagauuaaauggcacuuggggccaggcacaguggcucacaccuguaaucccagcacuuuggaaggccaagguggguguaucacuugaggucaggaguucaagaccagcuugaccaacaugguaaaaccucaucucugcuaaaaauacaauagccaggcauggugccauguggguauagucccagcuacucaggaggcugaggcaggagaaucgcuugaacccaggaaguggauguugcagugagcuaagacugugccacuacacuccagccugggugacagagugagacuccaucucaaucauucaaucaaucaauggcacuuagacuggaaaguaccugcauugcugccugaugggagcagagguuugaaggacagccucuacugagcaucacacuguugucuuuauaguuguuguuauaaaauaauacgucaaguuccuugaacaccgugcacagcuguaaaauacugaaaguaaaugaagguugugucugcaaagcccugcgucucugccugccucacacguuuggcugacacuccauacugcugugcuccugccucggcucugcucccacugcaacucucaguccagagccaccaggaccagcucugaccccaccuccuccgugaggccuuaccagaucucuccgguuccccaccugugcaagguugggaguugugggggggugguccuagcuuugcuuucaccuguauugaauuuaacaugaagggaaaacgugcacuaaagagguaaggcugaagcacagaagagaugcuaggacuacgauauuuacgugggagccucccacauagaaacggcccugaguuagggauugagcucucaggaaugauggugucacaggaaaagcuugggaccucacccucaugccugaggaaaugcccauuuuagggaaguaaaugaaaaaaccugagaaagaaaggggagucgggauggguagaagaauaacccggucagaaagagcaagcagaaacaauaugcuuuuuuaaauaacauucuuucucuuuucuuuaccuuugacaaaagccucugaguguuaaacaccauuauuuaaaacuaaccaggaagauuaguaugucauuuuauguaauuaacacauauugaaucauucaccuagaaguaguaucuuuggugaaaaugauuaccauguagcuuaaucauuuaauaagauguuuugaaccaucugcauucaggugucauaggugugauuuguuugagggagacggauaaaccugaguauugcuacacaagucagaugcacugucuuguacguuacagcuguccgcucauuugcugacuucaagucugaagaugaacugaaccagcuuuuccccgaagccauuuuccccauguguccggaggguggggacacuuuggagggauccauggcacagcuaaagaagggccucgaaagcgggacggugcugauccaguuugagguaagacccucuggaggcugaaucccacugccaugucgccuauugggcugccccugccucugagcaguggaggaaaugaggcagagacacaagcccuuguuuccuuggucgagaugauuguguguuucacaaaccaaaagcagucaacugagucucugaggacugacagggcgaggccugugcuugucguggauaacagggcacagcaggcagcccccuucucaggcucggagcagcaagcagggaucaggguggccacccucgcugaacucugucucacccucuuauucuaguaacauuugguagucauggagaaacaugccagaaacugaggaggagggacucugaguguauuuaacugccaacacaaaagcucaaaacucccagcaguggaaggcaguggagagguggcugugggugaaggaaccagcucucugaccacccccagccaugugcuggaauuuggagcaauuaguguuaucccaugagggcauagugucucgcccucccaaguugcccagaacccuauaaacacaaguaagaaaccaaacucaaacccccaucuuccccaggggaaccugugauucauaggauucaggcuguugacaaagguacacacagacauuuuuuauaaaacaaaagggaaccaaaggaaacucagcuuuuaagccaguuuuacugaucacuaacagaauuaaaauagaauguguucaucuuccaaauuuauuuucuuauuuuuauuuuuuaaauauguuguugucguuguuuaaaauagagacagggucucacuguguugcccaggccagucaugaacuccuggucccacgccguccucccgccucggucuuccaaaacgcugaaauuacaggugugagccaccacacccagcccaucucccaaauuuauuuaaaaguagaagaaaacagaguaauuccuguaauaaaagaaauaacaccaaaaagcauaaaauaggucaacaaaagaaaauagaucaucauuagaaauaacaacagucuggguucauaaauucaggaagagagucacaugggacucaagaacagaaaucaacaaugcauuauuuauuagaaaaccacauaaaggaaaaagaagcaaaacucggacauuugugaaaugugugugacugcagaguaauugaggaaggcaugaguaauaggaauguuuaaaaugaaggaaugcaaagcagagagcuuugagugaaagauugauuuuaugaugcaugugaaaacacauuaaagcaaugugcauugaacagcaguagaaagcaaaaauccacaagccaaaaaguaaaggugacugacuuccccgccaaaacaaucaacagggaauuaauuaauuaauauauuuauuuauuuagagacagggcgucugucacccagguuggagugcaguggugccaucuuggcucacuucagccucuaccucucaagcucaagugauccucccaccucagccuccugaguagcugggacuacaggcaugcaccaccacuccuggcuaauuuguuuuuuauuauucuuuuguagagaugcaguuuugccauguugcccaggcuggucucaaacuccugggcugaagcaagccaccugccucagccccccaaagugcuaggauuacaggcaugagccacugcacccagccauuuaaaauuuuuaauuaaucaucuugacacaauauaaaacaaaaauuauguacuuaugcaaaugaagucuggauaaaaggguaguaacuauaauuacuugaauagaacuaauagauauauuacugaguauucuacaaagggaaauagcccuuuuuuucaguggccuacaggaggcuguucacacuuuugguuaaaaagaagaaaauguaggcugggugcaguggcucacaccuauaaucccagcacuuaaggaggcugaggcgaguggaucaccugaggucaggaguucaagaccagccuggccaacauggugaaacccugucucuauuaaaaauacaaaaaucagccaggcgggguggcaggcaccuguaauccuagcuacuugggaggcugaggcaggggaaucacuugaacccaggaggcggagguugcggugagacaagaucagccuaggugacagagcaagacuccaucucacaaaaaauaaaaauaaaaaaaaaaggaaauguagagguuaucuucucuggccuugccuuucaaaaaaguucacauuuugagcaguaaaacucauucauauuuucacacacuccaaaaucgaaacaaggaagaacuuaagagccagucacagugcauaccgguuuuuugguauuagagaggacaggaaaggcagugagaagucguuuguuuguugauuuagcgagugugucuuggguauuuccccuggaucaggaaccugaugagggaaggagaggggaguuucuggccccaaggaguuuacagucuaauuuuaguguauuuuaggagguacaucaugugucccagaaacagcugaagaccaagacaggguaagauguuauuauacagaauauauguucugcagcaacuggaggugaggggacuccaggagaucccuggagugagaugugugggauuaauaaaggggugauuaggauuaaguguguggggggagcauauuccaggaaaaucucagcccaaaugcagacaaagcucaugggguaucacguagcauaaagagacaggccuaccuggguggacagcgcagugcagauccugggcaaugccucuaggugaccaccguccuucagcccugcgagaacugguuccaguuuaucagauaguccacaaggaggcgcugugggcucucacugaggaaaagccaaaggcugguguuuucgguguucaugaaaccuccuucacgcagguggcuccaauuugagguguguuuuacauaugggaaucccacaggugauuucccuugaaaaguguucaacuuuuuaaaaaguuuucaaagacauuagagauaaauacccacccuguccccuaccuguguuucucagagggugacccuccgaccacuuguauggagaucaccuggggaguuuauuaaaucaaggccccgcccacagcuacuggauuggcagcaccaggaugggaccuagauacugauacuuuuaacaagaucagcaccuguuuugaugcacacgcuguuccagaggagaggaggugaagacccaaccggaaccacugcugugcauccgaggcuuugucuuuggaggguauggugggaugauagcauaagaaaaggagaacguauacauuuuaggguugcguuuuagcauguacacguuuccuucauuuuugucuauacaguuccucaaguaggauauuuaaguaggaaacccuucuuuuuaauaaaaucauuugcagaauuccaaaauacagaacagaugaaagcaggucugcucugugaccugugauggaaccaguaggguccucaaagcccagccucuucagucuuccuucacuggcccccagggagcccuaggcuaaacagaccaucaugugaaaaccacuguuacaggugcgagaaugguguuuuacagagcagccagaggagaggcauagaaaaggaaaccagauaaaaugagaaacuaguaggaaaggaaagcuuucaugagcacuuacuaugugccacaggcuuuaaaggauaucaccuuagguaauucucacaagagcccuauauagaugcugucauuaucccaguuguaggcaugagggaacacagucuuggacagguuaagugaccucuuccaggucucacaguaaaugucaaaggcugauuggaacccaggcuggccaacucaaggggugguucuuagccacucugaaauaaccuuugaaaacuacaaaaugcuguugauguaugagaguuguuauuagaauaauagaacaucugagcuagaaaauaucugagaggcugucucccuacacggagccagacagauuuuaaauccuggcucuacccucacuuccuguguggccuuaggcacguccccuaaccucuguggccucuguuugcccauauauaaauuggguaucuugugaguucauuuaagaguuagaugagauaaauacuuaauguguugucugguauguggucaaagugccauaaaaaguaauagcuguuauuauuuauaaauaaagggaggcuccaagagucuguagaacaugcccaaugucugccuaagagguggucacaggccggacaugagggcucaugccucuaaucccaguacuuugggaggccaaaacagggggaucacuugaggccaggaguuugagaccaaccugggcaacauaacaagaccucaucucuacuaaacauaaaaaaauuagccagccaugguggcacacaccuguggucccagcuacucgggagauugaggugagaggaucacuugagccugggaaguugaggcugcagugagccguguuggcuccaaugcauuccagccaggauaacagcuaaaaaaaaaaaaaaaaaaagguaacuguguugugcuggguuuggagcucugggucgucuaguccugguguuccaguucucuaccuucuccagugugguuggcaggugggcguccuggcugauggggguguacacuggacaggaguaggaagaggaaggggcuauuccccagcagggcccacugcagguguccacaccacccacuccauggcacgaaagaccugcccugggguagccuuaauucccuucugcgagagcugguuucuaucagugcuugcuuuggagcauuuuuuuuuuuuucauaaagggaauucccuuuaugaaaaaaaagucccuccuguggcuuucaguaaacaaucacaaguguguuccagaaagcauuuggucccagcugucauaaaaucacacuuaauaauuagcauuucuagagcacuuuggaaccuagcaaguguggugcacauauguugucucuguuaacucucacaacaguacugugaaaucgauauggccagcaugaugaggaucacccuuuuacagauggagaaaacgaaaaucagagaggcugagggacuugcccaguggcacacaacuagucagagauagagccacaauuagaauauauguuaaauaucuaggcuaggcauaguugcucaugcuuguaauaccaacacuuugggaggcugaggcgggacgauugcucuagccucggagguugaggcuucagugagccauggucauaccaccguacuccagccugggcugcaacagagcaagaccuugucucaaaaaaauaaauaaaauuuuaacuuauugucggcaacucgccauugcugaguguacccagcccucacucuauccuccaacauuagccauucccuuugguagccacacuguaugaccuacaucaaugggagcaguuuggugguauuuuugauuggccccaaacugccuaaauacucuuuguguagccaagguaggguguuccucuuucucuuauguaaaggagcagaauugggguucacacugaccccaaaauuaccacuuccaggaagcucuuguuuuuguuuguuccuaagaaaaacuuggagauuaaucuacauguucccugaguugaaguguccauuuaagcaaaggacaggaucugcauuugguauagacuuuccuggauaaaagcuaagugaugaugcuaaccuguccuuuauuugagaaccagcuucccagcaacaaaggaucccaguguccauuuucauccagugaccaggugacucacagcuucccuaccuccuugcccacuguuaguuaagagcucgaaaaugaggaacaccacaagagaaugccugcaucccccaguugauggauuacagcaguggcuacaaaagaccaccaaaggucaugucaaacucagauacccggccccuccacuucagcauccaccaucuucaccaaaaccagaaaccaucuuuguucuucuggccccuguuuuuacuuuacuuacuccuacauugcccauuauagaagauagccauuaaugucaaaacaagugacucacuggcuccugugauaauuauaaaaggugcauuuggaagggcagagguagcugaaaacuuuauaagagguuuaaauugacaccuguagaaauuaaugagagcaauuguaucuucaagauuagaacccuuuagaccgagucucauucuguggcccaggcaggagugcagcagugugugaucuuggcucacugcagccucugccucccacguucaagugauucaagugauucucgugccuuggcuuccucaguagcuaggauuacaggcaugcgccaccaugcccagcuaauuuuuguauuuuaaguagagaugggguuucaccauguuggccaaguuagucuagaaguccuggccucaagggaucugcccaccuuggccccacaaagugcugggauuacaggcaucagccaccaugcccggcccaaaagauugcauuuuuaaaaacgguuuuccaaauaguuuguuguuuuuguuuguuuguuuguuuuuuaaggaaagaaaacaucaucaguauaauguguaucugggauacacggagcaaacugggggcuuuggaaugaccgugugugcagccuuuacauuucaagugccagcgacccaccuaaaggaagugcugccauaacuuauuguugugugucugucugaaagggccccugcaagaauacuuguuagguuugccagcaguagaaucugcaucugggacugugccuggaaaggggcacuauggaaggucccaaaauuacuagcaacgauuucaauucagcaaaccuuucugggaagguagguagaggcuccaagaccccgcuagaugguuucucuugcccucuggcugggucagauacaaaggaaaagcgauguccuagugugggugagcuacccgugaguagugaacuguuaauuugucuaccaagugguacuaaaacaaccucuuggggugggcucuuugggaaaaauggguuacccucagcuuaguuauagggcacuaugucuaagaaagcugaaauugcuuugaaauucucuugggcaugcuuuauucacaugguuggcacucauuuuugaaagcagcagaucccauuauuccuugacucuacaaauuuuuauugagcaccuacuaugugccaggcacaaugcuggucugggguuugugguagugaacaaaugagauuccuguccccauaaagauaaugccguaguggcugauacagcaaacagccauuuugaaacuugguuccuuggagucgacucuggguuuuuguggagggcaugaaaggcaaucugcuucuggccuuugcugucuccuuacccaugguuuccuugauucccggucccccuuuuuuuuccuguccuuuucccuuuuucuucccccuucuuggguucucagccuucaggaauuccccuuuuucuguucauagaguugacggagugcuugcuuccacuugcugggccuugccagcauccgcugguuagagccaguugggggugugaagcucucaccugagggaugugaguaggcugcacaccuuugguugagugaggagauuagagucaccugaugccuucucuaauauuauaguaggugacuuguucuaagaagaaauauuuaagccaaaaaaccauccauugcaccccuaccacauuggagagcaucugcucccaccauucaaauuuuuugucuuuggaggccagagcuggugauacugauacuguaauuucaauacaguuguuccuuagcaaccccucuuagccgaacuuuuuauaauuuaccguuagcuucagagcuucuuauaacuauacucugauagaaugagaacaaagcauuuuaggacauaaaaauuaauaauuuuucauaaaauucagugguuuugucauuuuguaucccugugacccugccucucagccuccuggugacucccauucuaggacagaaucuaagggaccugcagccaggagcuguugucucccucacacuccuucagcccaggaauaaccaaagcaaauuguuguuuuuccgaugaauuggaaaaugaaaaaaaagugaagguucucuuaaaagccaugucucauacucuggccaauaucacaaagccuuaacucauuccguuccaucccugacccuuccagaaagacauaccugugauuccuacacucacuuuccacucugucccuccgccuucucagagcaguguuucauaaccagacugccaagcagcccacagggccuggagaagagucgauaaauuuuaggaacuugaggccaggcgcaguggcucacggcuguaaucccagcaccuugggaggccaagacggguggcuugcuugagugcagaaguucaagaccagcuuaggcaacauggugaaaaccagucuguacuaaaaauacuaaaauuagcugggcaugguggcgcacgccuguauacagauuccagcuacacgggaggcugaggcaggagaaucacuuuaacccaggagguggagguugcagugagccgagaucacaccauugcauuccagccuagguaacagaguaagauucugucucaaaaaaaaaaaaaaaaaaaauaggaacuugaaaaaaaauauauacauauauauagagagagagagacacacacacagacagacacacacagacagggucuuccucugucucccaggauggagugcaguggcacaauauuggcucacugcaaccuccaccucccaggcucaagcaauccucccaccucagccucccaaguagcugugacuacagacaugugccaccacacuuggcuaauuuuuauauuuuuaguagagaugggguuucaccauguuacacagccuggucucaaacuccugagcuuaagcuauccgcccaccucagccucccaaagugcugggauuacaggcaugagccacugugcccagccgaaaaccaacucucaacacuuaggaaacuaaauguuuaaauucuguuucuacuaaguugcuucaguccuauucaguguuagccuuugcagacauaaauaugaguguguugucaaacuuuccaaaggccaaaacaaccuuaacuuugauuuguccaccuagcuuuuuguaaaaauuuugugcuuuuuaauuuuauaaauagauuucuuuuguuguauuucuuuuucucacuuuagucauuugaauuuaaaaauaacaauucucauugacauaauucagauaauucagaaauaaccaaaguaaaauagucuccugacuccuauccccuucaguuucuucccuccacuuuuuuuuuuuuuuuuaaauugagauggagucucgcucuguugcccagccuggagugcaguggcgcgaucucggcucacugcaagcucugccucccugguucacgccauucuccugccucagccucccgaguagcugggacuacaggcgccugcugccacgcccagcuaauuuuuuuguauuuuuaguagagacgggguuucaccauguuagccuggauggucucaaucuccugaccucgugaucugcccgccucagccucccaaagugcugggauuacaggcgugagcugccacacccggccaguuucuuccucuuuguuauaauuuacaaacaacaauuuuuuauguauccuuccauacuuguuccagugcucauugcagauauaucauauacacauguauacacacacaagauugugucuuuacacauuauauacacuguguguguugcuacuauaugaucaucauuguauaaauuauucauuguauaauuuguauaaauuuacaaguuauaaauuuguauaaaauuguauaaauaaaaauacaaaaauuagccggaugugguggcacaugccuguagucccaacuacucaggaggcugaggcaugagaaccacuugagccuuggaggcagagguugcagugagcugagaucgcaccacugcagcccagccugggcaacgugucucaaaaaaaaaaaaaaaaauguaaacacugccauaacacuuuuuaauauaugauuuaucuuaguaggauuaaucuuaguacuuuacaaauuuaucaacagaucauuacugcugagauacauuuaaagucuuaugguaauuaaagccuuuuucuguagcugugcuuuucugcuagaccaccucaaguugauuuuauuuacacuuucauuguuugaaaaaaaaucucuuuuucccaccagguuagcuuuacuauguucacuuaauuguauauucacuuaauuguugauuauauucacuuaaucaguuagaacuaaaaugccguuuagguaaauuuaacuuaggugcccgccuucugccagagucaacccaaaaccucuaauaaaucauuaguuuauuccuaaaaugaacucacagaguuuauuagagacugcaguuauuuaagaaguuguucagcugccugaugguuaugaacugaaacuguaaagguggugaguagcugagcucuuggaguguuuggaaauucuagacauuuggcaaauguauaagauacagcaccauuauuaugacccaaacucucuauguuaauuaucuucuggggaguucuguguaauuuauuuauuuaguaagagaaaaaacagacuaacagaagccaguuuacaaaacaauacaauuugcaaaaacauagagggaaaaauccuuuuuacccucccuauucaaacugcaaacacaucuuuauuaaggauguuggccacaauuuggugaauuuaucauacaucccuguagggcaacuugguuauauguaucgaaacucaaaaauccuagcacuuucagaggccgagguguguggaucaccugaggucaggaguucaagaccagccuggccaacaugaugaaacccugucucuacuaaaaauacaaaaauuaagcagguguggugauggauaccuauaaucccagcuacucaggaggcugaggcaggagaaucgcuugaaccccaggggauggagguuacagugagccgagaucgcaccacuucacuccagccugggugaaagagugaagcuccaucucaaaaaaaaaaaaaaaaaaagacaaaaaaaaccauuaaaaauauuauuugguauaguaauucucuucuuagaaguuugaguaaaaaaaauuucaaaacagccuaaugaaaaaguaagauaaaaguuaauacaaauuauaguaaacuagauuauugaaccauuaaagaucauauguguaaauaauaguuaaugacauggggaaauagauacuauauaauaaguaggagaaagcagcuugaaaauuaggguaguuauuucccagaauacuccauuagaugcugagauuuuccacggccaaauuagcuugagauauguuuagcugaucagaauuuaacaaauguaugcauuaugcauugcaggacuuguccuguuagagauucauagaacauaaaauaaauguuuuccaaaugucuugacuuugaaacuuuuucuaaggaauacuuacuaucuucuuuuaggacacuuagguugaguagaacauagcauaagaagugccaauauagccgggugcagugacucacgccuguaaucccagcacuuugggagguccaggcgggcagaucaguugaggucaggaguuugagaccagccuggccagcaugagaaaacccugucucuacuaaaaauacaaaaauuagccaggcauggugaugcacaccuguagucccagcuacucggaaggcugaggcacgagaaucgcuugaaccugggagguggacguuacagugagccgagaucacgucacugcacuccagccugggcaacaaagagagacccugucucaggaagagaaaaaaaaagugccaguauguuguucaaucucauuuuuugcuuuuaaaaacauaguauauaaauguauuaugcguuuacauauaugugcuucuguucauuuguguucauguaggcacagaaaaaauaagcuggagaaaauauacaaaaagcacaucucagaguugugaaauugcugauaauuuuuuucuuuauauuagucugaauuucccaaauuuuccgcaaaaaaaaaaaaucacuuccaacacugaaaaaacuguguuuuuaaauucccauagaguuaauaaaaaccacuggugagaaaggauuaaagggaaaaagcagucauauagaaaagaaaacauaagccuuggagucagaucugaguucuuguuugugaucucgaacaaagcauugaacuugcaaaauaagaauacaauuaauaucucuuacagggcuguugugaaaaucacaucagauaccauacaaauaugucuaauacaugacuuuagauaugcaaagauuguguuguuugagauuuuucguagugauuacauguguagggaaguaccucuguaaaugaaauguacuauauauugggauaaauguuuuuccuguggaaauagacuccugaaaugaugaaugaaaugcucucguucuuaaaggaagggugugguucacuacauugaacugaagggaaaugauucuagacuaauuuagaugauuuccauuuaauuuugagccagaauucuucccccccccccccacaucuaguugcuuuuagcucuugucaaauaguugucauaaagacaagguuucacuuaccaugcuccauuaccugagacccagacccuuccuauggcauuuuuucaaauuaaaaaaaaaaauuauuaaagaguuuagucaguuucucauggaacuguagaauuucuuauugggaagauuuucuuuuaguauauaacacauaaucacuuuaaaauguuaagauuuugguacugugaaugauaaaguauguuuucacacuuucuucaucugauuuuugcaaugcuugcuuuuuucucuauuucucacauagcaacucuacagaaaaaagccagguuuggccaucacguuugcaaagcugccucaaaauuuggacaaaaaccgauauaaagaugugcugccuugugaguauccggcaugaaugccuccuuccccccuacacugagauaauguuucccuuuuuaaaacagauugucugguauucuggaacgauuuucagugugucuguaaacaccaccgucuuuauugcagccauuucagacucggaacaguuggggaauaguguuuaugcuaaugaggcagagcugcagauggggcugggaacugaacucugguuuacuugguaugauaaaaauaaugcucggaauaaucgguaaauuuuucucuuccccgcagaugacaccacccggguauuauugcagggaaaugaagauuauauuaaugcaaguuacgugaacguaaguuaggaaucuggaugaugcuuaagagcacauucaccacugucgcaacgaugaugagggccuguguggggcuuugcaguugacacagugcuuucccguucaccaccgcauuucagcaccacaacagccaugggagggcaggcagaauagucucauuuuacagaggagaaaacuaagguucggagaguuaaaauaauuugaaaagucacaaagcuaacagaagaugggaccagacuuguucuguguuucuaauucaaucguccacaugccccuguacugaguggcuuccauucagguguuuguuuuugccagugaugaaacugucuauuucucuccauguaaugagugucauccugccuuaaaaaaaaaaugagaaaaauaaaaccuccucuguacauauaagccaaaaagaaaaaguggaauguuucacauguuaugggaaaagcacuuauuuucucucuaaaaacgcaucuugggcaacuuacuuggccucucuagacuuccauuccuucuuuuuuauuuuauuuuauuauuauuauacuuuaaguuuuaggguacaugugcacaaugugcagguuaguuacauauguauacaugugccaugcugguaugcugcacccauuaacucgucauuuagcauuagguauaucuccuaaugcuaucugaaccuggggucagacuuucuguagccaaccagauaguaauaugugaucuuugcauuugaaauguaaccacuuaaaaagauuaaaagccgcucuuaguuugcaagguggcacacagauuuggccuucaggcgauacguggucugccaacuccuaaauagacagaugauuucucagauuaaguucucaaguuauagcaaagugucaagaaaugcccuaauaaaaacuggucucaucagugauuccaccuguuccaaagcaucuaugggauucauugacccucacuucaacauucccggugucuuaaaagcagagcaucagaaacauuaggggcagcaauaccauaaagaccagucuuuucauauaaucccaggacugaggaagccauuuauccaagcaccagccgaaccaugaauuagaagccuuccuuuaccuugcucaccugagagugagugaaucccagugccagcccaaagcucagcagguucugaguguucuuucgucaaaaggacucaguccagagggcaaaaaggaaacauggagcaggaauauuucuaccugaaacauucauuucaaaacauuucaacauuuaaugucaagauugaccaacuucaugauacaagcauuggaagccaugcagaaggcaaagugcaacaagaauuggugguguaaaccuguaagguuuaugcuuuaaauaaacguaaauagauuuugauagaaaacccugcauagggaaagacuuagggguaggauugguacauacggcugaaaaugcagauagccaauauugauuauauuuaggauagagcaaugaaagucauuuaaacucuucugccaucucacagauagauuucugauuuuugccuacugaguaccacacacuuuuaucuuaaagaucuaauacuggugguugucagauauuuuucaagaaguuuuagaaauaacuuguuugauuuuccuuauuggcugugaauugauaaagagauaauuuuucuggugcaauaucaauuagcaaguagaauaguuuaaaauccaguucccugugcacccuggggcagcaacagauucuaauacuuuaccaauuucuuaccagauggaaauuccugcugcuaaccuugugaacaaguacaucgccacucaggggccccugccgcauaccugugcacaguuuuggcagguugucugggaucagaaguugucacucauugucauguugacgacucucacagaacgagggcggguaaguagcuugauuucuaauucagaugugugcagugucacacccuacucuguguaacaugaaucucagcgcugagaagggucuucagcgucuccugguccagcccguaugugacccuaagucuccucuacagagcaaccaauagacaccccuagugacgggaggcucagcccuccuccuccccagucccagcuuggauccauuacaacaagccagaaggcacuuccccuagccuuacuucaugugccccaacaccccugcagugacguggccuugcccauucaggacaagugcugguccugaaagagcagugugugugccagguuaacaguggccuuuguaaaaaggagaaauuacaucacugugccauuuuccauagaauccauuugggcagcucagcgcugucccugucuugucugucugcccuucucuucccuguaaaguugacucugccuuuucagcaggaaggucauucuucuccucagagaaaagggagcccccaccgcccagcaauggucucuugucuuagggcugauaacccuaaggguugguugcccuggauagcagcccccuucuuucccucauucugcuuuuuccagcuugggagaaaaggcccuuucugugauccaggagaccucagcuuccuccagccacuccuauggcugcuguccgccagcuccgugcugcugacagccccucuuuuuuguugauguccacucugcaccugagcucauuugaggucuccauugugaccuggaggguuuguuucccagcccuuucuuucucacugaagcuauuccagcugcuuugucaguuuccugcauuagagauucccaucuccucugaggucuagcauucccuucacuaucucuggcccuggaacuuaaccuccccuguuuauccauugguagaaaccuguucuucugaaauccagggugcauguuuccucccucuucuguugcaaacucuuggaugacaggaugaccucagcccuuuauccugaaggcccuaacccguccacaucaccacccaccaguucuuccagauuaggaguccaucacuccaggcagcagcuuugcgccuuucucugagagaugaaauuuucagcaucucccauuuguuuucuccuauaccaugcauuuaguagagugggacucccagcaggugugcagcuggcuggaguccacccccgcuccccagccucgcugugcuacucucaggucugcaagugcagagagagccuucuuugaagccucauauccccagcggucaguaggacacuuccccacgagauacuugauuucucccuuuuuaaauucccacccaaaauguuuuucuuugugcucucccuugaggcucauggguuucuucuuagaaacauugcaauugaauaaguuauucucccucacuuuccaucagagauguuucuuuuggagagaaauaucauuuuuugcuacuacacgugaauaaugcagguacucuuccuggcccacuggcggucagaggcaggggcuuuggggucagaggaggcguuugaguucuggcaccaccgcuuuccacuguuuaaccuugcacagggcucuaagccucaguugccucaucacuagaaaggaggugguaaugccugucuuuugggauuguuuugagaauuaagaaugagcuacccuggacuggcugccucauccaguagugggugcuccacguggcauagugagucaggauccuggccuccuugucucacagggccagaggcagauagguuugcugcucugggcaacauuaggggccccuggguugccaugaggaucaugugaggugacaggaagagguuugaggcagcacaaagcucuauaaucccccuugcucuuguuaucuguuaaacacacuguuuggugaaaugcacacuuaggcaacgaggcucuucggcagagaacugaucucugagucaggcuucaucaggcccucugguugguucagcaaauggaucuaggcacugauuccuuccaccuccugaacccagacccaucugcucauuuguugauaggacacaucuaccugaguguccucacauacaaggugccugaagcugaagcugucagccaugcaccugcacccaggugguacacgcccugagcucaccagucuggccaguggcacccaucugcccagucacccgagccaggaaccuggaaucggucuuaccccucccuucucuucacuucccacauccacucaccacggucugccgcugccagucuccccucucugucccccaaacccucaccuucucucagagcuuuugcauuucucuuccaggagcagcagcagcagccuccuuaguggcuuccuggccuagaggcucccccagcccccgucuuguccaucccuuggcacagcuuucagcgauaccuuuccagaggguugccugguccugucauuucccugcucaaacccucugguggcuucucaggugcaccacguaaagucucaccuugagacugguaccuucugugcagguguauuguacugucugucguucccuggguacaucaugugccucuuuaccucuugaccaugugugucccauucccucugccugaaugauccauccuugccuugccaaccugaugaagacccucguccuucaauacugagaucuccauccccucucuccaggacauuaccuccuccuccugugugagccgccugugucucugacuucccucuuucuuuucuuuucaccacauucccccaacaccgauucgagagcaccuugaggacagugccacaucgugucucauucaucucugcauccucagggauguuuauuaacuaagugaacaagaaagcaagcuuuucaccaugaagccuucuaaauuuggcccaugacucccacuaaacccuaucugguccaucuuccugagauagugcucucucuccuucuuuggcauguuauccaucguuagaauccuguucuucugaaauccagggugcauauuuccucccuuuuccucccucuccuguuacaaacccuuggaugaccagaugacccgagcccuuuaucccuaaguuccuaucucaucuucaucacugcccaccaguucuucuggauuaggagucggucacuccaagugagcagauuuaucccuuucucugagagcugaaauuuucaguaugucccauuuguguucacccauaucaugcauuuaguagagcaggacucacagcaggcguauggcuugucuuccacccagcuuguggcuuguuuccucugguccagaaagacacauccuuucagaaaccaucucccuggucagcuuucccuuccugaagccucuucucgaaaccacaccuggggacuggaaaugagaaacaggccccacucaggcuugugaaucucugaggacagagcauucugaguucuggcagcaucugcccagggucucguccccagcagcauguugccagccuccuagcuucagugaucuucguuguccauugacaacuucuccagaagugcuucuucucuuauaugcucagcuuugcauauguuacuguuuaauuuaaccacagcccuaagaaggugcauuuucuugucauuccagaguauuaccagccuggcuaaggguucacaggccuguugagacauuccagcucugccccaguuccucucucugugaucugacacacacugauucauucucugagccucaguuuacucauaugcaaaacagagacaaucauaguaccuaccucauaggguuguuuugaagccaagguaaagccauguucaugaaaggcaccauucagugcuuagcaucuaccguucugaagauaugaagcuucagaaucaucgccccucgcugcagcagcauuaauguggagacugagacccaaagaaguuaaguaauuugcccgagaucacuaaccaaauauguuuaguagaauuuauuaaccaggguugaaacucaggaucuccacagacuuguucuuuccacuacaccaccaguuuuuccagauccaaauugaacugcaaucuguauuuggucagagguaaagagagagucuaguacugcucagauucacuguggaauaaggggagucucucuggcaguacagauauugguaguucugccuugcauggguugaucucaucagagaauaucuucucugcaauuacccugugggcaggaccauugggagccuacaggacagggauuuauccuuccuaugcagaugaggaggugagagagggcuugugucugucaacucugccuugggcccuacagcccuuaaccugucaugucuaagcaaagucacagaauggcuacuaaccaaaauuacccauguuuaagguuuccaaguaaauucuuaacuccagcuuuccagcggcauaguuuaguuucaaguauucacugugacauuugaaaguaagaauagagaggcuguuucccaacaaauuacauaugucuuaugguuauaccacuuuuccaccaugaacaaauguauuuuuuacuuaaguugcuauaaccacauauaggcucaggggaaaaugcuuguuuaaugacuuaggauuuaacugacagaaggaucuaugaugggauggacagccuagcccugaaguuugcuuagaagccagaggcaggugcuaagauggcuuacaggacaaguugcagguuuuagaagcagggauagaaacuggggaggguggugggaucagcccgucugugcggacagcacagccauauugagagacacuggggugccauaggaagagugcuggacugcaucacugugaccucauggccuugggcaagucacuuaaucccgaguagcccuggauuccuugucugcugugugggauaucaccucuuuagggcgucaccuaagaaagccuucaagggcuucagagacgcugcuccagugagaaagguauucaucucgauuugugagucccuuaaucuggguuuuuguggaaacucaucacuguuacucaagcugguauguaacccaugacagcaacagaagucauggccacccccgccugcccccuacaguggcuaaguacugcacacccacgccggccgccucaccagcguugaggcaggagccaccuccaucuucccgguggaaaacaugaaaaucagagagguuaagcaacuguuucgacaucaucuggcugacaaauggaggaggaaaggaucccagcggaguuguguaugacaccagaugugugcccuuaacugcugugccuggaggccucccccucaaaaggguggggagaaugguggaggaggggugcaggaggaggggccguuggagguggggaggggccugaggggcuggggucugggaggguagagagguugcucacaggcuaagguccugcaucugaggccacuggugcucuuccagcgaguggccccuggugaugaagacgcugcguccuccuccuccaggcugcagccuggggcugagcggagaccuguggccuagucccuggcaggcugcccccaccccgcccugagaaacagcugauggacuuggcugaguuuguuuucucccaucagugcucucgggugugcaugagaggaugccuaacccguccaccuguccaggguuaacugcuugcaggaacaccccacagacggggcucacucacucucggugguuucuuacagaccaaaugucaccaguacuggccaga

SEQ ID NO: 13977 - RNA, 3101 nt, Homo sapiens
uauaaagaaacaaacguuagaacaucucuaauuuucuuugagaaauuuuuuguuaaauuuuuauguccuaccucccccaccccgcuuuuuuaacgugacagaguucccucauagcucaaggacagaaaaaaugucuguccugaaagaugguugagugcuuuuguuauucaauaggauauauuuaacccauuuguuucccuuuuugccuugguuaccagggaguucagaacugcacauuaggcucaauuguauucacuucccucagcccagauuucuuguauaggaccuucucuuccucauuugccuuuguuauaugggucuuuuuuuucuuauuuuaauggauucauaguuacauaucuguacguuuugggguaaacucgcaaaucauuuuuuuaaguagguaagacauagauuauaaauuagguuaaagcaugauaguaaaggaucaacuguuaggaaaucaaccauagucauuggguaucuauucuguuaagccccauacuauuucuaaaauauaguaagauaauggccccccuaacagcugaggauuagcaagcaggcacguuaguuaaucuguaaauuuuuuaccacuguagcuauuaggcugaaagcaucaaaugcacccugauuggacuccaggcauuugcaggugaauugcaaaucuccuucccauuuguaugugaggcugcuaccucuccucuguccuugcccacagcaaacaugguuuccaguuuaucuguguucuuaacaccucugguuaaauaaucccuguggucauucuuuccuugugaccugagcuuggaugaugcuuuugcuaaaugauugcuaucucuuguuccaacuugcagccugcugccccuuugucagggcuacaguggaugauugugaguuccuuugugugacuuuguagcuuuucaaaccacaagcacaucuagaaauacaaagcaggagugcaggcaugcgugacuagagccguuuugagucugcagugggggcucugcggcuuuggcaaaaggagaaaacgguuuagggaagcguuggagggcucugggaagcccacucacaccugcugcgucagagcuuccuguggugguuugcagucccaucacagaauuguacagcaucuaaaccuucccuguccaguacagcagccaccagccccaguugucuauucagauuuaaauuaauuaaaauaauaaaaauguaggcauucaguuccucagucacaugagccucauuugaauugcuugacagccacacaggaguguuggccuccaucuuggacagcacagauacagcccauucccaucacugcagaaaguguugucagcagcacucaucuagacuaacacguuuauuccaucguucauuuaaagggugaaccccuagaauaucuacaagcgaaaagugcauuuuucacacagaauucaugugggaguagguuuggaaucaucaccuugcuugcagucugggcgcuccacaccacucacccagcugcucaucuguggcauggggcagguggauagccucugagugcccucacagcccagcacccucugucucuuuaugcaaucagugccagguggggagggaugcauucuguccaaugacaugcaggcacuuuagagggcuugcauucauucccaaguccagcggcacacuuuauacauccuuggcuggucauugaggggaacaccggagcaaaucagagaaguuguuucaggagccuccaggccagcugggcaaauagcacauuaucagccuacgcugccacacuccagggcucugucacuuuggugaaaggaaaaggggggcuuagggaacaguacgugcccuacaucagauuuuccuccuguggucugcagucccaucacagagcaucuagaccuucauaguccaauacagcagccaccagcuccauaggacuauuuacauuccaguucauuaaaauuaaauaagauuuaaaauucacuccuucaagcacuguuugauguaagugauuucuggcccugcuuguuccuauacauugcacaaugagucuucuugaaaccccuccuugagaccuuguaaagugugucaucuuggggcucuuuuuaucuugcagcuaaauguuaagaauagcaaauaacagugguucaaaggcaggcuuccuugugggguuuuaccaggugcacugacaauagacaugucagggggucaaguuagugacugugcucugcaagugggaugaacagccagaaaagcagcccccaccaccucuguuaggugggagaccucuuccugccggugggaagccacuuugugcugggucuucagaggaggcuggcccuccugagggucugggaacccccauugcuccagguaagaaguacagacuggucuguaccuggugagagaaaaaaagaaaaaaaaaaaaaccuguugguuaguuucugugaguauuugcaaaauguuuacaaaauauuugacauguuuuauacagcagauuuguguuaagaggcaaaaagaagcauucugucagagaaaucggaugaauaauaucacagacagugaggaggguuccuuuuaagaagaagaauuaagugcgauguucuguacucguuuaaaaaagaagaaagagagaaagaaaaagagcgguuagauuuggcuguaaacccagaguggcgcagcucaggcugccugagugccaucuuagcggaugagucacuugcugguuuguuccguauuuauagcagcacagcaaaguuuaugauuauaguuaugaauccuuggcaguuugcuuugugcccaaguaggcugcacucuuuuguugcucccaagguucuaucagccauuguguguuccuuucccugcuuccgaaugaagaccaaauucugcagagaaguaaguuucuuucauggcagaaaugaaaaagcuaccacucuccacccagauaaaagggagagaauguucccuaaagaaagagacaugcagaacagaaacugggggaaacacauuguagagcaguuuagaguuguauuagaaaaacuuucugguugcuauuuuaucacaguugucuugaugggucaccagcaugacacccuccgaguggauggggcuuc

SEQ ID NO: 13978 - RNA, 72886 nt, Homo sapiens
uggacuccgggcuccgucggaaauccccccgacgcgaugcacgggcggcacccgcugcagcggcgcuaucccgggacgugcgacuccgggacaaggaccgaaaugagguuccaggggcugccgaggccucagucuaucccuggaacgacugcccccaggaccuggcacccaggcccgacuggaggguuccaaccaucucugcaucccuucguucacauauucaacaaauaauguuugagcgccuagugugugccagacaguguugcaggggggucacugcaguaaagacaagcagagcuacagccccaaagcugacauuuaggagggaaauacaacaugagaauuaaacaaaucggaggaaaagccaaagugaccaaccucaucugcuccucugccuccuugccguucccuaagcgguccggcgcucuuuugggucuuggcacuggcuguucccucggccaggaaugcucuucccugcuuaucugcguggcugaaauaccacuaucaccuucucagugucacccaaucagaccguccaucagcucaagggcccuauccgaccgcuucacugaaaauucacugcuuaccuccagccccaaaucuccugacccugcucuuuuuccucuuagaacuuaucacuuucuaauauaaugcauaguuugcuaauuugcuguuuaucuguuaccugucccucuuuccccaaacuccacugggggacagaauuuuugucuauuuguuccccacgcgagaaaaaccagaauaggugcucaauaaauauuugcugaaaauggauaaaucacuguuaaaugcuaugaagaaaacagaguacacggaguggucaggagcagagggcuaaucgaggaagguggucaggaaaggccucucugaggaggggaccuauguacaaugagaaggcgccggccacgugaaaagcugggcaagaacgucccacagagggaaaggcgggcgccaauguccugagguuagugaaguucgaguguuugauggacagaaaggcgcucuaggauccgcaggaaggcaggugugagaugagacggaggugggaagcaggagcacagaucagguaggggucccacgagccuuggggagguuuaaccagggaagcuuacuagugccaagggacgagcacuggacuggaagucagcgggaccucagcucaaccgcgcacccgucgugcaagacuccucauuucaaaguuucuuugggcgccgacuucuugccuucccuaggcaugaaaucacugagggccuggcacacaguaggugcccagucauggcuguggaacgaauggcugcaugcaugcgcgagggaacucaggaccugcccggagcucggcggagagccccggugccccuaggagaugcgucggggcgcgccagcccggggcgggggcgggagaacaccgcaggccagcccggacgcccgccccccgcccggcgcgcgggcccgucgcggccagcccggccggcgggaaccgcccgcgggcggcacugggcaugcucagacggcggccaggucgcgccgcgagcgagcuuccgcgccgcccgcacgcgcgaccuaccugggcgcuccgcgcccccggaugcugcagguacgggcccgugcgaccccagcgggccgggggcagggugcggggcugccgggggccggggucgcgcucggcgccaccccgcccccacccgucccuggggcgcgcggcggacgcgcgggcgggcuggcgggugcggcugcaccgggauccccgcaccacgucggggcggggagggggcgccccgcugcgcucaccuggcggggccggggcgggagggcgcgggcggggcgccggguggggcucggccggggcgggcuggcggccgggacgcggcgccggagcgugggcgugcgcuccagccgggcaggggcgggcgcaacccgcggagcccgugcguccggcaccuccggaggaccccgugccgccgcgaccccggcucggggcuccgagggggcacacagcccgcggggagcuagccgagagcggcugccagcgcucggcucccagggcgaauccgccucucggcuuucaaagauggcauuuccugggccuggcacgaaacuccagagccaauaaauccuccccguuccgcggacgauauggaaugauuuaucagguaccugcggugagacagcugcagaugggggaguguaugugagagugcccagcccccccgaaauucccauuuucagcuaccuaaacuuacugagaaguugcgguugccuuaaaaauucaugggaaguugagacaacuugacaccuggguuuuccaagcugguggaaagagcuugugacuuggaaacuggagaccuccguucaaguugggcucccccuuggccagcuggugaccuuggcaaguuguuuaaccucucugguccucaguuuccucccuugcaaucagcugguaauaaugcccaccucgcuggguuguugaguggauuaagugggauaaauuauguggagguguuuggcaccgugcccggcacaaagcuagcaagcaguuggcgugaugugaauuuaauucguuuagagacccucguggcucucauuucaggaggaaauuagaauuaggaaaccaucuucagggccuagugguggagugacagacccugucucugugcccaggagaacuucugccgaagucaaggccuucggaaaaacaauuuagccgaauuguaaucagagagcaucuccuuuaaaagcaguuuuauacauucagaaacuccagaaguuggcaguuggcuucacuuacaaaagagcuguuuugcaagaugauccaucuugcaaauguuuaagcagaugaugggagaaaguaaagccugcuuaggaagauuucuguuuuaaaaagcucccaaauccaacuuuaagcgauuauuuagaucaggguuucucagccuugcacuauugacauuuaggguuugauaauucuuuguguccugggcauuguaggguuuagaagcaucccuggucuguagauuccaguagcaauuccuguuccccaguuguuccaaucaaaaaugccuccaguauugucagauguccccuagggagcaaaaugccaccccagcaccccuuuagaaccaccaauuuaauucuugcuuucugucauuagcccgaguuguuugagaauuucaucuugugcuuuuguaauaacuaaccuuugcauagccuuauagaacuuacagaguacauucaccuguaucgucuuauuuaaucuuuacaacucccuugugagacuggugucacucccauuuuacagaugaggacauggaggcucugagcagccaauuacacaguaugugguagagcugggguguaacccaagucuccugguuccaagggcaggucuuuuucuucugcaucaagcugccugucccuuuguuguauggaggcuuugauauggaugacuuuccggaugauuaaaucaagaugugaaguauauuggaaguuggaaacuuuucugagauugacuaguugaaaauuaacaacaguaagcuauuaucugacagaguaggccauucuaguuaaauauucuaguuuauagcgagcucccauaaaucccacaugcaguuaauggaauaccaauuugcagagaauuagaguagaauagaacgugccuaauacucuguauugauccugcguuuucucuggugauuugccaucuccuaaaaaggacucauauaugcaaauuagacauuagcuggggaauauaaaaggucaaguuacugaaggcauuucagaguagcugaggcauuuauugaacuucuguauggcagauguagugcugaguggggauguggggugcaccccagagaauccagguugccugcauccacuuccgugcaggaaagggcaggcccuggucaggccagacagguggugggcccucagacagcuuggagcaggagaaaaagcccaaguuaccauggaagcagauucaggaucccuuaccauaucaucagucaugucucugaccccucgauucaucuuuuaucauacagaagauacucugguaguuuuaagcauucucauucaagucucagagaccugguuagggaggcaaggucagagacaaaucuuaucccuggaaaaagcugggguuccgaggugguaauuggcuucagagaauugagagcaacgcuuuguuggcugugaacuggaagguuucacacacagugggguuuguugcugccaaaccccaccccauuccccaccuugcagauaaggaaacugagcuggcaaagguagaguggggccaggagcaagagggaccaauuuugaccuucugaacuacagguccaggcacacaagagacauuuucuaggacaggcauaaccuaccagaagggcucagcuuuggggaugggagggagugagaagacauggcacccugccuuuccccaacccuccggguuuguggugguugagaaaagaccagcaauuuguggucccuacaucuuuucccaggagagcucaccuuccagcauugcgguccuggaaagcagggacaaugccucuuuaucuuuucccaagaucuguuguagaagcuggaaugcugaaggcacccagcacauacccuggucuggaagggcuggugggggugcaguagccuacccagcaucagcucuucauuccaacucuaauagagacaggaggagaccaggucaguguccacacugcucuuggcuggguccaggugaccucagagccugaucuuauagaugucuucuuuccucuggccgagaaggaccugagaagugcuugguaagccccuggcugaaaacugauuugguaauggguucuaagacccagaaauguugcaucuccagagcuucugcuugugugugcaccugaagcuucccacugcccccagguuaacuuguuauuccaagaccaggugugagcacagauuuaacagcaaauugagacauuuauugagucucuaccauguauuaggccauagggcuacagaggugaacgcugaaccccugccuuggaaggauucaugguggauuuggaaagacaguuuguauauguguaugugcguccccauccaucuguccaugguccuguaaguacuuuaaaaggauaagcuaggugcaagagacaccagaggaugcagccauucauuccgaugggcaucaggagacacuguggagcguaguucuaaccauggggagaaguuaguucuaacuucaaggcauaauuugaauuaagccucaaacuuaggaacaagauggcauuuagggcaggcaaaacagcaggggcaaaggcaugaagagacuuuguggaucauaggcguggugauucuucuccaaguccaaccuggucuuuuuuguuuuuugagacaaggucucacucugucaucaggcuggagugcaguggcccgaucauggcucaagcaguccuccuuguaccucgcaccugggacuacaggcaugugccaccacacccagcuaauuuuuuauuuuuuguggagacaaagucuuacuauguugcccaagcuggucucgaacuccugggcucaaacaguccuccugccuuggccucccaaaguguggagauauaggcgugagccaccgcacccagccaaauccagccucuugguguucacuaaugcagaacccaccugcucugguucgggucugcuuuaucucuguacaugggccaggccucaccuagcccagggcuaagugccuauucuccuuguuuucaccuggaugggagcaaugccacuguguugucuuugaggcaggaguaacuucugcagggaugccucugguuuuaguuaucagcacuaaucuguacuuauugguugccacacacuguugugagugcucuccaaauaguaacuuaauucauuuaaucuucacagcaacccugucgccaggcugccucccagguacaaguaggugggggcugaacuccucugcccaguguaugucccucugugggugaugcucugauuguggcccggccucccccuggcugccuuuacauagaugugccgggaaacagcccagucugaauugcaguggagcacugaccccauuuccuuuaggggaccggcaggacugugcugacugcguuuucugaaccaaagaacgggaucuguagugugaaaaaagaaugugugugccacugcuuugugcaagaggaggccugagaaguguuuggauacugagagaguggaauuuuugaaacauuuugaugguuuauauggaaaguuaggacagaggauuugaaauuggaauaguccuggaaaauugaggucccaugauuuacuguuaggauacacaagcuuuuaguaaauguuuaagcaguguagagugaagugaauuuuuuuuacugagcccccauagggaacaaacagugcauuuuagccucaaaaucugacugauuccuuccagccccauuuuacagagggggugagaaaacugaggcucagagagaugaaguaaccaccaaagagcacaguguuuguaagcagugcagccgagauuugucuuuuugguuuuuguuuguuuguuuguuuuuuaaauauagagaaagggucucgccauguugccaggcuggucuugaauuccucggcucaacugaucuuccugccucagccucucaaagugcuggaaucacaggcgugaaccacugugccuggcugcagccaacauuugaacccaagucugugccuagacaaaucaucuguugucaaagucaaauaaaauauaaaaacagauguuucucuaaauuuaaaacauuuugcuugggaaguaagaauaauaauuugggaaaucuauacagacuagguggucuuugguuuggaaaacaaagagaauguugggaguuuuauuagaaugagaaauauuauguauuguuuugaaaaaaguccaucggcacuagagaagcucuucgggagcuggcaagcucugauuguugcaugaugguagcagauaaaacuagucuuagggucacagcaauuuguuucaguaguuauuaaauaaaacugguuuuagguuauaacaggcaguuuuagcagccacgcuugcagagaauuacauuuuuggagcaauguuaugugcccugaguauuuuuccccuggccucucaacucugauuuaguugggcauuacaauaaugacccaaauuguauaaucaacuuccacccuguaaaaugaggaucauaauugcaccuauucccuuuaaguugacuguugucaaugagcuaauguggaaaacuaaggcaaaacuuggcauagaaaaggggucccucacuuuguggucagaccccugacccuccagacaagugcuuugaucuguguucagugcugagagucgcugugggugagugaaggucccuccucagccaggaccacaggucccgguucucaggacugaagggauauuccaagagggagcauccaggacugugcaggggccauggcugccugaaugcugugcugaugaggguccccuggcguaggagugggguuggagaccuggcccaugcaugucaccucccucagccacaucagcucaagggcuagcccagagguucucggugagggaggcagcaaccagcuccaucagcuguuuuuugaccgccagccaccauugggccuggggaggggagguuggccucugagcucagucuuccccacuggcucccccgaguccccuccccugcucugguuaucaaaugcauucaugguucuuguagaaaauaaagugucagggaacacaagaaaaauuaugcaugaugcuucucugaaagcagcugguccacugucagcacugccaugaucugcacaugcccucuccugcuuccaguggauucucuacuccacagacgggggagucuuccauacacuccuauuuuucucaaaaugaagacaaagcugaucucucagcaucuccugcaggcccuauguucaugcucuuugagcccucaccucaccgugcuccuuccugcugcagggacugcaagagccugggaccuucucccccuccccacugauuacuucauccugugggucucagcuccaugauugcagagccuuugcucaccuuccugacuugaguuaaauuguugcuauaaauguucaugccaccagaucucucuccauuauagcacuuuuccuaguggcaauuuugcaguuaauuaauguaauuauuuguauuaguaccugucucccggcuacacuguaagcugugugaaggcagggucucuuuuuuaaaaaaacuuuuucuaaguuuuauuuuuuuuucuuuuaauguuuuauuuugauacaauucagacccauaggaagguuguaagaauaaaucaaagaagucccauaaauucuucacccagauuccccaaacauuaccauuuuauucuuuuuauuuuaucccuguguacauauauaucuauccugaaccauuugaggauuauuuaucaaugccuccuuucccccuacauauauuuccuaaaagcgaugauauuccguaacuacaauacaaauuuuagaaucaauaaauuaauagugauacaacauuguuuaaucuauaaaccucaaguuuuauauacuuuuuuuuuuuuuuuugagagagagugucccucacucugccacccaggcuggagugcaguggugugaucucaguucacugcaaccuccgccuccuggauucaagcaauuauccugucucagccucccaaguagcugggauuccaggcgugugccaccaugcccggcuaauguuuguauuuuuuguggugacaggguuucaccauguuggaugcuggucucgaacuccugaccucaagugaucugccugucucagccucccaaaguacugggauacaggcccgagccacugcgcccggccuagauguuagguuuugccaguugucuuagugauguccuuuuuuauagcaaaaaaaaaaaaacucuuauaaauggguugcguacgguugucaugucucguuaguuuccuuuaaacuaagacaguuccccaauuguucuugguccuucaggaccuugacuuuuuuuguuguuguuguuccaagauggagucucgcucugucgcccaggcuggagugcaguggcucagucucagcucacugcagcauccgacuccuggguucaagcaauucuccugccucagccuccugaguagcugggauuacaggcaugugccaccacgcccggcuaauuuuuuguauuuuuaguagagacgggauuucuccguguuggucaggcuggucuccaacucccgaccucaggugauccgcccaccucggccucccaaagugcugggauuacaggcgugagccaccaugcccagccagaccuugacguuuuuggaaaguacaagccaauuauuuuguagaaugccccucacauugagucuguuuuaacucaccauuuuguccccagugccaagcacagucccuggaccaucaaaugcacucaguaaauauuuguugaaugaggagagggagagauggaaggaggugcaaggggaaaagucagcagguuuucugcuuucuuccagccccacgccuuucccugcugagugaugugggguuuuuuuuguuuuguuuuuguuuuguuuuuuuugagauggagucuugcucugucacccaggcuagagugcaguggcgcgaucucggcucacugcaaccucugccuccuggguucaagugauucuccugccucaaccucccaaguaacugagauuacagguguccacgaccacgcccagcuaauuuuuuguauuuuuaauagagaugagguuuugccauguuggccaggcuggucuagaacuccugaccucaagugauccaccuaccucggccucccaaagugcugggauuauaggcaugagccaccccacccggccuggauguuguuauuuaguugcagucauacuguauacagguuugaauccugcuauuuuuauaacaaagcuuuccccaaaaaagagaggcuuccugagaagauagugagccugcuguccuugcagauauacaagcagaagccagaugaugguuuggcagggauacuggagaggcaaauggaauguuugaugaggggugagacucaucaggcugggcgucccugcuaaucauggguagacuucucuaacugcagcacugacuucacaggccuaggcccccaagaacagugcaacuagaauuuaucaucccaaccagaacaauuugagaauaaaaagggguccuauuaauaauugcacaugacugacgggucuaagccgggacugcccuagguaaauccggacguguggucacguccggauuuaagagugacuucgagguugagaucagugcagggugagccagcauggaaaacccucuagcacuaggaaucuucuaccuggauaaagacaaaacuaaccucugcauggccugcaggccugauguuuguggcuuugguccccacaccucuguggucccaccuccaguaggaugccacucccagcuuugugccugccacaccggccuuuugucagcucucaccucacuaugguaccugucugccacaaggacuggcagagucuggaacgucacucacauacccuggcuggauggaggagcagggacagaguuuaugauagauggacagggagaugaacaagccagcugugcuucccacugaccaauuucuaauagaauuuaagagccaggguguguaagcaaagaagggcaggaggcgggagucacccuagaccuuaucuucuuuccucuagugcucacacuuccaccucuucuuccugcaccaacgcccacaucccuguuccagcccuaguucugagaugaugacuaagucacugaccuuuggcaaaggcagggaagcagguggcauuggggacccaggcagaagaggaugggcauuggauggacaguagaugcagacagggacuuggaugcagagaaaccaggcaggaaaccagcaucuagggaucccaguaacaaggucacuacagggccauuuaucaggaagucuagauuuguaauaucaagugaccagacacucggucaaggggucaggcucugggauccauacagucugguucuuuaacuuauuuucugccuagaagaaaauacaaaccuugccuuccuggauuacaaauuauuauaggaugaaaaugugaagauaauggagcuauuuucugggaagcaucccagucaugugaacuuuaagaacacuguccagugcagucguguuuuuauuacucuaggcaucagcagcuuuaauggaaaagccaguuaguaaaggaauguuccgguuccuagaaugcaagauacuaguacugcugaauguuggaaagauuuucugguuaacuguguuauuagauuuuacugcuuaaaaauguacuuucagccuggugcgguggcucaugccuguaauccuagcacuuugggaggcagaggcggguggaucaccugaggucaggaguucgagaccagacuggccaacguggcaaaaccccgccucuacuaaaaauacaaaaaauuacacagugcuggugggugccuguagucgcagcuacuccggaggcugaggcaggagaaucacuugaaccuggggugugggggcagagguugcagugagccagaucaugccacuucacuccagccugggcaaaagagcgagauuccaucucaaaaaaaaaaaaaaaaaaaaaguacuucccuccuccccccgaccccacacagcugcuuaaaagcauuucguuuggggucacuuuuuacaggacagagcaugucacacagugucagaacugaaagugaccucagaaaaaccuuuuccggcucccucuuuucuggauggagaaaccgaggcucugcaagggauguaacauacucaagggcacauagucaauggcagaguaggaacugguacccaugucucagaauuuccagcccccagaucuuggguguguuuucuacaucucauccaaggaaguuuaucagaugggccauguauuuuuauuauuuuguuaauaccuuuuggcauuucucugacuauagaaauaaguuguauuggcauugaagcaguuaggcauuucuugcugaguuucucuauguagaaguugcuaggcugucuuuuucuucuuuucguuuucauguagaaaagaugauauauaccuuccauugaauuuccauauccuguagcaguguuucucaaacuauagcacaucagaaucaccuggaaggcuggaaggcuguuuaaaagaggcuguuaggccccacccccagagcgugugauucucuuggucugaaucagagccucuggugaggccggaagguuugcauuucuaacaagcucucuggugaugccacucauucggacgccagggacuguccuuugagguccgcugcccaggguuucaugacacuuuuagauaauaugcucugcgcuuugcggccaggggggcccucccugcucuugccacaguggccagggacugcucacuuguuaagaccagaggcagguucucauaucucagcccauuuggucagagaaauuccucucuguuccagggcuucugugaugcuccucuccccuccuaccuuccacaccuuggcucuuccucugcugcccuuuauccucugaucuuacuguccugcaggccuuuucagguaaacucagcugguucuaucagcaggggcucacaggucugugucuccggccugaucaucucuggguauauuaguccauucucacgcugcuaauaaagacauacccaagacugcguuauuuauaaagaaaaggaguuuaauugacucacaguuccgcaaggcuggggaggccuugggaaacuuacaaucauggcggaaggggaagcaaacacaaccuccuucacacagcagcagcaaggagaagugcagagcaaaagggggaaaagccccuuauaaaaccaucagaucucgugagaacucacuaucacaagaacagcagcauggggguaacugcccccaugauucaguuaccucccaccuguucccucccaugacaugugaggauuaugggaacuacaacucagugagauuuguguggggacacaaccaaaccauaucacugggcauuuccaauccuguguauaucacaucugcacaacuccucaugagugcccccaggccccuccucugcauuucugaaacagagcucaucaccuucuuucuuaaaaaugcccucuccacuaguccucuccacauagucuuccugcuuagaaacccaaggucacucuucacuugucccccauaaccugcccuggacaagccuguccaccacaccucagaaaucccuucuccagcccacuccccuuuuccacuccacccaaacugaguucucucgcuucucccauuugccucuuuugcuuacugucacaaauaggccccuugcgccuguaccuccuucacauagcuaccagaaaaacguucccuuaaaaagcacagaagaucaccucauucugugcaggcuccaucuggccuugcuuuuccccaucuuuucuccaacccugcaaaauguaugcuauaagccagggcuucccaaguuuucauguuaaaaugcaaauacauacucagcagguuugggcuggguccuguacucugccuuuccagcaccgucccaggugaugccaggaugggguccguaagccaccacauguugaguggcuggacucuaggggagaucuguguuucacagaguccugcagaccugucuucagucuguucauacugcaagaauuuccaaguucuguguugucauuguaauguuuucuguuguauguaaaguuaaccuuaaauguuuucaaucguaaacuuagauuugcuguugcagugguuauuugcuauugaaagaauuuucaaagaccaggaaaggcuucaguuuucuucagaguuacuaaauagguccaggugaauagguguaugggagucggggguggaucuugagaauguuuuuccuuuaaagagguacacacugcaaagggguucccucucgugagcugcuccaggacagaggcucucccguacucagucuucucaggauggugguggaaggggaaggagaagagucugguuuccguaggaggagaugaguguggaaacugaugauuccgucaggaaagacugggcggggaaggggagcucuccuggggaaggugcugccagucacaggagaagagggcgaggaucugggggcuggaucauauaugacucuuuuuauuuuuacuuuuuauuuuuauuuauuuauuuauuuuuuucuugagacguagucucucucuguugcccaggcuggagugcaguggcgcaaucucggcucacugcaagcuccgccucccagguucacgccguucuccugccucagccucccgcguagcugggacugcaggcgcccaccaccacgcccagcuaauuuuuuuuguauuuuuaguagagacgggguuucaccuguuagccaggauggucucgaucuccugaccucgugauccacccgccucggccucccaaagugcugggauuacaggcgugagccaccgcgcccggccgacuuuuuauuuuuuuuuaagacagagucucacucuaucacccaagcuagcucacugcaaccuccaucucccagguucaagcgaucugcccaccucagccucccaaguagcugggauuacagaugcacaccaccacgucuggcuacuuuuuguauuuuuaguagagauggggucucaccauguugcccagacuagucuugcacuccuggacucaaguaauccacccaccuuggccuccaaggugcugggauuacaggugugagccacugcaccuggccuuauaugacucuugauaaggcuuugcucuugaggagccagcuggggaaaccacugguaggcaugccugggagccaggcuuuguccuagcgcaggauggggggucauagagggcugaggacugcgugaggaugagcagucaggaaguagagccaugugcaccugggacaaucaggaucuugccacagcaggagggucagagaagcaagucccagguagauguggggugagggaaugggauggauaucaaacaagggugcugcugacuuugaccagccugcuccagaaaccucacuacccuccugucgccucugaaguccaggcaccucaguccaccacugaagaguuuuucaggaucuggccucugccuccucucccauguguuuguucuccacaacuuuugccccucaauucuagcuccuagccaaguggcuguuccucacuucagauucagauguccauccucagcuccaaguuuccacagagguggcucggccaggcugcugugcucaguguuagcucucagcacagguggugagccugggaccaucaccgggcccccacucccucacuccagggcccugcucgagccuccugaguuucggucuccaccucuccacacuggaaugccaguggugucuccaccucacaaggucgugugaugaucccguggugacacagcagcaugcugaguacucaggcaguacuggcucagcugucuggacagagggacugcugugggacauguguccacagcuugagguggagagagcugugguuggugugcgccacccagggcaggguggggcucaggcaauucugccugagguggacacugcagagguuggcuuuaguucacugcguagaugucaaaggcaccaaaagauggcagcucgcgacagagugaagaggaggaaguuggaauuggaguggagaacgcagccugucacacuuuauacaaaaugauucagauucuguaggucaggggugaggccugagacugcauuucuaacaggcacucagugaugcugaagucacugguccagagacugcacuuugagcggcauucauccagaacaugauuaaugauggggagccuuguggaggagaagguagggaaaaaacacgcacagcuuaacguauacccagcuuucugccuggcugcuuggagacaccucaaaggggcagguguuuccaggcgucuggggucugucggguucuguuggaaucagauugugggugaugauggagacugaucguaagagcccggugagagcuuugggagacguauggagugauuugauuuuguugcuugauaucucaucccucacagucuggcuucacaguuauauccuccuuagaaggcaucgcuuucugccggaggcugagccauggucacacccuggaagguccucugucuuagcacuccccacauggaaagcugugauuucugcaucccucucucucugauugauuugugaguucccggagagcuaggaacugagacagccucuuaaccuuguaccccagcaccugccucacagcugguguuagugagagggguggauacagguuuugaaggaagaaugaguaaagccugugaucaaaagggaguaggagagcccagcaccgagcuggggcacuggagccugucgcuguggacaggaggcccagcuauggcauuagccaggccuuuggugaaauugccaggaacauggucuaaaggguacucgcauauugggcgucagcucugaggagcgagggcugggcugugaguucucugaagguguggagggcuccaugggggaauggcaguuucagccaagaagcuaucauguugaucugggagccaagagcaaaccuacuuuucuucugcugccuucaggaaaggacaggugcccagauuuaugcagacuggggaucaagacuuuucucccugugcaucagggcauggauagcagcucuuccugaggcugaguagaagcagcagauagggcuccaacaccgggcagugucuagagcagcccacagccuuagcaccugcgagugcugacgaggacccuguggguuaaugucaguuucauuuuccugaggaggaaauggaaucucagugagguucaguaacuuguccaaagccacagaucugggaaguggaggaggcagcccagcacuggagcugguuucugggggaggaguggguccagguauggauuaaaaggccagagcauugcagaggugguagggcagggcagacaguggauagugggagggaacccaggaagaggaagcaggguuggggaugcagaaaugggacaggaggcagcagagagucagaggacggagauuuaagcaguuuaacacccuagcaccaauaaagcauuaggugacagcauuuaaaacaaaaaaaauuagaucaguuugacuuucuucugacucaugauugcucaucauagaaaauaacagaaaaguugaaagaauagaaaaacuaacacaugugggguuuuuuugucuuucagauuccuuuguuuuaauuaguugcgguuaucccguagauacaacuuuauaacaagccucuuaauauucuaaucacacagacauccuguggcuguuuuguggcuuacuuaacuggccguccgaaauuggcaaguagcuuuuuuguuuguaauuuucaguguuauaaauguugcugggaggaaaaucucugcaacuaaaacuuuuuuucaugucugaauauauccugacagcagguuccuagaaauggaauuacuuagucagacugccuuccagccccauuggaaugguaugcuguguuagcgcugacacaagccuucuaaaagugcagguguaaucccugcgcgcauuaguuguucauucauucauuugugcauuucacacacauuucuuaagcgccuaugggcagaggcuccauuuucuauggccugaucagcaggggagcagcugccagcaucuuggaccugaccgaaaggcgggggaguuucugacuguacacaaugucccagcccucccugucuuugucacaggcccaggagcgcuggacagccuauggguccagaaguaaacuugggugccucuguggcuacaggguccaggcagugcccacccaucugccuuccccucuugugacacuuagugacaugcuacacacugaguaugggguucccaauuuuaucaauuuauucaugcauuccauagauacuuagugccucaugugcacuggacacuguucuagaugccauggagauggcaguucacuacuaaaaucccugccuuuaaggaacuuacauuuaaggagaaaucuaaaguagggugagagggagaaggagugaucagggaaggccucacugaugagguaaaauuuaagcaggcacaugaagaaacugagugagagagccaggugcauaucuaagggaaggguguucaaggagagggaacagcacgugcaaacacccaagguuggaacaagcuuggcaccaccugggaacagccagagaagcaugagacccugguggagcagaaugagaucuaggacucaggguucauuuccccauccccuuuggagauuuuagaaccagagggccaccccuccucugugaagcaguucaaacuaaccucauguauuucucuugcuuaucuauaguuggccaucacugagaccuguguucggugggcucuggcuuuggaagucccugccaugcccugcccugcccuuggguuuccuuaucugugcacugagggacuugaaccaggagacuggcaaggguacauugggcuuuccucugucuuguccaguuaggucugugaguuagaucuuggguaauuuuuagguuaauauuaggaguguguaaaugccguuguugauauuuaauucuuaauauguuuagccuauuagauuuccuuuguuaugaaagagucucccagccagcugugggcagcagucauaagaagugaguggagggauaaaccuagugguuuauccaucaaccauccaaccaugcauccaugcauccauccauccauccauccauccauccauucaucccacagugaauuauugagcaccuguuggguaccagccacugggcaggcugccugugcggcaguggugagauuuuaaagacucagacccagccuuuuuguguagggauguuagcucugccagaagaucgugcuggugaaggacuccacucagcaagaccagagcagcuaacacaucauaccauauacaaaaauucacucaaaauggaucaaugaccuuaauaaaagacccuaaagccauaaaacuccuagaagaaaacauagggguaaaccuucacaaccuugaauuuggcaaugaauucuuggauaugacacuaaaaaugcaaguaacaaaagaaaaauaaauugggacuucaugaaaauuaaagcuuuuuugcauccaaagacaucaucaagaaagugaaaaggcaaccuauggaaugagagaauaggccaggcgcaguggcucccacuugugaucccagcaccuugggagacugaggcaggcagaucauugagucuaggaguucaagaugagccugggcaacauggugaaaccccgucucuacaaaaaauacaaaaauuagccagguguggugugugccuguagucccagcuacuaaggagacugaggcuggaggaucacuugggagacacagguuacacugagccaagauggugcuacugcccuccagccugggugacagagcgagacccugaaagucaacagcucacacuaacacaaaacaaauuuuaaaaaugggcagaagacuugaauagacauuucucuaaagaugcacaaauugccaguaaacacaugaaaagaugcucagcaucauuagucauuacggaaaauguaaaguaaagccacaaugagacaccacugcacaccuacuagaaugguuaugaucaaaaacaggaaacuaacaaguauuagcaaggauguggaggaauaguaacccucuuauauuguggugggaauguaaaauggugcagccucuguagaaaacaaucugauuauuccccaaaaagcuguacauaauagggccaggcacagaggcucaggccuguaaucccagcacuuugggaggguguaucgcuugagcucaggaguuugagaccagccugggcaacagggcgaaacccagucuaccaaaaguacaaaagcuuagcugggcgugguggcacacacuuguagucccagcuacuagggaagcugagaugggaagauccauugagccugggaggcggaggaggcugcaguaagcugagauggugccuuugcacuccagccugggcaacagaggaagacugugucucaaaaaaauuuuaaaaagcuauagauagaacuaccaugugacccagcaauccuacuccuacguauauaccugaaagaauugaaaguggacucggacagauacuuguaugcugaaaugauaaaauuuaagcauugcaacaccauucacaauagccagaaggcagaaacaacccaaauguccaaugacagaugaauugauaaacaaaauggaauaucauucagucauaaaaagaaauaaaguucugauacaugcuaaaauauggaggaaccuuaaaaacaugcuaagugaaauaagccagacucaaauagacaaauacuaugugguuccacugauguaucuagacuaggcaaauucguagaggcagaaaguagauuagagguggccaggaguuggaggaggggugaauggggaguuauugccuaauggguacagaguuucuguuugggaugaugaaaaauuucuggaaauagugguaauguuugcacaacauugugaauauaauuaaagccacugaauuguacacuuaaaaauggcuaaaauggcaagcguuagguccuauauauuuuacaauuaaaaaaaaaaaaaacgcuuguuuaccggagauuuaaaagaacagaaaaaaagaaaagaaaaagaaaagaccagaagagguagugggaggagcacgucuuuggcaggagccaccgguuuggauucugcccugccgcugggucaccucagaaacacaugugguaaccucaugggcgaagccugguccccucuuuugaugugagaguccaguaagauggugagugugggcucucuccugggucaugggaguugcucagggaauggcuucccauccccuuuaauuucaucuuuuccauuguaaaagauuguucuaccugguagaaaagacagaacacaguuaacuuggcgauuuugcgcaaaucaucaucaguuaccuugcucauguuuagccauccuccucuaggugguggcccagccccugucugucaucucguuccuccuuucuuugguguuuuugcccuaacucagggcucuucgggacccccacuuccuuggcauuggugccuguccuuggucacaugcuuccucuuccuuuucuggguuuacuguggauucuuucugacaucugagcucugcuagugagaagucaucugaacacccagccacaguuauguacacccacgugguggaauaucguagagucauaacagaaggggucagggaaguguuugaaauaccuggacgaauguuggauagugaucaugagaaagaguggaauauaugauugcauagacauuacaaguucaacuuuuuaaaaaacacaaacaaaauuguugguuggcuuguuuuguucaaccugagcacaucagaguccacgcccuuuguagccacuggucugagccgcccucuccuuccccuccaagguucacuaccaucuguggucagaucccccuuuuucacagccacccaggguuauuucuugcuaccugagccucucuccuggcagguugaaagaagcucaggguucagacaccgugaggcuguccuggauccuccagagauccaggccccugcuacacccagguugccgcccccuuguuuaucaguuacuccugccccaugacuguccucaugagauccuuggcucagagccagugcaugugccccgaaaggugagugagcaagagucuuauggagcucuaguuugcugagaagcucagcuucccaugggccggaaggaguccuggcaguuccgagaucccuggaggcaggugcagugggaggagagacugacuggggccagggcuggccaccucacugagguccggaaggagagcuggucaucagguaggagcggccccaggccaaacccagagccuggccucaggaaaugagauggccuguuucugcccucccgcugcugcuaauaauuaacccagggacggcugccugugaggcuggaagggccuuuagacaucaugugacacacuccaguccaggccuuuugcaaaagugggaggaagucauuuacuacauuuccucaauucugaaaggugcguuggccacacuuuaaugcuucugaaaucaccgugaccuucacagucacaggguaccuuggauguacuguuucuuuaaaauaacuuugcugaaacaccuguuacaucaggugugucaucuuagagcagagguaauauggugauaaauacccagaucauuacucaaguuucuaauguugcagaguuaauuagggggcaagaagguuuucugggccauuucccuuguaagaggaaauuuaccaacaugagagccucggggaguguuuauaaaagauuaucucaaaaggguaagaacauaccuuauuuaguaaguuacagagacaauagugacuaaguguggggcuccguuuaccaccuccagugaaucaccuguaauucgucugccucccagucacguggaucaguggacucagaguggguggugugugaugcccccaccugagcuugggaucaucaccuuguuugaagucugccugugugaccugugcgugguucugagucgagucucccaaucuuguaaaaugguuaacagcagugcuaccuuccaggcccagucaaaaucaaucagucaggagugagggguguaaaaauacuuggaaaucgcugaagcccuguagcacaggaagcccagaaacaggaaagggaauggcccagggacugagaaagaaggcaggugggaagggcaagaaugcauaggcagcauucacagagcugguguugaguggcuguggcgggccaggcccugugcugcguuaagaaugaaaucucugcucccuauaguuauucacaggggaggaaacuaagacaaaacauuaauuuguucagguucauguccacuugggaguggcagagcagagacuagaacccaggucuggcuauuccuucaaaccuccaguggacucuggccuggcaagaccccuccugucccagaguacucccaagcaaagaucuucuugguccagucacggaccacucuugaaaucagugagaggguugucuuuaucucuguauucucagcucccagcauguggaaggccucaguacagauaaaugcaucaacagcagcaaugacauauauuauuuccuuuuuuucuuuaccuuuuauuuuuuaguagcaauuauacauuccuuuuguuuacuuuuuacuguuuuuuuuuuuaagguuuacaacuuguuauuuugauaaacauauacauuucauucauuuguuccuaaauguuguucuccugauuugcauuuuggcaugccuuuuagaagucuuuuuaaagaguuucauuaauuugcugaccccauuuuaucaggguacaaagcccuggaaaucugaauaggcugcauaaaaauauuuuaugguuucuaggggcacacuggcaaccagcaggguuaccgaaccuaauauaaccugagauggcccccuggauuaaaaccuuacaggcagaggauuuuaaagcuggaaaaagcuuuagagggcucuaaccugggaaaccgagccagagaaaagugaguuagugacuucgcgagucaccuggcugaucagagacaaauaagaugaugcuucguggggguaaguggagaguauuuuucucuguuuccuugagauaaaauuauggcgagggacacugguggugaggauuggguuucucuggccggacuaccacuggcuucagacuccuuggcgggaacagaggcuggcaggaugguccgguugugagauuccagcuucuuggcugguaugcacugugauuagcacaucucaaaccuuucaaagugacuuuagcuguuuucuuuucugaaggcuucugcugcuuuuggcuguaaaggggugggggccagagccuaagauagaaauaucguggacugacacccaaaugggcgugucugugccugagagcaaauauuagcagaguauuuuuguaagguuuaugcaacuugauucaugucccuguggaguaaauguauuccauccugauuuccagucugucuggggccuaguggaacuacucggagggaaaaugaaaugagaucaguagcuuaauuuuagguagaaacagcuaaauguaaaacauauuccauugucuauuuugugagcuuuacauauuuuugcuuguuauagucccucaucuccuauuucacgguuugaugggccauuucaguuuuuuccaagaaugagguauucauuuagaauuauuuccgaugagaaaguauacaugaaaggaaauucaguuuugaacaauaccacauugaggcuuacauguacagaaacuuaaccuuggaauuguugaaacagaaguccugaaagcccagaguucaucuaucccacucuucacugucagucugcccucugaggccuucucaccaagggucucauccagcuucucugcuugauuaccucuagugaugaggagcucacucucuuacagggcacuuccuuccauauuugugcagguuuaacuguuuaaaagcuccuucgucuguugaagagaaauguguuucuuucaucuucuacccauugaaccuuugggaccuaaaaaaaucagucuaauuauaguagcuaggugcaaguuaauuugcauacacauuaucuccagugauuaaaacaaccuuagggaaauccuuccucuuuuauagguagggaaacugagucucagagaggguaagcagucucuccgaaguuaaucucaguaagugaugaagcugagguccccccacagcugucugauucugaugcugguaacuuucccacagccuuacauuguauccuaauuccucuucugugugacagccccuuggauuuuugaaguaccuaaucuuauccgcccugagauuucgcuaagauuucaguuauuccucaggaacgccugcuaaaucaguuucuguggaguucccauaccaugcgugcauuuucccccccaaccuuugcacauggguuuugcagugucuggaaugcugcagcuucucccuggccaauaccccuuauccugcaagacuccccaugaaauuucugugaaccgguccugacacccaccccacccugguggauccagagcccuccuuguguuccuccagcacccuggggcuuccucuccccuagaacuugauacugcccacucccuggccuggcgcagagacggcacagaguaaaugaacaucgagagaguaaaugaugcggaacuccuuugccaaaguagcaaccaaggaggcuaaaaguaauuguaaacaagauugacaagcccaugaaaucguagucagaugcagguugcuuggaggcugucguggggacagcuugucugggguaaguccugaugucauuuuccucaguaugacuugguuaaaacccccccaugggcuggcauuugcccuauuuuucucccaggaggcagguuugcuggcucuuaagugucuggguucaccaagguggcgcgcaguggggaaagguuaccagucacuguucagugacuaccugggcaaaaccaaaucuuauuucuuugcaacccacccaagacauccacauggguaccgagaagcaacccagggaaaguugagaccuguggaauuugggggugugcuguuugacacugcaucauaaucagauuuccuaaaacucuuuaaaaaaaaaaaaaagaacuucuaacacaaucuaauuuuuaaaaaacucaggaggauggcguuguaagucaggagagaguggucaccuguggaagggagugucuggaagaggacaugaggggcuccugcugggcuccuggggagcacuauauuuagcauuuguacuuuuucucucugugauacuucaagaaaaagguuuuucuuuaaauugaauggcuucauuuaauauacuuagcaugaguuuucugccggcuucaaggcaaacuuuguguuuuaguuacuagcuucucaucacaacacugaaaacccagcucauggcacuuaagagauugguuucucuuuauagcaacauuaccucuuucccgaaacugcccgcggcucccgcagcauucuuuaucuugcccuucagggagcuuaaaacuacuacuucuuacccugccaggaucaaguauaacuuuuauuuuguuaguuuugcaagugucauggugucgaaccuauaaauaaaaccuauaaauaaaccccaacuccauaauaagaaaacuauuugacauuuugaagucguaugaaaagaaggccaguaauuacagaucucaguuugaauacaacggguccuacaaaugacuccacccgggcuucccaggggcuucagucagagagccacuccccgaacaaauuacagggucuguagaacaaaugauuugaucccaaaauuguacuuuuggaguaucaggauugacaacugcaagaugauucgacggaguauugugcuguauuauuaaagugaccugugugagugugucucccuugugcuagagaaaaaucugaagacucgaguauuaaauauguucauaaaucauuuuuucauaaaagguauuaacacauucauaaauacccaaauuuuuaaaaaguuuuguucaccagcacuggcauugucaacuguguuauucauuagcagacuuuaugcuuuaaaaauguuauuuaaaaauuaauguuuuaguauauagguucaggauaaauuuguuucuuggcuuuaacguugaauuagccauaugagguauuccucccugaauaaggacguuuguuuuucuaguuuagcaaguauucagucacgauuauguuuacauuaaaaccuaauuuuaaaaauaaguuaguguauuuaguguauuuaucuuuguauuguuauguaguauuguacuuuggaaaauuuaaaagccaagaaagcaggcuaaaaauggcagaagguaguguugaucaauuuaugaaauuauagaguuaugaggaaaaagauuaaauuccagguaccaguuguacaguaauuuuguuaucaacuguacuuauuuuaaaacuaauaaagggaaauguauaggaaaguguuuucuaagauauuugggcauuucacaaaugaaaacugaaaugacuaauuuuuaauuaguugggcugaauuucauuaagaacguucgcaaaaaaauaaaaaugauggugaaaacagaaaauauuaaauaacauuuuuaaaaagaacauuuucaaagccugauaaauagcacaaaauguaugcaucuuguuucauugcugcugcuuuaagaaagugcugguugacucaacggguuucugaggaagggugugugcauuguguggccuuuuauaauuuggacaaauuguuaagcauugguguuggugaaugaugugaacucauuugagugaacaagccaagacaucugguuaugcaauaucaagugauacaguccuuuuugaaugauggcaguuuuccuguugcuuucuucucuauuuagacaacaguacuaaucccagcacugacauauagacuggaaaaucuguuacuucaucaacaaugauuuaggaagcacuucucccagaccgagugaugggacagcugccaagcuacagaaacucuauuuagcucugggaggugacuuguaauguagacaguaaaacugacauaaggaugcccaccuaacaaagacccuggcuguaagcauagacaggcagaaccaaaaggaacucugaagauugucugguggaagauuuuccaccguguggcucucagaccagcugcaccauugccaugagggucaggggguauuuauuuaaaaugcaacuucaagcugggugcguugguauacauuuguagucccagcuucuuaggaugccugaggcaggaggauugcuugagcccaggaguuugaggccagccugggcaacauaaugaguacccugucucuuuaaaaaaaaaaaaagugccuuccauaugacaaguaaaaccaggcaugauccugauuuggauuguggaucggggaagauaaauaaaggacaucuuuggaacaauuugcaaaauuuuaguauggacuggauauuagauaagugcuuaucaguuaaauuucuucagugugauaauuguacugugguuaugaaaugcccuuauuagggggagauacaugcuaaaauauuucgagauaaaggggcaugaucucugcagcaagugguucagagaaaagccuggugugucuguguguguauacagaugagagacaugggaaauaaaguguaugugggccgggcacgauggcucacgccuguaaucccagcacuuugggaggccaaggcaggcaaaucaccugaggucaggaguucaagaccagccuaggccaacauggugaaacacugucucuacuaaaaauacaaaaauuaguugggcgugguggcacaggccuguagccccagcuacucgggaggcugaggcacaagaauugcuucagcccaggagacggagguugcagugagcugagauugcgccacugcacuccagccugggcaagagugagacuccaucucaaaaaaaaaaaaaaagaugcguauguaccaaaauguuaacaauugaauccagggcaaaaggguuacacaggaguuuguuuuucuugcaacuuuucuauaaguccagaaaauuauuuuuuguuuuacaaugcaguuuccugggcccuuacugaaccaaaaucucuguggaugguaaccaagaaucugcauuuuuaacaaguccccagaugauucuuguguacgcuaguuuuaagucacugguuaaaaagaaagucucauuucagucacuauuuuuuuaauaucuugaucagugagcagacauucuuaguuugagcucaucuuagugcuuaauaaaugauaaauaaauccccacccaaguguuuguaaauuuuuuuuuuuuuuuggaugaggucucgcucuguugcccaggcugcagagcaguggugcggucauagcucccugcagccuugaccuccugggcucaagcgauucucccaccucagccucccaaauaccuaggacuacagacaggugccaccacaugcagcuaauuuuuuuuuuuuuuuguagauaugauggucucacuaguaaauuuuaucuuuagaagggaauaccccacuuacuucagaggaguuuaaggaacaguuaggccuggcuuuaaaacagacuggaaugagaagcuguccucuuugagguaccaacagcaguaggaaagcaugguuucugucuuccuaaaggcgugagcaaugcgagugauuguugcuuguuggggccaugguuggccccacaaagaacucgauaccacauaaugcaacccagcaucugugugucuacagugacgagagagaacaacgcugguacuauauuagcugcuaaaugaaugaagcaugugucugcaauacguuaaauauuggcauuugacgagaagugcacuuaauuugaugaaucauugucuaggguggcugauaguacauguacuuuuccaugcuagaaaugcccuucucuagaucggucaucuguuggagcucagaaauagcuaaaaggaaaaaaaaaaaguagagggaagaaggcgcuuuccugaguucauagggaagaauugggaaaaggggacugcgccacggagaagggcuucuauacugcaaaaaggauuuuugaaauaagcugaacuggaagugauaagcaagaaagagcagagcugucccuguuucccuugaaugccagcguaggagguggcaugucuuccucugaucgccacuaggugguggcauugggcuaggccagcuugauguagguugauuacuguagugagccacccaugauucauuuauacagguuacuuacaaauuggguauuuauaaaucaagacuguuuucuuauucuccuccuuuuuuucaacggaacucauauucuucaauuagaggccuaagucccuuacuuuaaaaaauaagaauauggaauacuuugccauuuauuuauuugagauaagagucucacucugucgcucaggcuggagugcaauggcgcgaucuuggcucauugcaaucucugcuucccggguucgagcgauuuuccugacucagccucccaaguagcugagauaacaggcgugccccaccacacccagcuaauuuuuguauuuuuaguagagacgggguuucaccauguuggccaggcugguaucacacuccugaccucaggugaucugcccaccugggccucccaaagugcugggaauacaggcgugagccacugcgccggccucuuuauuuaaaauuauaauaguggaguuggguuugcucugucauuugcauguguuccucucccuucuuugugucuaugguucauuggcuugcgaaagaacaguuucccagauccgaauguagacagacccuuuggaaauaaagcggcggcauuacccuuucguugucucaggcuucagggcagccagggaggagcccuaguagcagcccuguuacccaacccugacucccagggcucuggugucucaugggcccaggguguggcaauuugugccagcaugcuacugcuucugguuccccugaguuuguagagcagcucaaagauguaucacauaucuaucacaacuaucuuuuaacucuagcaagcugucuuuauuaaaguggauacauaaaacuuuaagaaauggaacauucauauaucuguaagucguuugaaaucaggauugcccuacaaaaucuggaaucuguagacagcacccaauggcauuagaaguuuaacguuaauaaaaugccuuucauugagugccugguaugugucccacaugugcuaggcacuuuccaugugcaacucuaacucucauggucuuuauugugccccuacuguuuacaaagugagguguugccucuugcuguauuuuccaaguauaaucuuugauuaaaaacuguauucacagccgggcgcgguggcucacgccuguaaucccagcacuuugggaggccgaggugggcggaucacgaggucaggagaucgagaccauccuggcuaacauggugaaacccugucucuacuaaaaauacaaaaaauuagccgggcgugguggcgggcgccuguagucccaccugcucaggaggcugaggcaggagaauggcgugaacccgggaggaggagcuugcagugagccgagaucacgccacuguacuccagccugggggacagagcaagacucugucucaaaaaaacaaacaaacaaacaaaaaaaaaaacuguauccacaauagagcuucguuugcuauuguuuaaaacauucuaaagcuauaauggauuuuuaaacucaugcaaagaacaagcuuggcuuccauauuauaaaaugcaucagcagcagcuguaaucauuugugucagagaggccagcauguuccugguuggguuguggcuuuguuuagaauuaagaggcuuauaaaggaagccauagaaacccugaguuccccaauugcuguaguacaggaaacagggcaguuagucagcauccauugucccgaccagauuguuuaagauguaauuucaagacaaucugaaaauaccacauggcucaauuauuggguuauucaacaucaggcucauucuuaccaagguuugcuuuaggaaccauuguaggaagauuucugcagcuuucauaaaauaccuauuuaugacauugucauuagguuucaagcccuuuauguaacaaucagagaugggugugagaaagggaagucugucucuccuggguugcuggugggcuuuauuuugucagcuagcugugugacugugcuggacagcaucauugcuaaccacggugaaaugaauaagucccagcggcacccacgccagcacgagcaggagcugcucaggugaagucuggaaaucaguguccaccauuggagcaucagcccaugugacuuucauuuggaggcaccuguuucaaaucuuaguuuuuuucugccuggggucauugugugacuaucucugcuuuagcuguuccacagaacaacugcccaccucuuaucacacacagugaauucauccacauagugcauggcuuagauuccgcagagccuguauucuaaggccauccauccaaaacacacccugagguucccuggaaacccacuccuuuaguccucgucuuccuggcuguuacuuugagggcucccaaagggaaugugauccugcgccacaccugaggaugcugaaucaccacugggggugcggggacaggcagguuuuaaaagcuccucaggugauucugaugugcaccucccacuaaaaccaacuugaaaugguucuauugugucuuuugaaaaaaaaaaauguaacccaccugagauucuuagacaagaacuaaaaaauaaaauugacauuuuaaagucaaugugguuaaagcauuauggaacacauuuguugucuuuugauaacuuuuuguauuacucagaaaaugcaucccugcuucugaugacauuuucauuggaaagggcaaggcggagguggugggguggguggaauuuuauaagcgacugaauaaguuccuuugcacugcuggucccaggaaguuuuuuuuuuauuaguauuucagacucucuauccuuaucuaaggaagaagggagguuugcuuggagcuccuuaaauauaaugauaugagaccaagugcuucucuuccuggauguacuuucugcacagcuuucaucauugcgguuucucuuucuacaccuaaccggugcccccugucauucccugaagcuuguuucuuaguccuccaaucugcuuuggccacauccgucuaagagcugagucaccuacuacuccuugguacugacucccaaaucuuuucucuagccaugcccugacauuaggcgcuacuuuuccaauuacccgugacuugcgucugccagaauggacccuggcagcagcagcuuggucaucaccugggagacaagaugcagacucuuggguccuaucaagaccuacuugaaucagagucugcauuuuaacaagauccccaagcacucuguaugcacacugcagugugagaagcacuggucuaugggacaucugucuccccuccccucugcauuccuucuuucuuuucuugcuugcuuucauuuuuuaagagauagagucuugcuguguugcccaggcugggcucuaaugccugggcucaaacaguccucccaccuuggccuccagaguagcugggacuacaggugcacacuaccguagcuagcuacauucuacuuagacccucccccauuuuucucugucaaauuugucuauccuguuguauugcuauacgguauuguuguacugcaguacugcuauauagucuauguuauauagacuauaaaauuuagcuucauuuucuauuucauucuuccuuccauucauucggacauuuacuaacucuaccagaccuagguuuggagguacaaugagcaaaagcagaccuagccuuguggggcuucgcaucuagugggagaagcagauauuaaauacacaucaugaguucuaagugugaaaugaggguaagcacuagugagugaacucugucacacaaaucugugacugguuagggagaccagggaaggcuucccagaggaagugaugcuugugcugagcacugacgaugaacuggaguuaaucagaugaagaggagcagaaagagcuuugcaagcagaaggaauagccuaugcagaggcccagcucaucagagaaaguuuguggagaauuaauaaaaaaaaguuaacuuacucucaggcccuucaucuuuauuugcucuuccacccaacacugucagaguuauaucuucaccguucccugagccaauuugauuuguagaauuacuucacauauucuuuuuuuuuuuuuuuuuuuuuuugagacagaguuuuguucuuuuugcccagggagugcaauggcgagaucucagcucacugcagccuccgccuccuggguucaagugauucuccugccucagccucuggaguagcugggauuacuggcgcaugccaccgugcccagcuaauuuuguauguuuaguagagaugaaauuucaccauguuggccaggcuggucucgaacuccugaucucaggugauccgucugcuucagccucccaaagugcugggauuagaggugcaugccaccaugccuggcuaguuuuguauguuugguacagaugagguuucaucauguuggccagcugaucucgaacuccugaccucaggugacccgcccgcuucggccucccaaagugcugggauuacaggcgugaaccaccgugcccggcugcuucauguauucuuuguagaagccuagauccucccaccuacgugauauagucauguccucaguugcacaccuuuccagucuuuuugccuaccucuccaccauugaaaucaccgguuaaaccaguuuccuuacuguucccuaauaucauggucagauuuugaaugcccucuaauucucucuucauaaauauuauacucucuuuuucaaaaaaguaaacuuguuauuaaaacauacauauggaaaaguacacaaaucauaaauguagagcuugguaaauugucacaaagugaguacaccagugucauuagcacccacaucacgaaauagaauguuaaaagcaucucagaaaaugcaucucccccuuccccucacuacacacaaagguaaccauuauccuuucuucuaucagcauugauuaguuuugccuguuuguaaacuuuacauaaauggaaucaugcagcagauaaucuguugugucucauaucuuuugcucaauguuaaagcaauugauucacguuuugcauguaaugguaguucauuucuuucuuuugcuguauaguaguauaugguaugacuguaccacaguuuauccguuccacauuugauaaauggggucuuuuccagcuuaggauuauuaugaauauucuuuuuuguuguuguuauaaauuaugauuuuauuagauacauauuuugguccaaaucuuugaauugucgugacuuuaaaaaaaauuuuuuuuagcuuacaaguucugaguacaugugcagguuuguuauauagguaaauugagugucuuggagauuugguguacagauuauuuugucaaaugcgucauaagcauaguacccgaaagguaguuuugcaauccucacccuccucccacacuucacccucacguaggcccugguagcuauugcucccuucuuuguguccauauguucucaaaguuuagcucccacaagaugcugguacaugucuuuuagugagugaauauacauuuuucugcugggaaugugcccaugacugaaauuguucuaucacaauaaaugcauauguugagcuuuaguagauacuauucagcaguuuuccaucguacagugguugcacugaguuaugcuuucaccagcagcaugugagaguucugguugcuccacacccuccgugguuuugccagucuugaaucauagggguucucuggugggugugugguacuauugcuuuguggguuuaauuugcauuucuuugacagcuaauaugguugaguaccuguuuuuguuuucuuccuguuuucuaaggaguuuucuguuacuuccucucacuagguuagcaggagcacuccauauauucuuggcagauguauauauugcgacuaucuccucccacucuaucgguugccuuuuugcugcccuaaauggugucucucaaugaauagagguccuuaauuuuaauaucaguuuaucaaugagucuuuucacauuugaaaucauauuuauaccauguuuaguucuguaaaaccuuagagguagaacacaaauacauaaaauugugaaacauaaauaaaaauuuaaaagccugggaaauauaaauuagaagacucagaccagggaguuaauaagacaugcaaauaagccacguaauucugugaacguacaauuuagcaauacauauugcuuagagcaucuuagaagucaaaacucaauuggaaacaugaucugcuauguaguucucauuaucugugaguccgucagacaguaucgagaggaugggaucugacagguaucugcacucacaaguaacugacaauucgcauauuaaagcacuaacagguauauuuuauguuacagguuauucagcgauaguuaugaccucccgguuacgugcguuggguggaagaauuaauaauauacgcaccucggaguuacccaaagagaaaacucgaucagaagucauuugcagcauccacuuuuuagauggcgugguacagaccuuuaaaguuacuguaaguucucuacuuuuuuuuuuuacuuuuccugaauuaaugcuccuaacaaauaguuuucaucucuuggcucacaaaaugaagaaaaaaauauuuuaaaaugaaagcuugagaucucagaucuuguauguugagauugcacuggaaauacuuaaaaauguugccccaauuucaccucugcccugagggucuuccccccgcccuucuguguggugugaacuguuugacgcucagauguuggugcuucugggaaguccucauccacuuucugaaggagacugguuugggaaguggaugaggacuccacggaagcaccaacaucuggaggcaucauggcacccuauauaugcuucauuagagcccacgucagguugcauuuuuucaaguagugauuaggguauauguugcccaugaaacugagcuccuugaaaacaggaaagaauagaaaggguguuguuucccccgugccuggcacaaagcugggcacacagcaugugcucguuaaaugugugagugaguggguugugaaacaaucagccucacagauggcagggcuuggggagguucuggcucaucccacuuaaagcccguggcagagccagcacuagaaacgaggucuccagucucccaggccagcugcaggaagauacugggaccauggcugccuauggugcccacccaccccagucaccaccgagcccgugaccuuugcccaugaccucuuccauccucuggccaguccuaacaggaucagucccaacccugaacuggcugcuaggaucugccccaaccuguaaaguucagugugcaaggaaagacaucagaagagaagaugggaugagagaacaauugagggaacaauaaaaggccacaagaaugcaaagggugacaaaaacugaucccugggucuuccgcacaccccauacaaguuugcccacugccaaucccaggugaucauggaccuugauguaggcaggaggagaaggcaguuugcguggaguuuuagcacggugggugcuguaucuccuuuucagcaggcauggggcgguggcccagugccuuggcugcagacgucucccugucagugcagaagacucagguggacaaccaaagucauggaaguuugggcccuucgccuggcagagagugggaaugggcaguagagauggauguuucccagccuucugccccacucuuccacgagcacccaggccuccagcuauuccccagugucagggcaucauuuuuuuguaggugggaaacauuguuguaacaagugaaaacuccagcaaggaaauucaguugucuaguuaggugucuccaaagucuaauuagaggggcuacaacguauaccugugaccuguuucuucagaagccacuuuggaggaaaacauccucucaggaggacuguccaaaagaauauucugcaauucuggaaauauucugugucugcacuaacccauaggggagccccccagccgcauguggcaauuggacauuugaaauauaccugaauaacuaauuuuuuuuuuuuuuuccugaaacaaggucuuucucugucacccaggcuggagugcagugguguaaucccagcucacugcagccucaaccuccugggcuuaagcaauccucccacuucagccucccaagcagcugggacuacaggcacacaccacuacacccaucuaauuuuuuuauuuuuuuguagaaacgaggucucacuaacuuguccaggcuggucucaaauuccugagcucaggcgacccucccacuuuagcuuccugaagugcuggaauuguaaagcaugagcuaccaugccuggcuuaaauuuuguauuuuaucuuaauuaaaauggaagcagucuuuaguaguucauaguccccacuuuagauugcucagcuuugguaaacauuucuuaaagugugucagaagcuccuacgauguguguuaaagaugucaaucccuuguccugccuggguguuuugaaacuugcucucugugggguggggccugagaaucuguauuguaauggcuccccgaguugucucaaugugccgugcaguuagagaaccacugauuuaggggucuguuggcaagguuguaaauauuucccuuaaaaggcaacuaguuugguucuacagaaccuugucuuguaucugauuuccuuuuaacauaaucuuucauagaauuuugugauuacacaagcuccaugaaggucacagaugucucuuccagaugcuguacacuaauaguuuaguaugugucuggcuucuuuguuaaaauguguguuugucugucuuggagcuguucuuuaaccguuuauccucuuccugacgaaaacaugaauguuuguuaguauauaacucauguauucauucagcauauguuuacugagcacuuacuaugggcuaagcuuuguucuggguacaaaaaauggcaacagugcacaaaacagaacaaaaucccugcguuuuugaagcuaacaucccagcaggggagaugggccauaaaaaaauaugugcugagucgggcuuugcagaaaaauaaaguagagcaagagggagagagugccagggcaaggugagguuaccauuguauagacguaaccagagacguccccacugaugagaugaaagaaccaggcguucaucuggagggagcacaucccagggagaaggaacagcagugcaaaggcccugaggcuggagcccacuuccuuugguugcagaacacaguggagucuggaguggaaugagcaaggggggaggguagcagaagauaagcucagagagauaacagggguaaggggugggggaucgcauggagccuuguagaucauucugagggcacuggcuuuuuuuccuacaugagguggaaagcacuggggcucuguccacaguugacaauaggagggaaggggcugaaagacugguguggcaguccagggcggagaugaugaccauuggacaugguggcuguguggggcuggcuaagaggaaacugagcccagaaguacuuugaagguggagucaauaggguuugcugauagaugggauuuggaaugcgaaagaacaggaggccucaaggugaaucccagauuuuuggccugagcaaugcagcaaaauagaguugcaguuuauugagauggggaagacugugggaagaacaggucucaggguagaaguaaucaguucugcugugggcauauugugggggagaggccuguuauucaucuguguagcaguauaggaaugguacgagauagaagagucaggagguuaggggauggguccaggcuggggauacagauguggaugucaccaggauagagaugggauuucaagcuugaaacuggaggagauccccugagaagcaaguggauggaagcugcgaacggugcuuaaggguaggagaggugaggagcaggcacuaaaggagucugagaaggaccagccagggaggcgggaggaggccaagagcgaaugucugagaaucccagcaggaggaagagugaucagcucugugaaaaggggagaaagcaagcaccuaccccgagugagcaucauaucaagccuuacaacaggcugggugcagugguuaaugccuguauucucagcacuuugagaggccaaagcaggaggaucccuugagcccaggaguuugagguuacagugagcuaauuguaccacugcacuccagcaggggcaguggagcaagacccugucucuaaaaaaauaaaaaagucuuagagccuggcaaacagugagcacccagaaauucuuaguuaugaacgucauuguucuuaucacguggcugccaccccaagcuuccagcagccugguucaaagcugagucccauggaacuugagaaguuggagggccugguugcaacuuggaguaucccucacuuugugucuuucuauguguaggaauuguuugcacagucucauucagacucuuuagcccagcccaccuugugaccaggagcagaugucagggaagcugacuuggauaucagucguucuucucucagcccagggagcgagcccugguggugaccuggugccgugaagaugaccucuugagggcaggggccaggccaggaggccuuuucuuauuauaaauguguuuuuuguuauuacauuuuaauuucucuugagaacuggaugaauuaugcagaauagauaccuguauaugugaauuaugcacuucagaggaggagauguaguaggaacaaacagaccugagucaggcagucagacuguccuucugcugauggugcaaggcacggagccucucggugccucugcucguuggcaagggagauggugaugacuacuacacuuugcaaaguugcugcaaagauuagagaucauauauaaaaagcacauuggcauaaugucuggcuccuuguagauguucaguaaauuguaguuaauaauauauauuaaauguaauauaaaaucauacauaaauaauuccgacaaggggagcagcuagcuuuuugacaucugguaaugugcaauguguggucugggucauucuuuccccaccuauugugauucuuuucugauggauggugcccuggguagaaggagcaggagguacaagcgcuguugggcaggaaagggggcauguucaggaaaugggcguguuucauguucccacacuucagaccgaauaaucugaggcugccccaaagaagucucugcagguggggccugacaguuaucuaauucucccaaugcuggucacugugaccuauuuucaaguacauuauuugcucucaggcacucaaaaaaaggagcuaccuuugccuguucuauacacggucuauuucugacucauauuguccuuuaguuaaaugguuugguucaaaggauuccugcaaagucugccuguuaaaguagaauuugcaguuuuccaaacacuccaugcuguuugccaucccugggccuuugugccgggccaucugauccaaaggccuguuuuuagcucgugugccuggaggggaggggugaugcuuggcccuguccuccucccaaacccagaucaggggguugcuuccucuacggccccagucgagaugaccauuuguguggucccguuggguguccacugugccucgacuguuucacagcccucgacggccuuugacacucuguuacagccacugccuccauggcuggggcaggaaaagggagcuucuuauggccguguccccauucccacaccgugccugccccauaaacauggagcggggaaggcaauggaguccugaucugaagaggcgugugguugaacgugccccucagcuucucacuucagaugaugggaaggggaagcagggaggcagauaaucccacaggguggcacaggccacaucacucugaggguauuuugaauggcaguugaguauuuuuagcugucuuccuuuaggcuguuaggugagagcuuuccuuuccuggacaugcacuucgguggcuucuccaggaguaggagccacagguguguccugaggagccaacagaaaccacccugggguuagcauuucauuguggauaauccacuggaggccacagggaguucacugugauuaugagagcugaguuuuccgauuuagacauuaucacuugggaauugcagcuaagggggaaggaagaaaucuuagacaauuaaauuaaacucguauugucuuguguugaugucauuuuucuuagcccuacuucccauaugugcuguguggcuucuuaaaauuuauuaaagcuuuucuuguggugggaagugugugugcauagcauuucugaauauuuuaacucuuuuuugccuacaguaaagauguuuuuaccaccaauuaauuuaagacuuuucccacuugauaauuuccuuuguucuagaaacaagacacuggccagguucuucuggauauggugcacaaccaccugggugugacugaaaaggaauauuuugguuuacagcaugaugacgacuccguggacucuccuguaagugccauuuuuaaaaaaugugcugaacuccuucacgguuugcuuuuauauuuuauguuuucuuguccaacagagauggcuggaagcaagcaaagccaucaggaagcaguuaaaagguuggugugaucuuuucauuucagucgaacauuagguguuaguguaucacagccuguuucuccccuccaaucgucagugccugugacaucugguaccuguaguuccggguguccaggagucaugagugagccgacuucucccugucugacuucugagucagcagagaugcuuccagaucagcccucuaggauccgccccagcugugggaaagaaggggaagggugagaguaggcagcucagagcgagggaacccacauuucuguauucaaggaaggaaaaggaaggaggauggccuuacuuagcccgaugugagagccaggguggacaagagagacagggagauagacaaacacaaacaccucauacuuuccaacagcauagucgcguucacggaaaaccgaaccauaaguagguaaugucaccaauauaaaagauuaagucuuccaaacuaccgcuuaucucucaggagugaaucccagugcugcagcuaacucccaguucgguggccagucaggccacaccauaguccacccucugcccugaucugcucucggccugauguuccaacauugccagcauuguuccccuuuaugccacucaugccccagaccaaccuggcugaucugcagggccucccagugccuccccucagucuguuccaucugcugggaaugcuuuucccucccacuucccucugucgaaauccugccuuuuuucaaggcugcucagaucucauuuccucuccuagaaacuguggguggcucccucgacauucucuuagauuuaccaucacccguguugggguucugaaugcucuuguccucaucuguguuaguugccuuuaguucccucucagaacugcaaguuccuugagguuaggacccuuguuauauuucucucugcauccccaaggugcccaacacacacaaaaaguggccagugcauggcggaguggagaagggcaaguggauuugcgcacgcaggugcgcauacacaggaugccccccaacacacacacgcacaccugccucagcacccaggcaggaagaaguagacacaguggccuucgcucccgucucacugcugcccccacagggagcccgauucucaaaguucuucccucccaugagcugcauccucugcguucagaaguaccugugggagccucagggccacuugcagacaaauaccugccucauccaaguccccaggaaugaguccacacaaggcaugaauagguguugucauucauucucucauuaacuccugcuuucggugaacguauccugagcucagacuguggcaaggugcugggcuaagcccugggaauccaguccagaucaaauuuggacucuccccucaaggagcccacagccaagugugcagacagcccagaggguucgacauucuaugauaauaguaagcacacgauaggggacagccagaaagaaaaagaggcuaugccugcagcgcagagaugaaaaguuuuagaagagggggaggggaggugaacaagcaucccaaggcagcaggaggacauuguucuccccugaugugcagauugucauagcgccauccgcugguaccuagacauguggacagguguacucaggggcacacccccguuagggauucuuugaacacacgcugcagaugaagaaagaaagcacuaaagagcagggaggguagagcucaggaugaucucagguagaggaggagaucuagcaggcuagugagaaggacuugaguugcagagagcaagaaagugcucagugccuagauagggcuggcgaauauuuacugagggaugauggugaaauugacaugaagaucuugggaucuuagcagcacaaucugaucuucuccuguugccgucucugugagaagaaauggacuaauuuuauccacacaagcaaauugacucuagauguugaugcauaaagccguauuugaauauguucauugugugauuuacuaguauacuaacuuaauauacuuuacauuaaaagcaugagauauuuucuaguuuaaaaaugauuuugaaaugugguauagcagaaucaaagaucucauuacucuaauucugguuuugucaccagcugugugaccuaaggcaagucaccucuaauuggcuuaucuguaaaauggggcuaccaguagcagcguagcccacucauagucauggugguguugaaaugcaggaauguacaugaaaaugcuugaaacuuauaaauggcuacacaaacgcaggcuauuauuucuuuguauauuuugcauaauaaugccgauuuaaggauuuuuuaaauuccuaauacagaugacggagugcaauguuuaaacacagcccuaagauaaacgugugcuaggaaguagaugauaacucagucugugcugauguugcauaaauguuuuacuuuuugaagacuuggagauuucugaaacaacuaacuuauguacuccauguuugaaauuagcccuuuuauaauggaaaaagcuaugguugagugaaaaaaugcaucacuuauggaagagaagcaacuuacauacauugacuuugucaaagggaaaauuuaauuuguuuuugaaaaauguuguaggagguuuccccuguacccugcauuuucgaguaagauuuuuuauaccugaucccaacacacugcagcaagaacaaaccagguaacaacauuuuuuuaaaguuuucuguuuaguguauaaaaaugaguaaccacuaaaaauguacucuucauuuuauuacuauggccaaauaacuucauuuggguguaacuacaccaacaaugaugauccaaguaaaaaucuggggugcacauacugacauuuuaaucaccuaaugaguuuucagucuugggccugcuucucuuaucuccugauuugcugccauucccagcauacucccaucugccaccuccuaccucucccaccuccuuccaccucccuggccucuccugccugcugaacacacugugcucaaaggacaaaaagucauuuucuaccaauguaggcaggauguagaagacaaauuuguaaaauagucauccacaggucaaauagcaugaugucucugaagagcuaaaaucaaggcucuugaagauaacaagacaucucuuguuauaagaauuuucuuucuuuuuuuuuguuuugagacggagucucucucuucacccuggcuggagcgcagaggugcgagcuuggcucacugcaaccuccgccucccagguucaagcgauccucccaccucagccucccgaguagcuaggauuacaggcagguaccaccaugccuggcuaauuuuuuuuuuuuuuuuuuuuaacggagaugggguuuccaugucguccaggcuggucucaaacuccugaccucaagugaucugccugccucagccucccaaggugcugggauuauaggcaugagucaccaggccagcuuuguuauaagaauuuucuaucagauccccaguuugcaagaguuagaaaggagagcaggcuggauucagcuugucuucucagugaaucagcaaguacaggaaauaugugaaccagauaagggaaagagggcugugauaggaguuguuuaccccucagggcuuggagucucucccaacccugggcugguacugggguuuuucuaggugugagggacagaguaauuggaauggaguaggagaguguagcacaagaaaguuguugcuguuuuaacacagacugcacaaacaaacuuucccuccccuguggcaacguuaagcccuuuuauuauugauccauuuauuuuucuuagggagggaagcuauagaaaaaaagcaauagaugcuuaguauugaauccuguuuuacauucaucguggccaaaagacauaaucaaggaggcagcauuaacucagacacagaguguugccuuguuaauuuuuuuuagcaguaauuacaucacauuuuaacuuguaauauguugaaaggccaaauauuaaucuguuacuguauuuugccuucuuugugcaccuccucccucuacuauagcagacacugggaauuugacuguauuuuuuauuacuuuuuaagccaauguccaaggugucugguaugacacauccggugaccacacagaagcaugcccuguccucugaguuuuccccauaccagcucuuuaugcugguaaacuggggauaggauagaaacacucagcccagcagguuacuucauaagcugacggacacagagcuggugaugaaaucuauaagaauguguuugaaaugacccuaccaagguuuccucaggccaguacuaaauaacacacucugggccaggcaugguggcucauacuugugagcuucccagcacuucaggaacccaaggcgggagggucacuugaggccaggaguuugaaaccagccugggccacauagcaagacccugccucuacaaaaauaaaaauaaaaaaguagucaggugugguggugcaugugucagcaucucaggaggcuaacuaggaggaucacuugagcccagaaguucaaggcugcagugagccaugaucaagccauguacuccagccuaagugaucgacugagacccuguugcagaaaaaaaaaaaaggcucuguugaagggaugucuuaaaaacaacauaauauguguguguuuacauguauaugugucuuuuauauauauuauauauaaugugugugauuauguauguauguacauguguacgugugugugguucuaaccaguggguuuuuuaaaaaucacaacuccaaaguaaaaauauauuuuguuucagaauacaguacacauauauaaauuacugaagcaaacguuuuauaaaacuauaguaaguaccagguacucugaaguuuucuauucuguuuuauuuccuuuuuuuuuuuuuuuuuuuuugagacggagcucgcucugucacccaggcuggagugcaguggcgcgcucucagcucacuguaaccucggccucccggguucaagcgauucuccugccucagccuccugaguagcuaggacuacaggcgugugccaucaagcccagcuaauuuuuguaucuuuaggagaggugggguuucaccauguuggccaggauggucucgaucucuugaccuugugaucugcccgccucggccucccaaagugcugggauuacaggcaugagccucugugcccggccuuacuuccuuuuuuuaaaaacuugccaacugugacgcauuaaauugauuguacaaccaacugggagguuccaaccccaagucuggacggcacugccuaaacuagugauugucaccugccuccugccuucccauaacacuagagccccagguuuguggcauccacugggcacauuagagcccuccaguggccaaacuugagggagagguuuccuacggccagugcaaccuaggaguuugucuccagggcccauccuggccauuggccauccacuuccauacgcuguggaagagaagcccacuucucugggagcugacaaaaucuuccugcugagccuuccugucauuugagggacaucuguggaaauguagggcauucaugauggagagaagccucgggcacaaaugaaggcugccuucagguguccgaagaguagucaugggaaaaggggaacuagaugugcagggucguagaauuguggccaguggguggaggcuacagggaggcagauuuuagcacagaaugaguaauaaacagugugugucugucucuucuaaaauucacugguugacaacugacaccccacccccaccuuccaucuuaagaagggugguaucccguuguggaguagaauguaacuaugaccuucugggauuugggcaccagauuuaucuuacugcaacaggagccauggugggagccacccccauaacucuuauagagcuggugggccaccaggacugccagauauauauauauauuuuuugaaacagggucuugcuauguugcccagacuggccucaaacuccuggacucaaaggauccucccucagccuccugaguagcugggauuauaggcacauaccaccacgacuagcugccagaucaucuuaucuuggaccaggcuucuaccauuaauucacaugcuuuaaaaaaauuaaaaauuaaaaaaaugaaaaauaaaaaaacuuaaaagauuuuaccuauauuccuggaacauaguuaucuuaccccagcuuuguaguuccuguuuaaggaaauucccucugaaggaaauuuuagcucucaagagucaaagaagauguauagaggugguaucuguuaguuuuuguuuguuuguuaaggaucuaggcagagaggucauuacauuuuucugaaguugaggucacaggugggguacccacaagagaggucauuacauuucugaaguuaggcaucccaggcaucucuucuaaagaacuauccuguauucuaauuguuaaauaaauaucuucuucauugugagccuccacaacugcuguuucugauaaauuuagaucauucuuugcagaauuuuauauacuggcaaucucaaaacuaggcuccuucaagauuccuaggaagucucccaagcucggguuggguuccacuauucuaguuucuuuguguaugaugccaugggguugacucagaaacuuugcucaauauaugacaaggcagcauuuggugaguggugaucuccacguuuaucuucucauuuauaucccuaggaagacauacugauuagcugagcuugucaaugaaagcccggguucaccauuggauuaucuauaacucuccuuucucuuuuuuucucucaguagcauuguaggaggagagaacacuuaauucugguugaaugucagcuuggauaaacauagaaacaaacuagaaagaacugaugauguucuccuagguggaaaagauggagauuccaauaccaaauaggugugaaucagcaaauguauguuauacugucucucaaggccagguguucaauacauuguggguaguuaauuauaaucaaaguaauaauauuagaguuacgacauggauccuaagcuuuuuagccauuaaacauauaagaaauuuguagcauagugaguuuuuuuauaacaugaucauccagguuaaaauaagacacaauugaccucacauauccuaucugagcuccgauuuugucaucuguaaaaauggagauagugguaccuaccuuacagaguuaugaggcugagauaagagggaaaguuacaaaguaguaccauguacaaagcccggaacugugcaaauaggagguuguaauacuguuugaagcauucccaucucaaaaagccaguuccuuggccuuuauaaauuugaaggaauaaugaaacugauuuguuucaauugugaaaauuauuucucuccugccccugugcacuucugcccugucuauauuagauuucaagagguuucccuuuugucaucuuggccagacaauggaaugucuaucccguuugaaucuggguuuaaaaaagcaugggagcuaguggccaagugucacauguaugccgcaucccuaaauagaagucuccccagggcgcuuccugaccugcgcaaugcugccgaaggccuccuuuccccgcuccccaggcagaggagcaaagucacaggcugaggggccugccacgacuugcccacaaaacaggucuggaguuuggaaguuacauuugcugguugcccagagaugagugcagaauucagcuuggagguccuggaaacuucuaguuuacugauguuuaugcuuuugcucaugcacccacaguuccugggacacagaaugcucaccuggggguuuguaccccagccaagaaggugucuucacagacuccccuccuuuuagcaacuucaugcagauggagcuuggguggauggauccuggcacaguguucagaacaguggcccugccagugugugggcgccgcuugugcagagccccuguggguucugguccucaagggcaggggcgcucacugacagcggaacccauaguaccagcccaucuuuggugggcuguuuccaccccauucaucccugcucagcucuucauaggacagccugugcuggcagaaaauugcccccaccagucaagacguagggcaucaacaugagccaucaguaaugacagggcagcuuugcagagcguaagguagcaccugauaccuuggaccaaaaccguauuuuuauguaucuuucacauguacagcucuugucuuugacucaucaaacuuucuuuuuuuuuuuuuuuugcuuauuucaguuugaguaugaauuaaugaaaacaauuguuucauaggcacuuguauuucuuacaacugaagauggauauuugcgaaggaagguaaugagaauuuuacauuuuucuuuuccuguuagacuagcaaaauuccugguuuuaaucuaaugaguguuuauuucugguaacaauaucaaaucuaaacagaguggaugugcaaagcauccuguacagcauuaggcuuuggacaucuguuuuuauuauaccucagucuuggcugagagaggcuaaggauugauaacuuuguuucauguuauuucaguuuuauuacaaaggaugcagcuaucuuucugguaaagaccugagaaauuuuaaagggaggaggggacccagaauguacaaugggcuucauucaggaaggcagaucaggccuaauuuggguccacuuuugagccccuuaguacccacggaugacucauuuucucucugggaggcuuuuugcucauuugccugugauucagugcuucuuguguuaccaagaccaucucaguagcuagaagggagaggaaauuccaagccgauggucccugagcuaccuccuuuucuugacuuagggaagaaacugcagcagguaaacuggugggaagagcacagcuuauucccagucucuucaccgcacccccaaccccugugaguuuagcccuggagaggagggucuucagagguuaccagcgugcuguaccaugagggagcuggagucucacuggggaaaugagacaguaucccaugaagcaauuaggaaacaauuagaaccaauaugggcaguagagacaacaguugucauaagacuugaggagcuccugcuggugugagcuagaaaagucuuuauagauugcuaggaugagccagaauuggguuggguagagaagugaggagguggauuucccugggcagugagaagacaccccacccccgacagucccacuuggaaaccacaugcugagagcuuacaggagaauagagagggcuguucguguccuacguaggcgggcaucuuacaucuagcaggcagaagagaacuguugaagguuuuuaagcaggaaggauguggcaagagccauauccacaaagauaguaucauugugcacaagggaagacuggcagaggccaggggcgguucagucuggauggaagggaauggacagccuucaaggaagcuauuguagcauccaggccagagaccugggggcauggcagugaaguuuguggagagaggagguggauaguuagaagcaagagacaccuugaggaaaggauuuccagagcuguugacuauugagcacucauagaauuauagaauucucaucacuuagcucauccugccauucaagguaggaaugagucacuuccccagcacaaucuacaggucuucaggcuucugcuugaucacccccagugagggggagcucacccuuucaugaggcagcauuuuuacauuuuaggguaacucaagguugaaauuaccgaccccucuccuggguccaggcuguccuuagcagcugcagaaacccauucuuuccuucucuucugcacacuuagucuuuuccacagauaguuugcagucaccuuuuuaugagacaggcaccgaacuacgcuggucaaauaaggccagggccuugccuccucaggaacuucuagucuaauucuccaaauaauggguugucuucaguuuuucuucuccaaacaaaaugccccuuguuauuuccaugugaaucagggcaaaucuguuaaggccacauccuggcuuagaucuguggcccuugucaaguccucaccaccucucugaggagagggucucugcuaccaaacgcuucucagauguggauuuguguauuuguaacugugggucuuuugacaggcccaguggaacauauggagcacuuuuccuaggugucaaauugucccgacuuguuugagccguccaugguagccggcacucaaggugucaucuccuucuuuccaagaugguugaucucauccaagcccuucacucagcaggugaagacccugaagcccaaggugaaagaaagggauguguuuaggaacaugcggccaaguugagagcagaacagaggcuucugguguucccuaguauguauuuggaacaguuuuuggaauguuuuucuuucugguuucuucauaggauuguuucuuccaucuagagggaaccuccucagccucuuuucuaaguuguuccccaaaucccauucaccuccucuuucuccagcaaggacacuggcguagauuuaaucaaaccccaucuuguuaggagagcaaauagcugauacucauccuguuucugccuauccuccccacgagcucucuagauuuccagaugaacaaacagaggugagaucccuggaccucaucuguaaccuuggggagauuauuugcaagucccagcaggaacacagcaucacuugaggaacaaugggggccccucagauagggaaagucgacuucauaugcagcugcagaaccagcacacagugcaguggacaggaagcggaaccccuggagggccgcauugucagaaaggcggagugguucacaucuuggguacuucacgggcugccauagaaacuguguuccccacuucccacuggggugcugggaagaauuuuuaaagucccaguggcucccaguguugcuguuaaggauuccuccguuuaucagagaccuccccacccuucaagcccuucuuccugcccuccccuaaccuguucugcccagcagugaccccugcuccaggucugcuggugagcuccugggcaggccguggagucugcaguugaaugcagaaaagaaaagggagcaaucagaggauucaaaaugugccuaagacagagguggagucauuggcagaaacagggcaccugggaaagcagugaguuuaagaggaaaggagaacaaggccaacccaaguccaugauuacuagugaauggcacgaagacugagagacagaucacugaacucuguagaucuucaggagggcaaauagauaaaggaauccuaagucaucguaauuaguuaauuuaauuaaggaauugcagguuuuaaaauugaaaauaccuuucuacuugucccuccuaagaggauguuacuauuuuagaaagaggguaaucuagaaccaaagggucauuagaacucaggaauuuaguuagagagcccuaugaugagucucaggucuuuacuagaaagauuuaaaggcugcccauugaucucagaguacaauuuuuuuacuuuuuuuuccccucuuagagauaagagccugacccuucuugagcagccaaaacacuggccagcauuaguccuuuaguuucaugguauuugugauggauauuauuuuaaacaugaaaagguuuuauuuuuaaaaaauuuuaguguauuacauuugccuuuacuguuuaugugcagcauaaaguugcuuuuguuacaauucauguuguuuuguaaugguugaucaaagcaaagaaagacauguguuacuacgcaugaucugucaauguuuaaggcuguuguugguucuugugacuuugcuaauauguuuuucuccugacagguuaaccugcccucuuaacucagcagugguucuagcguccuaugccguacaauguaagucacaaagggagcauuucacggauggacagguuguucugaucaguguguggagaaagucacugguuccuccugcuugaccaagucccucuuccccaggaauccugcugggcagcauaucucuggcuguccagauauguguuucuacucagacuggcacucuccuguagcauggggauguuagauuaaggaaggugguuaaggggaaaggaaugaaugaacuguggugugaaauuuucuccaagggagcccaucagacagcagacagcuguugcacauugcauuuuccagaaacuuugcucaggcauuugaucugaucuucauacaaaucccagugggacaaauauuuguaucagucaucccuuauacacauggaaaccuagacccagcuagguuaagaaauuugcuaggagucaccccugcugcuugguuggugcuacucuaaaacacuacugggaucuuaggaauuucuuuucagaguugcaguauagcuaauggauuguauauugaucuauaccagugcuauucaauagaaauauaaugugaaucauauauguaacuuaaguuuucuaguacacucauuaaaaaagguaaaacgaaacaggagguuuuuuauguuuuauuuaaugcaauauauugaaaauauuagcauuuuaacuuaauguacaaaguuauuagcaagauauuuuacauuuuuuuuauacuaagucuuugaaaaucagucuggauuuuacacugacgguacaucucaauuuggacuaaccgcacgucgcuaguggcuaccauauuggauagaaaguccagauggaauuuucuugaaggcugguuuaaacuggaguaggaauccgcucauucaaucagcaaaacuuuaucgaggguauauucccuuccaaguccuguggguagaugcuggguaggcacaaugaaaagaacguauagccagaugagagcaaaaugucacuuuauaguagcuagcuuugugguggcaguacaguucaucagcauaguacucagguagagccauuugcagcuccagaccuaagaaaucuccucuaccagaagcccaaaccaucuuggccuauuacccuguugaccuacugugugauagauagauaaggcagcaagaugaucaggucugagagcaggcacuggcugaacuacacacccugcucuggucucagaacaggcaaaauagcaagagaaggcugacggacuccugagguggcccuaggucugccuauuucccuaccaggaaagaacagaaaugaaggaggugaagagcaagguggcugggccugcagcuuacccacccaccugcauggaaccaggagguggagggcaggggacaucaaagaugacccuauucacgaguaagacgaguaccagaguuagucucuccaucgauaccugcaucgccuccuccuuagugggaaacucaaaacaggcgaaugggccuggguggauuugaaccuucccuucucccuacaauauaccugggacaggcccggccauuucacauccauaugggaaguggcauggucaccaguuuguauucuuaugaucuguagaccuugugaacucugugucugccaggccaaucagcugaggagacugagccuccccaugucucagagcaaguuugguguucacagccugagcuucagguuuaugaggcaggaacacuaacuagaauauaggcauauucaauuuaaauccuggcaucccuggccaggugugguggcucacgcauguaaucccaguauuuugggaggcugagacgggaggaucccuugaaccccagagucugagaccagccuggguauuauaguaggacccugucucuacaaaaacugaagaauuaucugggcaugguggugugcaucuguaguccuaguacuuucuaaggcugaggcaggaggaucacuugaucccaggaggucgagacuggcaugggcaacacuaugaagccccaucucuacaaaaaauagaaaaauuagcugggugugguggugcggugccuguagucccagcuacuagggagacugaggggguaguaucuguugagccccagagguugaggcugcagugagccauaaucaugccauugcacuccagccuuugugacagagugauacccugucucaaaaaaaaaaaaaaaaaaucugaugucuccgguggccaguuaugugggauugccucuccuaaucuugguuuucucaccuguaaaacugaggugagugauuuaagacagcucucaauauggcuaccuugguucaaauuaagcaauaaugugaaggugaucuguaacuaaaaauucuuuauuguuggaccaucccuggcugagucauugagaacuggacuggagccauauaccuaggucuugccuuuuccacuuguaccugcccgacuuugagcuucuccagaccucaguuucauuaccugacccaugaggauaauaagugucuccuucaaggguuguagugaagaugaaaugagugacuguauguaaaacuauuagaauagugcauggcacgugucaaguguuagcucuuacuguauuuucaugucugcccagaagaaagcugucagggaauugccuguuguaaacaguaaauucuauuuagaguaaaauuuaaaaagcaaauaaagaauucuaucgcaggcuucaguagucagguucccuucugcaaagaacugauagaaugggggcuaaagaaguugugggcaccuaaaaaguacaaacuggcuucaguagaaauagucacauuacugucaugcuaauagaaucauggcuuaucaggcaagcaguuuuaaguauaagcuuuuaucccuccacccucaauaaauauauauauugcagagcauacauuucuuuaagauuaauacuugugccaggcacggugguucacgccuguauucucagcgcuuugggaggcugaggcaggcggauugcgugagcccaggaguuugagaccagccugggcaacauggugaaacccugucucuacaaaauauacaaaaauuagccagguguggugguacaccccuguaguucaaguuacuggggaggcugaggugagaggauuauuugagcccuggaggucaaggcugcagugagccauaauugcaccacugugcuccagccugggcaacagagugagacucugucucaaaaaaaaaauuaauuauuguauaugaaauuacuggaucaaaagguacaccuacauuuuaugauauauuuugcuaaauucuuccaagaggggcaucugauauaaguccucacugugaccagcuaaccaaaagcacauuuucuuauuacauaaaaaauaaaguccggcauagugguuugcaccuguaaucccagcuacuugagaugcugagguggaaggauugcuugaccccaggaauuagagacugcagugagccaugaucaugccacugcacaccagccugagcaacagagcaaccccaucucuuaaaaaaaaaaaagugaucuucagguaaaguacccaaaaauauacaaugauggaaaauuguuaauggccugccaaggcuuuaugaggcucaaagaauaaaguauauuuuuuggaauauauguuuauuccagaauguucccugcaccugugccacauagaggucuguaccagccucagggugcacagauggauaaaacacacugcucuccccaaggagucuacagccuguagggaggcagauguggaugauacuagcaguggagauggccaccaggggugcacuucauccugcuuagggagaggggagagcaucugggaaaacguccuaggaaugaccccugagaaccgccucuaagaucagguuggaguugaaugaauagcagguaaaagucuuuccaaguacaacagccgggcagcuugaaaugcuguacuuuggaaccugggauauacccucucuuugcugcaaaacauaaaauauuaucaaccagaagaaagcauggaacuuaaaaugacaagguauuucccacauaagcacuuccuuuuuuguuugcuauaauuagcuuuugcauguguugcuuucucacagauaggaaaauggauuacuuaggaguuuggagcauauaguauaguaaguagguaagagcagggacuauggucagagucuagccuccaaauuagcagcugagcaacaguggcagaccccuuugggucuguuuccuuauguguuuaguggggauaaaaagcauugccuauaucacaggguuaccaugaguaacaagugggaugacaucauugaaaucgaugugaaaccgcccaguguuuugcaaauguuuaucacuguuuaacuuuguuucccccuagugguuagcacagagcuuugcacagaguggccgcuuaggauuuaaagggaaaaccaccccacagggaggcucauugguuguguucgaagcucagaacauuugucagcaacuugccuaaagagagaaccuugcuguucauguuugcagaaugauaccagggaugggacuguuaacugguaugauggauaaccuuauugggauccaggaggaucuccaugagcuaaugaaaccaacagaguaaagguucauaggacuccaccuugaggaucaggaaaagucauuuacagcauuugguuggccuuuggggacaugauugcugccaucaaauggccagcagcggcucacaggccuggcaggcaggcugguggggugguaggagcacuaacugggguucagaucaccuggguucugaucuugacccugucccaaaggugucuuuuccuuuccagaccgcaauuucuucacucuuaacaugagagcuuugaaggaagugauucuaaugcuuucuagcaauuuccucauugggcaugcugugucagggcauuuaaaugauuuccugugaacgcaccaugugcgcuuaacccugcacaaacucaccagccacauagccuugacauuucuuuccacagcuuggccacauuuggcuggccuuaacagccucuggucuaaccuugaccaagucugcaugcauuggucacuuggcucucugcccuuuuccccuuccagaacugaaauuugcaucagccucuguacagaucaguucugagcacccaaauuucugagcaccuacugugugucaugccuggugcugggggcccuaaaggugagucugacccacucccagcacuugaggcacaguguaggaaggaaacagaucccuucguuaugguguggaucucaaaagagcagcccuguguugugagggcaguuaggugaacaaggcugaaugaaacauaaccuuugcaucuucccuuuuuuuuuuuuucuuuuuugagacagagucuggcugugucacccaggcuggaguacaguggcucagucucgguucacugcaaccucugccuuccagguucaagcgauucucaugccucagccucccaaguagcugggauuacaggcaugcaccaucauaccuggcuaauuuuuguauuuauacuagagaugggguuucaccauguuggcuaggcuggucucaaaccucugaccgcaggugauccacccgccuuggccucccaaagugcugggauuacaggcgugagcuaccaugcccggcugcauugcccuuucaacuucauggugaaauucacccaagcagcuaccugucucacccacuucccuucugagauuggccacaaaguaucaccauaucuuucccauacucugcccuuguaacagagaaggaguuauuugauuuggaaaucuuugguguugaauugagaguccucaggaggcuccuggcauugcagcgagcuacaggaagaaauucauuaaaauauuuggaaagaucaggacuaauuuuuuuuuuaaagaugaaguagaagcuuuuuuuuguuuuguuugucaagaaaauggaauacgagaucgguugccccauuagagguagagauuaucuccucaauucuguuuuuagacaaaugggaaaacuuguggagaagggaaauggauguccucaggucccauaagccugguccuuugcucuucaccuggugccauccuuuuucccaguuuccucaaugguccagacacccaaaugguuugaguccuugaggcagccauggacacuuguacagguugagcacugcacaacucucaagaaugcccaucacaucauaggcaucaacaauucaauucacauuggcagacaacagucaagggucucaagggagcaguaccauuuugcccaggggcuagucuggaagucacccuuccuuuucccucugcaccugcaggucccuaaugugauuccccugauagccccagaaucucucuucauaucuucugacuccccuuagaaugugucuuucucccuaggaacuuugcuguugccugagcccugaccauucagccccacucccacccaccuuuugucccuguggccucugagcacauccugguccccuuucuuccacaccucccugaaucccaggggaugggucaggauguggagaguggucaggucggcauggccucccuucugccuacacccaguuuuuagagcagauugguccaguguuaugguaaccuugggguauggcagagaaagccugcaccguguguggcauauggauuguggcauuucccccaguggguucucuuuauccaguggcaugagugcaaacugcugugcugaccacaguguauggaagaggugugggauuagaacagggccuagguucaaacaccgucuccuaauuuucucccucuguguccuuggggagaaugagaauuugauuggaucaugugugauaguaucuuagccuauagugaaggcucagauaaguguggaaucuggagcuagugagaagcuucaguucaugugguguagaacuuaccagaagaguauuucuaauuaauguuauucugaugaugcuguagaugcuuauaaaugcaaaccauauuaaaaaggcaaaacuaauuaugauuuuccccuucuucugucuugauagcucauuuuggagacuauaauucuuccauacaucauccaggcuaucuuuccgauagucacuuuauacccgaucaaaaugaggacuuuuuaacaaaagucgaaucucugcaugagcagcacaggugaggggggcugggguggccuacuuuggggacuuggguuggguauuuucagacaucauaucccuuuguguuugaugcagccucuuucuuuugugcaugaauccucuuucaagaugucggggguuuuugaaccuuugagcugguaugguggcagauauauuuggcauaacuagcauuucuguaaaguguaaaauccaguaagaguuuagggugauagcugcugcguccuuuucaggaugucauugaaaucaguaaauuccugaaggaaaugcccauuuugaaaucugauugccccaccaauggacuguaccaagguaaaccucuuagcaguuuaccacauuuaauaaaacaagcuguuccuucaggucuuguuaaacagacagacagauggacguacagugcugaccagucuccuguguucaguucaugaaaagugcccuauguccaaguggggagcaugagucuucugcaguugccccugcguauuuguugcgagccucagcuccaacacauaugcccaauucuggcugcucuuccccuuccuuguuuuacuuaaagcuacagcagcagcugugcaguccaggucaaauaaaggccacccugaccaagaaggccagcucucaaggggcugcucucuucuugggaaagccauaaaaacaaaggccaggcaaccaaguguccuuucuaagaaggcauugccaaaccucucucccagaauuacucccagggcagaagucaaucuccuaaaauaguacggggccaguggcguuugaaaguuugaggccacugccaaaagaagagauaaaggcagagagaccuaaagauucccuacuaauuagcaacuuggaauaauuagggcagggauucugaaagguaacagucuucuccgucugaauauugugagcccacuaaaggggaaguauuauuuaauuuaaaaacaagagggucuagagggagucacauucaauggauaagaauaaaaacuugcuuuaguagaauuuagcauuagauugcugaagauugauaacauaaggcauuuaauaaccuuacagaaaugguaucaaauguucuagauuuuuuaaaauuggaguuaaugcccucucuuuauuggaugaacucugcuuuuugucuuuucuuccguagugggcuaaaacaaucagaagcagaauccugcuauaucaacauagcgcggacccucgacuucuauggaguagaacugcacagugguaggguauguauucuuguuaugucuuggcucaaacauuauguuuuuauuuuaaucucugagaguuugaaaaauucuuugaugaaacuauuucuuuuucauuauaacaggacuuuuuaaaagauauuuggaagguuuauuaaguaaugcugaauuuuuuguuggucauuuguccaauugcuuuuuuuuaauguuugcuuuuguacuugaagacuuuucccuuuugaaggguuaggggacuagaaacuaguaauuuuuguaagaccauuuuauauuaugguuuuaaaaggcaaaaaauagguauaaauucauuuuucaggugacgguuuaaggagccaagauuucuacuacuuaaucucaaguguugcucaaauuggagauaguuacucauauaugauaguuuuuuuaaaaagauuauggugauauaauuguuaaaaucaauaaauauuugaaauuaguuguggcuacuuuaguaggauuuacuaacaucugucaucugucaagcaauuucuaugcaccaguggauuauuuccugcgguaauaccaugaguuccauauguuaucauuaaccccauuuuacagauggagaaacugauacucagggacauaaccgaggucacacagcacacaaguuguagcuucagcacaugaccccucacugucuaauuagcaucugaccuuugaucaguggcauacguuuucuaccugugauugguccacaucauauccaaaaggaagcaaaaauuaauugagcaccuacuauauacuagccuuuauccagaugcuuucauaugagaccauaaggucucaccuugugaucauagaaaccuugugaaaucgacauucuaguuauucccguuuuauagaugagaaaaccgaggcucauagagauugaguaaaugaucagauuuuaaaucuauguauuuucauaguuuauagaaacacuuucauuuauuuuuguuucacuucggucccuugacaguccugugagguaggcaaguugugauauaggaaauaaggaaggaaaaugguguuagaucuuacaaaauaucagcuuugggacuugaccauucauuuuuauuccauuugcaaauaauauuuuaucuuagauagaauguuucagagaacuuuaauugucggugaaguagggcuuuauaucugccugaguugagcugugcugucccaccccaagaacugucagugaaaugacccucaagggcugugaggccagaugauaucugcguggcaaagacccccacaguaucagaggggguuggucauacuaggcuguucuacgugaacuaaaaaccccuaaaucuccauagcuucauaucauaagguuuaucuuucaguaauucaaagcuugcauugagucuaggagucuuccagggcagcccuccaccccauccaucgcaauaacucagcagucgaggcugcuuccaugucauggccaucuuuccaugugaccuccauguuugucacaagggaacaggaagcugcaggguuacacaccagcucuuaaaugcuucagcccaaaagagacauacauuccuccugcucagagcacaguggccagaacuagucaccgaguucugcccucugcaaggggagcugggaaaugugggguugggccugggaauugaauagacaguaacuuccuaugcugcagggguugaggugcauacugaaagaccacaggauuaggagauuugagaccuggucuuuggcccacccaaaccauucauuuguuuccuuguucacucaauuuugauuuccuuugcuaauuugcucugucacaccugcuucauacucccucuguugugaucucaaguaucauauuuaaaugcaauucuacccuucaucaagcaaauuugguuuuguuauaagcaugugauuucuguuggguacugauagugaauacugccuggacuuuccacaguaucagcacuguuuuguuugucccguuucucuaacuccauguucacauugugguucacaaaggguuugucccacggcaaaggggaauggacguuucuuaugucuuccacgugccaaacucucuucuagaagcuccauaugccaagcccccuucuagguuuucaucucucauuucagccagauaaaaacgcuucgagguggguucugucaucuuuauuguacaagaagaaaaauugagccucaggagcccaacauuauauagcuaguaggugccagacugaagguucacacucaguugugacugacucaaaccaugcccccucuuuauaauuacuaguaucugggucaagcauaguggcucacgccuuuaaccccagcacuuugggaggccgaggcaggaggaucccuuaagcccaggaguucaagaccagccuaggcaacauagugugaccccaucucuacaaaaauaugaaaaauuagcugggcgugguggcacaugccuguagucccagcuacuugggaacugaggcuguaggaucacuugagcccaggagguugaggcugcagugagccacgugugcaccacugcacuccagccuaggcaacauagugugaccccaucucuacaaaaauaugaaaaauuagcugggcgugguggcacaugccuguagucccagcuacuugggaacugaggcuguaggaucacuugagcccaggagguugaggcugcagugagccacgugugcaccacugcacuccagccugggcaucaaagcaagacccugucucucagagaaaaaccaaacacacaaaaaccaaguaucugauugggaaaacaagaagguaaaugacucaagaggaggaacuauuuuauuuuuaaauuuuauuuguacucaccuuguucucaaacuuguagcggcugugucuucuguauccucacuguccacagcaaugcccagcacuuaggcaugcauaaauguuggauacacuggauuuagaagcaacgcuuuuuuuuuuuuuuuuuuuuuuuuuuuaaacagagucucccucugcugccuaggcuggagcaugguggcacaaucacggcucacugcagccucaaacagccucaacuucccaggcuuaagcaguccucccaccucagccuccugaguggcugggacuacaggcguaugcuaccacacccaccuaauuuuuuguauuguuuuguagagacagaguuucgccauguugcccagguuggccucaaacuccugggcucaagggauccacccuccuuggccucguaaagugcugggauuauaggcgugagccaccucacccagccaacauuuauuucuuaaguagauuuagagucagcaguucuacauguauacauuuucaucaucauuucaaaauagcuaaagccuuuacaguaauggaaauugagauuugcaaaaagcuuugcaaaggggugaggccuuucugauuuagugcugauuguugaaaauuuaaagcuugaguguucauguaaaugauuccguggaaugagugggcuuauuugguaacuuucuagaccaguggcacccacauguugcuugacaggcuguguucacuuuagaagaauuugguacucaguacuucgaucuuaaguauccguuaaguggggcuuuuugccuguuuucaguagcauuuucccauuuggagccuauacauaugacuauuuauaacagcgugggugcuuuaaagucaccagagggcauaagcaugacuguaacaugcuguggaucugagaucuuccuuuuuacaggaucugcacaauuuagaccuaaugauuggaauugcuuccgcggguguugcuguguaccgaaaauacauuugcacaaguuucuauccuugguaagugcaaacaguucucauuauuuucugaaucaugcuuuaaaaauaugccuaacaaaaguaauguuaccucccauucuaaauguuuauuucuaaagaaaagauagagagugccucccgaguuuuacucugaccucuaaauuugguccagauuugguacuuaggaaaauuugaguuuaguuuucauuagcauucccuucccccaacucacccugugguuugggauacucuggaaaccugguggauaaaauggcacaggcaggccuuggcauuaaggaauuuuuccugggcaguacauuggucagaauucagagaagagcuuucucugggcaggaaccaucguuucauuucuguuccucgguuauuaacugaaccuuuaccaaguguccagcucuguucuaaacucuaaagggacccaaagacguguacaacugagugcuugcccucugagcucacaggccuggugggaagagaccuguaggccagccugucccgcauuacucgugaguggaacugaauuuuggagagaaguuugaguuuaaugugccaggcaacagggagcuuucuuaggggaaacaccaccaaaauaauaccaucuacauaaugguaacgugauggugcaaggaauggggguagcacgcauugccaggaagguacaggagagugagugccauagacggcaggagaugcagauggaaaaggacaaacggggaaaaaacacggaguuuuggcaaaacaguggcagcaaggaaggaaguuagggaauggggauaagagaagauuuggugccagguaugugccacacagaguuugaccuuugacaucuaaaucugcuccccaacuugggagcauagaauuucauuaccugaaacacaaagauguucaucacagcauuauuuauaacaggaaaaaaccugcaaguaacuuaaguaaaacuauggaguauuauauaauaauauauauaauauuaaugaguuaguaauauaauacucuauuguuauauaauauacccuauauuauauaauagaauaauauauauuacacauaaauauauaauuauauauaacaaaauuaucguuauuaauagcaguaauucuuauugcaugcuuacuguguccaaguccuauuacuguguauuuucuuugauuuaucuccuuuaaacuccaaauaggcacuauauagguuauuauccccaguuucacggaggaggaaacagagguacaaagaaguuaaguaagaaccuguccagagugacacagcuaauaaucagaguaguugaaacucacaucagagucuagcuccagagccuggacuuuuguuucaacacuaaaagugguauuuguaggaaaacgcuuaaguagcauacauacuuaauagacgcuguucaguuaaguuucaauauaucuauuuuccaaaaccaaaaaaugugacgacagcccuguucaauuugacacugaaaucaguguaacagauagcaggaucuucucuccaucuuucauucaccucaucucuuuuagaagccccucagaggaagcaagaaacuccagccugcuuggugggcuggggcgugcccaggcagcucucuggcccacucaggacuaagaucaggcuaagcagagggcacaaugggcauacggcucauuuuucugcacccagccccuccagaugccgggggcuuccuccaggugccacaggccuaaagccccuuggguccagccuaacugugaccaaaccuccuaagggcccacagacaagggcuggacccucacauuguggagaagaugugggucccacaaggucacugcaggagagagaagugggagacuuggucaggagaagcagguuugugaacagaagccuuuuuggcagagccugcagggacucuccaacccccaggcucacccacaguccugcugaagccucccucacccuucaacaucaagauggcuccugucgaggccuggccccugccuccaguguaaaccucagagaccagcggggagaccagcaccagauggugaccccagggugacaagggaggugcaugggcaagugcccaggaggggcaggacauaagaagggcccuaagcaugcaggguaaggcacucaccaggaucugaacaccagcugagcuuuggcccaaggaaaauucuagagaaguggcaggguguauagguccagagacaagagagaacccagcuagugagucaggaggagugggacaggccaggcuggagcuggccaugggcaugaggagcagcaggagaggggccaggucauggagggcuucacgggccauaggagccuauaggcucaguucuuagugcucuugugagacucuaggcauuccugcaugcagugcucacaguuacagugauuuacuuccaugcaucauucuuuaugugguuccugucucccucacuggauuauaagccucuggauggcaguggcuccauguccucuucccucuguccccagggccuggcauagaacuuuguacauccuaggcucucagugcauuuuuuuuuucuuauaaaugagugaagggcaguagggagccccgcugaggccccaagccuggaaacgacaagaguucaugucugugcauaaucagauuugacagcucagggagagagcugucagguggggaaauuggggucagccugggaaggcgaugcugagcuggagcccuaggaaccacaggaggccugccaggcccuccuaccccuguauaugaagccagggguggggggaguaagagguccacagauacccaugggccaaacaaggcaagguaagaacucaaaaggggaguugauucuccugacucguucugcagaacaggaauuuuugcaucugccaguuggcacaggagaaucgugaggagacucccccgacuucagggagauggcagagcaguaacacacacuaggaagaguaucuccagaaggggugagcccagacacucuucucauccuuagacuauuaaccuguagucaccccaaaaaauuuacuucacaguuacaucuaccaacagaucguugaaaauagauguguauuagguaauaucuaauauguaauagagguauauugcugauccaucugggggaugucccaugaauaguucaaguuucguuuuaccuacacagccucuccauucuagaauguucuaccaaggucuuuguaugauccuagagaauaguaaaauuccuucauuuccccaaaguauuucagaaguaaagauuccagcagagaaauaugcacccuuuguauggauuacagaaguuuugcauaaaugaaugauagucagcccuugguguacuugggggauugguuccaagaccacuuguaguuaccgaaaucuacacagacuugucacacaguuggcuccgcaaaacucguguauuugaaaagccagcccuuuguauauguggguuucgcauccugcaaauacuguuuuccauccauguuugguuaaaaagaaucccccagauaguggaccccacauaguucaaaccuuuguuaaucaagggucaacuguaaauuuauuuuaaaaguuauguuuuuaauuaaaggaacaagcauugcaggccuacugugugacaagguagggacuugacauuccuacucugcuugaauccucacaaggccgcucucugagaagggcaguguuuucaccacuguugggaagacuucauaguggagagcuuaggagcacaggcuucagagucagcugagaccggggugcagguccuggcuccaggaauuucuaguugaaugaucuugagcacuuuggugaugucucugagccucaguuuccucaucugaaaacuggguauaacaauauguacuuuucaggauuguugcagggcuucguugaggggauguuuauaaagcucuuaguagcagccuaguaucuaaaaaauguucaguuaauggugacuaaauucuguuaucuugcaaauguuaaguaggcuacuugacacguggcuguuaaguaauggagcugggguucggaccaggucuguccucuuucagcugcuccaugcugcucucagcugucuuccccauguauauaccagcucacgcagagcugcagugccacaaaagcagcuuauagcaaagagagcgcauggccuauguuucuuguuauuuaaaagcuacaucauaauccaguggcccuuacgcagugcucagcuucagucagcuacuugguauuagccugcggcaguggggcugccaucauuucuacagagaaguaaacucuaggcagccaagagcccccacucaucaggaucauggaguaaaggacaugcauugagaggcaucagcuucaaccuggccgaucccugaugugcuuuguuuguguuuuguuuuauuuuuugaagggugaacauucucaaaauuucuuucaaaaggaaaaaguucuucauacaucagcgacagaaacaggugaguaguuaugucuuugcuugcuuuguuucgugcauauguaugugugugguuagagacagggucucgcuauguugcccaaacugagcucaggggauccuccugccucagccucccaaguagcugggacuagaaacaugcaccacuuugccccauuucuuguguuuuuaaguuacuucagcuuuuaguucuuuaaggguugaaggcuguuugcuauguauguaucagggaagaaagagcaugccauuguggagccagagucuggaggauccagugauugucuguauaauucugcuuagcugguuggaggauuaacuugcuuuggagucagagacagugguuucagauccuggcucuuccacuuaccagcuagccagguuacuuaacguucccuagcccaaguuaccuuguuuccagaaauucuauaaugcccacuucuuagggaauugugaagauuaaauaaaagaggauuggucaaagcacuuggcagagagcccaccacaaaguaacagugaaugucagcaaggucaguucccucccaugauguguugaaacugcacgauggcuugguagguguauauaucucauaagcaaaguccauagcacugugauaacuccauuugcucauccauacagagauguagaacuuagaggagaggaaacugaggcucccacagcuagugagucaggggagcuggaauuuuaaccagaucauuacgaauccgagacaccugcucuuuccacagcacuacacccuuaucuuuuuaugcugcaugauuuucacuuacugucacugugucaauuucccaauuuuucaaagguaauauaugcuuaaaauggccucacagagccgugaacucuuaggaaugaggacacaaaagcucagagcagcuaggacuggaaucuggaucuccugaccccucagugcaagauucaggguggcacaaaaauguauaagacggcaauuuaacaugaaaacagaaaaccuaaacucaugcagaaugcaggcaaagcaaaugauuaaaaugauuauuacauaugagcacuggauucaacucugugcuuuguggaaagcaaauagagaaaaacccaaaggguuauaaacuugcuguugucugauagaugaaagaguauuccuucaggagagagauguucccagaguuaaaauuuaaaaggaguguaucagacgguuuuuaucugauugcuccaaauguauccagccuagaaauguaaauagauuugaaauaaaagcauucaugaagaagcgcagaugaugauaaagaauagauucuggucaucucuauuaccauguucauaaagacgguuaacaaaucgugcucuugaauauuccgguacacugguuuguggccacggcauuuugaaaccaguuuucugcugucuguugcaucuuaccucauuucaccaauguggguuaaaugcuuacaagucccugcuccuaugucugugugggugaaaucuugacuguuuuuccucccaggcugaauccagggaacauauuguggccuucaacaugcugaauuaccgaucuugcaaaaacuuguggaaauccuguguugagcaccauacguucuuucaggcaaagaagcuacuaccucaggaaaagaauguucugucucaguacuggacuaugggcucucggaacaccaaaaagugag

SEQ ID NO: 13979 - RNA, 1307 nt, Homo sapiens
gcucggcucucugcuccuccuguucuacagucagccgcaucuucuuuugcaucgucagccaaaccacaucccugagacaccauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaagaggaagagagagacccucacugcuggggagucccugccacacucagucccccaccacacugaaucuccccuccucacaguuuccauguagaccccuugaagaggggaggggccuagggagccccaccuugucauauaccaucaauaaaguacccugugcucagccaaaaaaaaaaaaaagagagag

SEQ ID NO: 13980 - RNA, 2621 nt, Homo sapiens
ucaggagguuagggaucuuuauuuccugauguuucccaaaugccuagaaccaugccuggcacauagcagugcucaguaaauaucagugaaugaauccaucuccuuauccaaugcugaacuucaggcuuccauguuuaucccacucuuagucccuuuuuuuuuuuuuuuuuuuuuuuuuuuuuuuacagagaaaaggggucuguuugcucuuuguguucuuuguguucauaguguuuccaagccccaggccauucagagcuuuugucuccagugccccacacauucaagaaagacuugaauugccucucaggucugaaccuguuuugugcaggguguccaagcuggagugcaauggaccggucuugacucacugcaaccucccacucccggcuucaagcgauucuccugucucagccucccaaguagcugagauuacagacguucgccaccaagccuggcuaauuuuuguauuuucaguagagauaggguuucaccauguuggucaggcugaucucgaacuccuuaccucaggcaauccgacugccucagccucccagagugcugggauuacaggcgugagccaccgcgcccagccaagauacauuguugcagaguguaaaaccagaucuuguugaccuggcauuuagaccuuccaaaaucugauuuccaccuguguuucuaggcaugugacccacugcacacuacacagcccccacagggaccauuucuccuacccugagcaagccauuccuccaagacacacuucuuugcaacuccugcccguugaaagauuacucauucuaccaagccaggcuuaaaugcugccuacucucugaagcugucucugauauuccaccagaguucgucucucaucugcacaucuacuaauucucuguucucaacuccuguucagaagaccuuguaaucaaguucauuguuugcacaucugucccuuuacuaagguggaacuccuuaaggacaagggaccauaucuucagcagcucugaauagcauuggugcuucaugcagggccuugccuauaaauacaacuucaacaggugggaguuguugguggguucccaccugcaagcauaagucagcaggcuucacagugaguggccuaacauagguguggaucagaaggaaaugaaagcuucauucuagcuuccccaauacuacuugucucuuaccauuccguugucuugaguauucuuuggggaaccugcugauauaggaggaacaguggcuucaaucugaaggacugugccagcuuagggugaguaugacucagucuggaagcagaagcagaagggaauaugguuuuguggaugaacgugggagacagcauggcaugagguuagugcucugaggucuggugcaucuggcuuccugucuaggcucugcugcugacuggcuggaugaccuuuagcguauucuucaugcuuugaugccuguuuccccaucaguauacuauagacaauguugggaccuccccuaaccccugccacuaggggcauaaugaagaggaagccaaggggugugcauaugaccccaccaccagucugcagggaaugccacaaagaugcuagccuuugcaaauucuggugcaguguuacgaggagacaaaguucacaaacauuaccuugccccuggguaccacgugacuuuugucucccuauaucuccugcacaauugcaaggauuaaacaugcuaauauguauaacggacuuagcacccugcucuccaauaauggcuuaauaaugcucugguuucucuucagaucauauaaaucuuucaccuuuuaccaauaauggcuuaauacaccuuuuaccaauaauggcuuaauacacauaagcaaaaagacucaguuaauauaggcuauaaguuggaaucaauaauccaugaaagaaacccuggauaggguuuuuaggacacaggcacugcuauacccuaauagaauggaucaacuuucauucaguuaaaaaaaaaucuacuucuuuuuuaugccacaaagugccaccuuaaauuuaucuuagugauugaaugucauacccaaaagaaucaaaagcacuggagcaguugaucugguagaaacuucagcauguguuuguucauuccacaaagguuuacuaaacccuugcuuugugacaggcacuguauaccaguuggccuucucucuacauuaugcuguugcaacaggcaaccccaguaaugguuucuuucuugcuacuggagcucuguucuaggugucuucauuccuggacccaggcugcaggaucagccccuauauggaacaugccauucuuaugacagagagaaagggguacuaggagaaccauauaguggcucuuaaagucaugcuuggauguggcacguguagcuuauauuccauuggccaaggcaagucacauggccaagccuggcaccaaugggguaggggaguauccuccucccauagagcagcacugcagaucucuugacaaugagugaggauauauaauccucccacagggaaggcagaaaggauuugggggcaauaauacugucugccacaugcugucaugaaugcuaucuaguuuuagucucuugauaacucugugagguagguauuauuauccuca

SEQ ID NO: 13981 - RNA, 43940 nt, Homo sapiens
caccagccccauguuggcuccccaagauucucuuuguauggggcggggguuugacaacaacaaaccauuucccugccagaguacuaccugcccagcuagaagcuuuuggcaggaaaacgggagucaggaagugaguggucuguagucuuugaucuuucugaaaggcugggaagaagaaacguuuccugguuggguccccaaagcugaggcugagagcucugccuggacacuucugggcaugcuuguucuggcuggcgcuaaaaugcaaugcugguguuugcuaauucguucaccacacuugccaggccucaugaaaagauuccugccaggagaggaaccaggaaucaugaguuggcugagucgacacagcauaaagcucaacuuaaacaguuuauggguauuuuauuucuguucucuuuuuuccuugguucugguuuucuagcuuuguauuacuauuaucagagugggcauaaauuucaguucaauuuaguucagauaggauuccagcugggcgcaguggcucauaccuguaauccaaguacuuugggagguugaggugguggauggccuaaagccaggagucugagaccagcauaggcaauguggugaaaccccagcucuacgaaauuuuuuuuuuuaauuagccagguaagguggugcaugucuguggucccagcuaauugggagacugaagagggaggauaaccugggccugaggaaguugaugcugcagugagcuauaaucaugccacugcacuccagcgugggugacagagacccugucucaaaaaaaaaaaaaaaaaaaaagauuccaaggugcuuuguuauaaucacucccuggcaaaugcuuucagcuuccuugcuuuuuucuuccuccaucagucacgccuggcauaacccuaaccccgaguaaaagcaaucacugacuuuuccacgccuucccaugagccccugaacauuguuggcgaaaauuacuuaacuagacugacugguuuuccucuaaugaucacaaacaacacaaaggcacacacgacacugcccaguaaccccagagauucuccaggaaauuuccuuacucgcaaaacuugaugacaauuuuauccuuucacacgguucucaagccucaccccucaacuauucuuaccugaugcuucacugagagauuaaaacagauuagaccagagacuuugucuuuuuauggucaagacuacaaacuuuucugcauaugcauccaucuucacuccuuucuuucuuucuuucuuucuuucuuucuuucuuucuuucuuucuuucuuucugucugucucuuucucucuuucucucucucucucucucucucuuucuuucuguuuuugagacagggucucacuggguugcccaggcuggagugcaguggcacaaucucggcucacugcaaccuccgccucccagguucaagccuuucuccugccucacccucccgauuagcugggacuacaggcaugcaccaccacaccgggcccaucuucacuuuucuuucugugaaaauggaggcagcuucucuccuccuaccaaagguuaauguacuugggaugcauuucuccuaaccuuccuaggcuaccuggauuauuucuuuucuccugcauaacuaaccucuucugaaucaacuaggacacuuuccaccgcaaguaaaaagacaaaggccaucagcagacugaacacucccaaauuuauaucuccugcccaggaugucuuccaggcuccaucgauuaaugggcugaagagccuccuguguccagccugggcaacauggcaaaaccucgucucuacgaaaaauacaaaaauuagccaggugugguggggugugccuguagucccagcuacucgggaggcugaggugagaggaucgcuugagcccgggugguugaggcugcagugagcugagaucaugccaccgcacuccagucugggugacagagcagagggagacucugucucaagaauuaaaaaaaaaaaaaaagucaccuggacauuuuccccauggcaucuuaaacuuaacauguucuaaacugaacugauuucuaccuggaacagaugcuucuagcugcauucucucuugguucuuugcuagcaaguauccccacguuguuuagaauaguaacaugucuagcuaaaaaauugcuagccaagcuccuuuauuguuagaagugaucacaugacaauucugccuggagguaugagcagaaguuacuggauagggccuccaggaaagcuuuucaaaagugggcagaacacacucucucuuuuuuuuuuucugcauggaacaugcacggaaguagagcagcgacuucaugaucgugagguccacaagccgagagugaaaaagcagaagguuagaaggacucugggaagcaacaucaugggaucccaacauuaguucugggauguuacaggaaaaaaaugaugcccuacuuguuuuuuuguuuuguuuuguuuuugagauggagucucacucugucgcccaggcuggagugcaguggugcaaucuagguucacugcaaccuccgccucccagguucaagcgauucuccugccucagccucccgaguagcugagucuacaggcacaugccaccacaccuggcuaauuuuuuguauuuuuaguagauacaggguuucaccgugguagccaggauggucucgaucuccugaccucgugaucugcccgcuucggccucccaaagugcugggauuacaggcgugagccaccgcaccuggccgccauuacuuguuuaagcuacuauguauagcagacauuuuguuacaagcaacugaaccaagccuuagcuauacaccacucaaaccuacuucucccuagccuuccccauuaguaauugggaccuccagcgccaaauccagaggugggcaaguuauccgggauucuucucucuuaacacccaccuacaauccaaucuauaagcaaguacugcagcaucuccuccaaaauauuccuauucaugcacuugucuuuacgagcuuugccacuaccugguucaagccaccaucaucuccuaaaauaaccugauacuggucccuuugccuauccccuugccuccuuucagucuuuucagcaucuagcagcuagaaggagcuuuuaaaaugcaaacugggcaucaguacuggcagauacuaaaacuuccaggaaggacaugaacugcuuugccuaagagagagagagaaaaaaaauuuggaacuccccaauuuagaaugaaaaauuaagaaaauggaacuccccauuuuagaaggaaaaauuaagaaaagaguagagagaauggcucuggguuacauaauggauuccuuaaucacuggcuaagaaauaaaaaaggaaccucugaauauuggaaugaauuaauuuucuuguggaaauuggugaaggggcuaaauauccuaaugaucuuggaacaaaauagagcucacauuuaaaaauagcuagcaggacgcaggaggaggcaagcccagggagcucacaggcauugugggagaacuuuggacuaucauggaacauagaacuuggauuuguuccaauuuaaucagaccucggaagggcagaggagccacccacagauggcuuuggguuauguuuggguuuuacuugccagcuugggggcauuguuuagauaucagcuguuggucaugcugaacugugaaacaggcgucauuccuuauuugaggucuuauuaccuugguuugugaauuaugugggaaggguaagggugaguaggaccugcugauuuggauuacuuaccuggauuuauaaccagaugcauccaucugguggcgcuuaggaggaacuuuuuagcaacucucagugguguccuaauuuuuucauucaaaagaaucugaaaacaagccugggcaauauaaugagaccccaucucuacuaaacuuaaaaaaaaaaugaguggggcaugguggugcaugccuguagucauagauacucaggaggcugaagcagaaggauugcuugaacccaggaguuggaggcugcagaaagcuaugaucacaccacuguaccucagcccaggugacagaguaagacucugucuccaaaauaauaauaauuuuauauauauguauauauauauauauauauuuuuuuuuuugagacagggccucacucugucgccuaggcugguguacaguggcaugaucucagcucacugcaaccucugccucccagguucaaauaauucuccagccucagccuccugaguagcugggaccacaggugcgcaccaccaagcucagcuaauuuuuguauuuuuaguagagauguggucuugccauguugcccaggcuggucuugaacuccugagcucaaagugauccaccugccucugccuuccaaagggcugggauuacaggugugagccacuacacccagccuaacaauaauaauuguguuuuuuuguuuuuuguuuuuugagauggagucuuacucugcugcccaggcuggaguacaguggcgcgaucuuggcucaccacaagcuccaccuaccggauucaugccauucuccugccucagccucucgaguagcugggacuacaggugcccaccaccuugcccggcuaauuuuuuuguauuuuugguagagacgggguuucaccguauuagccaggauggucucgaucucccgaccucaugauccaccugccucggccucccaaagugcugggauuacaggcaugagacaccgcacccggccaauaauuuuuaaauauuuauaugagaggcagagaaauuuuguaggaaaggaaugcuuuguauggaagagaguuaagaugcacaaagacaguaagugguucaagaucaaggggaaaagugagugcucagcucaguguugguuacuuguaucuuacuucagcccagacucuugggcucaugcccaaguuccagcucagggggacaccaacaaagaaaaaaguaagaacuuaaacaaguggcuucauuaaacucucugugacauacugaguagcuuuguuacauagaugggagauggcaccagugacuucgacccuaucggagacauugggauucgucaaucuaauuacucauguggagggugcccaaggauaccuuauguuuggagagucacuggaagggcucacgggacccagacuauaguuguauucauggcuaagguuuauuacggcaauguaaugaggagggagaaagacucagguggagccuggggaaauccaugggcaggcauccuacugcccccucccuccacgaggaauugcacagugcacucuuccuucagcaaugaaaauauauuuccccagcaguaagcauucaauguuucugcuuauuagagggaaacccauuagagucucaacauccaaaguuuuacuagggucuagucacauaaggcacccucugccuagcguguaccaaaauuccagaccccccaaaggaaggcagguguucagcauaaaccacacuguuuguauagucuaggcagaaugggccacccuugucaguuagggaaugguggggacacgcuucaaauccaaguucccagacaccagcccaaggccaacaucgcaaucaggcuugcuauguuaacucuucuguacaucaguaaaaccucuagcaauagugaagucauuaagagaaauuucguccuggaaauuuuccaccagaauuucuaauguuguaugguguaugcacagaaguuaggauuaaauauguuaaagcuuggcagcucuucuaacuggucuauauucaagaaauauauucaaggcagggcaaaagaaaaagaauauagccaauugcaaaugaggagguaauugguucuuugaccauuugucccugaagcacagcugcagauuaacacuuccuugugggucguucucaucucaggaggacagcugauguacauagacacacagggaggugggcacugagggugggcuguaaaccuggcacaaccuagcuaugauauccacugugacaucuaaccugcuaguagaaucaugccaaggaauggaaguaaugcaagcugacagagguuugggcccaggaauuuccucccacaguagaggaaugugguagagacauacguagucacagaaccagagcuguggaccaaaagaagguucgaagaugaauauuucuggcagaaagcuaacaguaacuauuuugaauuuaccaggcaccucccuaaggaaaauugcuuucagaaaacacuggagcaagagaauacauggaagauaguuuauacuccugcauccuccaaccuagaauucuaaaagaaaaaaaaagaguaccuaaaaaaagaaagaagcugaggaccuaggacaaauugaacagagcaaugcagccugggcugcaaauagccggauacuaaaacuaggauuuuugcagagcuaucucggggguagaagaaccugaacuacagguuaaaugugccaggugauguuccggaauagaaagucaaggagaaugagagucagauuaugcaguguuuggggugagacuguaugaaaugagugccagaagcuauaacacuugugugcuuaaaugccaauuuuggaguaagauuuugucaggguagaaucugcuguggaagcaugagcugagcuucccaccuuucccauccaacaaugaauuaauccagugagacacuaccuuuucuccaucaaucuguauccuugauccugaauaugaggacaaugguaaaauugcacaaugugaguuacaauucucuugugcucuuuggaugauguuuuucuuuuuauuuauuuauuuauuuauuuauuuauuuuauugaucauucuuggguguuucucggagagggggauuuggcagggucauaggacaauaguggagggaaggucagcagauaaacaagugaacaaaggucucugguuuuccuaggcagaggacccugcggccuuccgcaguguuugugucucuggguacuugagacuagggaguggugaugacucuuaacgagcaugcugccuucaagcaucuguuuaacaaagcacaucuugcaccgcccuuaauccauuuaacccugaguggacacagcacauguuucagagagcacaugguuggggguaaggucauagaucaacagcaucccaaggcagaagaauuuuucuuaguacagaacaaagugaagucucccaugucuacuucuuucuacacagacacagcaacaaucugauuucucuaucuuuuccccaccuuucccccuuuucuauuccgcaaaaccgccaucgucaucauggcccguucucaaugagcuguuggguacaccucccagacagggugguggccgggcagaggggcuccucacuucccagaaggggcagccgggcagaggcgccccccaccucccggacgggucagcuggccaggugggggcugaccccccaccucccucccgggcgggguggcugccgggcggagacgcuccuggcuucccagacgggguggcagccgggcggaggggcuccucacuucucagacggggcggcugccgggcggaggggcuucucacaucccagacggggucgaggccgggcagaggcgcuccccacaucucagacgaugggcggccgggcagagacgcuccucacuuccuagauaggauggcggccgggaagaggcgcuccucacuucccagacugggcagccgggcagaggggcuccucgcaucccagacgaugggcggccaggcagagacgcuccucacuucccagacgggguggcggccgggcagaggcugcaaucucggcacuuugggaggccaaggcaggcggcugggagguggagguuguagggagccgagaucaugccacugcacuccagccugggcaacauugagcacugagugaacgagacucugucugcaaucccggcaccucggggggcugaggcuggcggaucacucgcgguuaggagcuggagaccagcgcgguuaggagcuggagaccagcccggccaacacagcgaaaccccgucuccaccaaaaaaauacgaaaaccagucaggcguggaggcgcgcgccugcaaucgcaggcacucggcaggcugaggcaggagaaucaggcagggagguugcagugagcagagaugguggcagcacaguccagcuuuggcucggcaucagagggagaccguggggagagggagaggagagggagggggagggggagggagagggagagggagagggagaggggauguuuucaacuuuaguuuuuuuuuuguuuuuuuuuuuguagaguuucagagagaaagaggcguuuguauugauucaagaggauugaaucagauggauuuuccauuuagaaagcaaaagguaagaaaaaaaauagaaacaauaccuuugugccaagagaagagcaaaugggaaaguuagauauagaauuguuaucaguaugucuucuuuuucaguacaaaauaccuugaaaacuuaguuaaucuuguacauucaacagacuauguucuggaauguucuauucacauguuucaggaagacuaaccuuucucuuucuauucuguagaaaaucaagacuucagcauuguguuuaaaaugaugaaggcagccgggggcgguggcucauaccuguaaucccagcacuuugggaggcugaggugggcgaaucacgaggucaagagaucgagacuauccuggccaacauggugaaaccccguuucuacuaaaaauacaaaaauuagcugggcaugguggcaugcaccuguagucccagcuacuugggaggcugaggcaggagaaucgcuugaacccaggagguggagguugcagugagcugagaucgugccacugcacuccagucuggcaacagagcgagacugugucucaaaaaaaaaaaaaaaagauuaagccaucaacacgauuuuauuuuauuugcauagccuucaaauaggaaagucuagguucauaauuagauaccuuuuccugucuggcaagagaccuuguacaguuuauauacuggugaacuaaauuauacaaaaccugagaagccauggucagagaugauugcgcacgcgugcgcacacacacacacacacacacacacagaguuguuguuuugagauagagucuugcucuguugcccuggcuggagugcaauggggugacuuuggcucacugcaaccucaaccuccuggcucaagugauccucccaccucagccuccgaguagcugagguuacagguacgugccaccacacccagcuaauuuuuuuguauuuuuuguagagauggguuuucgucauguugcucaggcuggucuugaauuucuaggcucaagugauccaccauugagugcuggccauguaugcaguagcaucaguacuuguaguagcagcaacagugauccuaauagggguauggguggcaucacuaaguuucuugguuaaugcagccacagaaaacauaccagaguauagaggagcagaugcuggguacccaagacaaccuagugauacaacacaaagcuuuacuggcagcugcaggccucauggagcagacugggacaguuagaagcaugcuuuuuuuuuuuuuuuuuuuuuuuuuuuuuugagacggagucucgcucagucgucugggcuggaguacaguggcgcgauauuggcucacugcaaccucugccucccagguucaaacgauucuccagccucagccucccaaguagcugggauuacaggcaugagccaccacaccuggcuaauuuuuguauuuuuaguagagacaggguuucaccauguuggccaggcuggucucgaacuucugaccucaggugauccaccugccucggccucccaaagugcugggauuacaggcgugagccacugcgcccagccauagaagaaugcuuuuauuguuauuauguugaccucauuugcaacucuagauugguguggccugguaacacauauauagugccagaauaaacaucuuugugcauacauccuuuuccauauuuugaauucuuuccuuaagacagaaaaguauugagucaaaggguauaaauacuuucugggaguugaaacaauaccugggcucuucuagucuauguauuacagucaccaaauugcuuuacaaaaaguugucucaauuaggaauuuaugcagcccugagaaaagugucagcuguccucuucgaucggucuugcuaaaauuggcuauugcaaguuuuagaaucauugcuaauuuugucaggaaaaugauaauuugugguuaauguuugcauuccugugauuacucaucaaauuaagucuuuccauuuauccugacugguuugauuuccuuuucugagaauguccauucaagaucauuacuauuuaaaaugacuuuguuuuguuuuguuuuguuguaaagagucuugcucugucacccagguuggagcgcaguggcgugaucucggcuuacugcaaccucugccucccggguucaagugauucuccugccucaaccucccuacuagcugggauuacaggugccugccaccaugcccagcuaauuuuuguauuuuuaguagagaugggguuucaccauguuggccaggcuggucuggaacuccugaccucaagugauccgcccacuucggccucccaaagugcugggauuauaggcgugacucacugcaccuggccuaaaaugauuuuaauuauaccuuuuaauuuuuaaaauaaaguauauaaauauuuauguaaaauauacuaauucuuugucaaauuuacuauaucuauucccaaauuugucauuuuuucuugaauauuaugaguuuuaaugcauacccuuaaauuucauguaaacaacuucaugaaaaauuuccaucuuuuuuuuuuuuauuuuuuuugagacggagucuugcucuguugcccaggcuggagugcaguggcgcgaucuuggcucacugcaagcuccaccucccagguucaagugauucuccugccucagccucccgaguagcugggacuacaggcgcucaccaccacaccuggcuaauuuuuuguauuuuuggcaaagacaggguuucgcuguauugcccaggauggugucaaauuccugagcucaggcaaucugccugccucagccuuccaaagugcugggauuacaggugugagccaccacgcccagcucauuucuuaauuuaaaaagccuucucugcaucaacaauuuuguugaguauucacaucucacaucuuuauucuucuaguuugugcuucauuuuguuucagugggacacaguggugcgaagcuggaacucugagccaggcagaccugccuggggauuaugcuaauuagcagauggauaucuccuugagcuuccuauauaaaacuuuaucauagagaauauuucugaaaugccuguuuacccaacuucacagauuauuuagacaaaaagugaauagguguacacuggagaucuucaucugcaaauguuuuuccucccugacagaaccaacugccagguuuuaaaaaguagguuuagcuugcucaaaaguccccuuugaggaucacgugagcccagggguuugagaccagccugggcaagauaaugagacccuaguucuacaaaaaacauacaaaaauuagccagagaugaugacaugagcccguaguuccagcuacucaggaggcugaagugggagaguugcuugagccugggagguugaggcugcaguaagccaugauccugccucugcacuucagccuggacaauaaagggagauccugucucaaaaaaaaaaaaaaaucccuuucacauccauccuuauaggaaguaugccagaggaacagguauuggagcuuuuuuuaguuuuccccauuugucuaugcaaccaaucauacagauuuauuuuccuuucuuggguucuugguuuuaaaaaggugcuucauucaugaauucugaggauagcuagggaaaauuuaaaccauuauaaacuggggaauuuagcuuuuagacaucuccaacaggcugugcagaaguggguagcauccucugguggacaguuuuggaaccgguauggucucugaugggugcacuggaaccaguuggggagauacagauccagggugaauccucuccaaaaucucuccucagcauuuuucuguggcucucugauggucagcaaguaaacggcugcuuuguaucccugaugaccuagcagguccaguauuaaacccacuaugagugguuugugugagccaugugaguuuucugcuugccccaaauaagaaugccagaggaaugggagaauuguaaaaugaguuucuccacaaaagugacugagugggcugaacaguaaagggcaguggauguggaaaacaaaaaaagggagugaauacaggcagaauccacccauccucugacucccugccauucuucaaguggacagauuuuaggagagguaaggaagaaacagauauuaauugccuuaaguaauuaauuaauuuuauuuuuaaauuuuuuguagaggcaggguuuugccauguugcccaggcuggucucgaacucccggacaggcucaagccauccacccgccuuggcccucccaaagugcugggauuacaagcaugugccaccacaccuggcucagauauuaacucucaacaacaacaaaaauauagacauacaccaagaaggcagaagagaaacuauagucauacaagccugacaaaauuagagauggaguuggcaaugaaauugguggcauuccaaugccaugaaccgugacucacacuaguggguugcgacacugguaguccacuugcagugagaaggacagauuuguaaaugucaucaaaggaaguucaaaggcaaugcugguuuugaauuagcuuuuuaaacuguaauauuauuuuuuaaauguauaugcauuaaguacauaugcauugaagcauuucuuucuccacuuugaaaggaagguguauucaucuguucucaugcugcuauaaggacauacccgagacuggguaauuuauaaaggaaagagguuuaauugacucacaguuccacauggcuggggaggccacaggaaacuuacaaucauggcugaaggggaagggaacacaucccucuucacauggcgacaggagaaagaagugccgaacaaaggggaaaaagcccauuguaaaaccaucagaucuugugagaacucacucacuaucauuagaacagcauggggcuaacagcccccaugauucaauuaccucccaccaggucccucccacugggucucucccaugacacguggggauuaugggaacuacaauucaagaugagauuuggcuggggacacagccaaaccguaucagaaggauuuuaauuuugagacuuccugugaugugcgugaauucccuacaauuugcaaaugugccuauucaucaagacuucuauuuuggaauaaguauggguacucugucuuugacaaguuaucaucaaaggaaacaaugaaaauuaaguuuauggaagucacaaguccauguugauacaagaaaauguuaauugucuuccauauaaauuuccaaagcuguuuaucaaaacuuagaaugcuguacagaccaaucccaauuacaagaaucuuaaauauaguugugaucaaguugcuaaucauaaccuguugcaaacccacaaguccacugauucacugaaguaauuuagcuaaaaguuaucugugaagacacuacuguuugcugugcuucuuaguucuccuuuuacauaccuuauaugaagaaauucaauggcuggguguaguggcucacaccuguaaucccagcacuuugggaugcuggggugggaggauugcuugaggccaggaguuugagaccagcuggggcaacauagcaagauccugucuccacaaaaauaauuuuuuuuuuuuuuugagacagggucucacucuguuacccaggcuggagugcaguggugcaaucacggcucacugaagccucaaccucccgggcucaagcgauccucccaccucagccuucugaguagcuaggacugcaggugcacuccauuauacccggcuaauuuuuguauuuuuuguagagacagaguuuugccauguuuccuaggcuggucucaaacucccgggcucaagcaauccacccagcuuggccuuccaaaguguugggauuccgagcgccuggcccaaaaaauuuuuuuaaaaagaaauucaaggugcggauagauaauuaaggaauggaauguagaggcuauaucucgaaauccaucugugaucaucuaaucuugaccuuugggcuaaagaaauauaaucaaaagcuagauuucagguaauagggguuuuuuuuuuuuuuuuuuggcuuaagauguuauuacucaaauaauuauacuggucaaaacaaccuccccagaagauuguucugacugauugaacauguccaucuaagcaauuggaccagagauaguaaagaacccucaaaccucagcguuugccuggguuguaguaugaaaugaacuaaugaaugauaagccuccugauucuucuauucagccuugggaaagaaagccagaaagaagauaguuuugcucugugggaagauauuguggggagaacauuauaaaugauauagcccugcagcugcaguuagagguacauccagacuaaacccugacuucccucagacugcaaagguggagauucauguaguaaguaguccaggaagaaccaugaacagcaaguucaucauaagccacauucacuuagacauucaacaaauguuuauuaagcaccuacuauauaccagaugcugaauacauaguaguggacaaaauauauuccauuuuauaguugguuauugccaauagagaucaaugcuauuaacuuuucuggguugaauuuguguguuaaucuugcuaaacucuaauucuaauagcuugauuguugauucuguuaguuuuucuagaugcucauauuauuuguaaauaucagcaguuuuaucucugccuuuauaaugcuuacacuuuuuucuuuuccucauaaugcagacaagaaccuccaguaucauauuaaacagcaacaaggguauuccaauggcuugucuuuuuccugaucuuaaaguauaguuugcuauaagucuaacuuugcuguagauuuuuuauauauaaacuuuucaagguaagaaaaauguccagcauuccuacuuuguaauuuuaaaaaucauagucauuaaacauuauaaaacauuuuuucuguaucaccugugggagcaugugguuuuuucuuuaaauuuauuaauuaugaauccauugauaaauuuucugauuguaaaacaucuuuacauuccugcaaagacuuuuacuggaucaagauguaggacuuuuuaaagacauuguuguuggauucaaauagcuguuauuuucuuguauugcccuuaucugauuuuggaaucaauaugacaauagccaauaauaaaaugaauggguugauuuugaaaaucuucuauuuucuauagcaacuugucuuguuuuguuuuguuuuuucaggagagacaguccugaauggcuuuuaaguuucuuuaauauuaauacaagcaugaauuuugauauuuuauauuuuuuaggaacuuuugcauuucauccaaauuuuccaauuuccuguccauaugaugacuaugucaauauuuuauuucagauucugguucauaggguuuccuauggugagagagaugaagugagaucugguucaggcagcacuuuucaagcaugguguucauuuuuuugaguaggaugauucuauaaaggauguguccuuccaugauuagucugacaucugaucuuggccuggaugaggccuuuugugauucuuccuggcuccccuguagucugccuuaucuuccuucaggcugggcaugcuccuuuauggugcuggccaugguuagcuacuaaaagggagaaaagagaaccuuaaaggaguauggagcaaaagaugcaguaacugcaugcuuaguagauacaggauuucuauuuggagugaugaaaauuucuggaacuagacagugguggugauuguacaacacugugaauguacuuaaugcuacugaauuguaugcuuuaaaauaguuaaaaugguaaaugugauguuauauuaauucacgauauaaaauuuuuuaaaaaauaaauaaugaggccaggugcaguggcucacaccuguaauccuaguacuuuugggaggccuagacgggcggaucaccugaggucaggaguuugagaccagccuggccaauauggugaaacccugucucuacuaaaaauacaaaaauuagccaggcaugguggcaggcgccuguaaucccaguaacucggcaggcugaggcaggagaaucgcuugaaccgggaggcggagguugcagugagccaagaucgugccauugcacuccagccugggugacaaaagcaaaacaucaucucaaaaaaauuaaauaaauaaagaaugcagagagcagcuaauuacuccuaaaguggagggaaaaguaaacaaauauggaacuuagaacucagagaaagcucuucccugaucugagauuuuuaaaaauugugauaaaauacacauaacauagaauauacuguuuuaaccauuuuaaaauauacauuuuaaaggauauccaguaccugucaagcaugcauuuacuacuucuuuugcucugaggggagaguaugguugcccuaggagcaugcugccugcuuucguggggaagaaacuggccucuguugagagcuaacagcugccaccaaccuggugacaaaguaacugacucaagcugcauuaguguccuagggcuguuguaacaaacaaaguaccacacacuagauggcuuaaagcagcuagaaauuuauuuucucacaguucugggggugggaagucuaaaaucaagguauuagcaggguuggauccuucuggggccucugagggaggagggguuccacgccucuccccaggcuccuggugguugccagcaauccuuggcauucuccgguuugugguagcauaaccccagccucugccucugucuucuguggucaucuucucuugugccucuguuuucucuucuuuugaugacaugaggccgggcgguggcucacgccuguaaacccagcacuuugggaggccgaggcaggcgaaucaccugaggucaggaguuugagaccagccuggccaacaugguaaaaccccgucuccacugaaaauacaaacauuagcuggugugguggugcaugccuguaaucccaauuagucaggagccugaggcagaaugaucacuugaacccaggaggcagagguugcacugagcagagauugcaccacugcacuccggccugggcaacacagcaagacuugucuaaaaaaaaaaaaaaaaaagacaccgucauuggauuaggguccacccuaagccagagugacuucacuaauuuacauuuacaaagacccuauuuccaaauaaggucauauucacaggcaccaggauuuaggacuugaacauauauuuuuggggggacauaauucaacccacaacaagagccauccccaauguggcagcaaauaaacuggugcugaacagggaaaccugcacaucgaucuguuugcuuugagaagaaaauaucccuuucuuuuuccacguuuguaguguccuucaaguacccucuacuggcagaguuuaacauccagccagcuggcaaaggggaauggacuuugcaucguucccuggggcaaggaaggauggguucaaagcucagaggcaauaaauuaauaacugccauaucaggggaccaaaguucucucugcuuugaagugagcuucagcuagccucauucgaucuucuucauuuuauuuuauuguggucacaacacuuaacaugagaucuacccuccgaacacauuuauuuuuuuucuuuucuauggcugaaauagaacucguuguuguuguuugagacaguguuuugcucugucgcggaggcuggaguucccuggugcaaacuuagcucacugcaaccuccaccucucggguucaagugauucucccaccucagccuuucggauagcugggauuacaggcgcccaccaccacgcccagcuaauuuuuguauuuuuaguggagaugggguuucaccauguuggccaggcuggucucgaacuccugaccucaagugaucugccugccucggccucccaaagugcugggaguuguuuugagaccaggucucacuuugucacccaagcuggagugcaguggccuaaucauaucucugcagcuucaaacucccaggauuaagcaauccucccaccucggccucccaagcaguugggacuacaggugcaagccagugcacccaguaaauuuuaaaauuuauuguagaagccgggcgcgguggcucaugccuguaaucccagcaggcacauccauucaaaccauagcacucagggguuugaacucuaaucuaaucugaggggaaaguugaguaaaaguuacaucgccaaauuugcaauaugggaaauuuccucuaucugaaggcagcgugggaacuucuucaauuugggaagaagagcccugaacaaguagcagugagcaucuauaagaggagcuugcauggaggaaauggacuggguaagcugcauaucugaaaggccucacgggaggcaagggucaaugagaauccucaaagguuucaaauuuggaaacgacaugauccaauguggagaugguuggcaucuacaacacaacauguuucaagcaaaugccccauucuacuccauaagucuacuuuacuucuguguucccuguuuccagagugguaccugguugcccaaacugggaaccugggcauuaucaugacucacucaucuccuucacucuuccagagccaacgacuaaauacuguccauuuugcugcauaaauauauuuuaacuuuuuucuauuucuuuuccuuucccagagccacuaccuagaaauagaccuguagcaucuguuacuuggacuuuuuuuuuuuuuuuuccuuugagacagagucuugcucugucgcccaggcuggagugcaauggugugaucucggcucacugcaaccucugccuccuggguucaagcaauucucccaggcucagccuccugaguagcugggauuacaggugccugccaccaugccuggcuaauuuuuguguuuuuaguagagaugggguuucaccauguuggcuaggcuggucuugaacuccugaccucagaugauccacccacuucggccucccaaagugcugggauuacaggcuacuuggacucauaacugucuccuaauggucuuccugauacaucccaacucauuuucccaggcagaguaaugguucugaaaugucaauccgaaggugucacuuuuugcucaaagaccccauauuggccuuuccauugcucuuaagauaaggaacaacuucuuugacaugggauaaaaugacccuuugcaacuuggcuuucuccaguuucaucuccuacacuccuuaccucuacuccuagucauauagguugucuuucauuuuuugaaaagcuuuauuauuauuuuuuucuugcccauggcucguuucucuucuugguacuuauuucacacucccuuguccccaaacuccucucuaauucacauccuucaagccauucucuauucguccuccaaagucaguuuagcugucagcuccuacuggaauugaugcuuguaauugaucccgauccuaauaauuucaggagacccucccauguguuuccauucauuuuaucuuucucauuauauauauauauaagcauauauauaagccauauauaagcauauauaaacauauaugagauacaaauguaaauaagcauauaugauacacaaaauuguuauuauauauauaacuuuuguaucucauuacauauacauguaucucucucauuacauauauaacuguauauguugcuauauagucccaugcaauauuuagugggcugaggugaaaaauagacacauauauguuauauauguaaugacagagacauauauguguaaugagauuauauauauuauauauguaaugagggagauauauguaaugagagauauauauuuauucaaugagaaauacaaaauuauaauguauauucauuauguauuauaaguauauaaugcuauguaucaguauuugauuucacuuuauuaaaagaguugauuauaucugaacguuuauuuauuuguuacugacugucauccuccaucagaauauaugcucucugaaguugagcuucuuguuuacuuugcucaccacuguauccccagugccuaaguaacagugcccggcucagaguagagacucaauaaacauuuaccagaugaaugauagaaacagauuuuuugaggcaaaguuuuucauguugccauauagucccaugcaauauuuuggacauacuuauacuaaaaaauuauuaucugaaauucaaauguaggccgggcacgguggcucacgccuguaauccuagcauuuuggaaggaucgcuugauccuuccagcagguugucccgggaacgcgcagcccaagguggacgcacagacccgcguacagagauuuuuuauugucaugacugggggugguggcacuacuggcauuuaguguggagaggccagauaugcugcuaaacaucuuacaaugcaaagggcagccccucaaaggcaaagaauuaucuggucuaaaaugucaauagcguggaggcugagaaaaacugaacuagauggcuaugaacuuucagggucccuaccuaguacacaggcagcgccuagaauugcuaaguucaucuuccguuuggaaaggcagcaugggguuagugagaggaaggcgcccggggcugguggcuggcuuuaaaggccuacgugcaaaucuucuugacgcugauaacgggaugcgagagagccagguagguuaccuauugcagcaggucaagugaugaugucgaaaaggaugcgugugccggacacuguggaagguaaagcgcuccgcacagcccgccuaagugcgcccgggacagagccaucccccaggugcuaccaaacaaauccuccagcugcugguacggggaagguguucagugacacaccggaagcagccuaguggcugaggcguccuucucccuaccaacggguugcgaaggaaguaguugcuguagccgcgcccugugcgccugcgcggaggcgucggcugcugacguguagcuggggccagacgggacuagccgggcgcgcggcugagugcugcagaaucgcugggguggcagagccgccagcgaggcuggggaugggggcgccgcugcucucucccggcuggggagccggggcugccggccggcgcugguggaugcugcuggcgccccugcugccggcgcugcugcuggugcggcccgcgggggcccugguggaggggcucuacugcggcacgcgggacugcuacgaggugcugggcgugagccgcucggcgggcaaggcggagaucgcgcgggccuaccgccagcuggcccggcgcuaccacccugaccgcuaccggccccagcccggagacgagggccccgggcggacgccgcagagcgccgaggaggcuuuccugcugguggcaaccgccuacgagacacucaaggugaggccugcgggcguggaggggcuucgaagacuggccgcgggaagcccacggcgccuuccgaccccgguccgcggagcgugggccucugugaccccgaaacugagcacagccaccaccgcgaccuuuaagauacucacguuucccacguggcccugugaaagagccgagucggccccacggggccuuggggggcacagcuagccuccuugcccucuuccuuuuugugacauuguuaugcaaaacuuuggccaucuuacgauuucgugaaaauauuuuaauaacgugcauuucacauucgaaaagcagggugaucauuauuaguaggaucugggguagcccacaacagggaaagucucgaauaucaagugacaacugugaucgcaucaguuugauaugacagaaaauugguuucuggaaauaguguuaauggugacgcuuaguuuggguuuaaggaacuaagaaaacacugagaagaacaaugaacaccagucaaaaggcuggaugugagucuuugcugugacaccccuguaugaccuuggauagugacuuauuauguugaaauagcuguuucuucauaugcaaaauuaaggccaugauaccuccucucagaguuauuauggggauuaaaugauaagugugcgaaccgccccccuuuccauaggauccauaaauaggugcuuaaugacuuggguacaaaacucugagaauuucuaguaggaaauauuuugugaauauguauuuguauuucauuugacagguuuuauugagucuuguggggaugagagauuuagcccgaugcuguuuucuucuacuacugcaaaaaaucaaaccaucuaggacaucacgaaguauaaaucguacuugauggugguauuacugcuugaagggccccaucauacuaaugcgucagcgauuguaguuguaaaguauuucuuuucuagccuuuuuuuuuuuuucccgaggcaaaauuuucuauguugccagguagccugcuuuuaaugauuguacuuugaguggauauaauuuuaccuuggauuguuccuccagauuguuuuuccagagcugaaaauagucaaggagcuaacaacuuuauugaugccuuccagagcaguuuggauaauuuggagucauaaaaugagugguggaggggcgggcccugaacuagguaaacuaggugaauugaacuagguaaaauuuaauuuaccuaguucauuaaauucucacuagcguuagugagauuguaauuuuuauuggcaguuaacugagggauggcuggggaacugggaaagugcugaggccccaaagggcuuuguugccgauuauguaaaaagugauggaaaaaagacuccagaaaaaauaggaaagaacucuccauccaaggcacuucagcauaugaagcuccaaccucuguuccuuguagucagccagaagcccugcuggugcgugagggagcccuggaccagugugugaaaucauaaugggauuuacuagggauaguaaaauugauaggauuagggauguuaaucauguuaauuuguuucaggcgcgagaugguaauaagguuguggugcuugaauuuagguugagugucaggaaugcaguaguuguuaggaugauauagauaauuagguuaaagauagugauauuuggauuguauaucaguuaucccauuaugauuucacacacugcuuuauaaacuaagaccaugcaauaguauuuaguguguuugacuuuuggggauuuagggaguuuauggacuuuggaaguuaaacaaguggacgcuuacccucugugucaacccaucuucuggaagauggagaacuuccagaagagagggcagcagaaacacugccagcuguugccuucugcugggcuuuguaggaguggagaugaguaguuuuggcaugagaauggugagcauguugguaagaacuuugaaaacaagugccaugauuagaggguagaaauagugaugguagagauuccugcugggagggccaccaggagagacugaucagugcccccaucccggaacugaucugaugaaucuauaugguugccucuaaagguuucuaccccuaaaguuuaccacucauugucagcuaaugaaaagcuagauaaaauaagugauccacucaagaucaaggaacguuuaggcaguuaaagaccaguaugucuggaguagguaacacuuguacucuugacucugacggguuugugauagcuacaaauaucuuggaacaggggaguggaaguggaguuguacugguggaggagggaaugaggggaguguucuguagcucccccagaacgcccacugucuuacuguggaaauuaucugugagacaaaagggaugucuggagauauuuuggacccuggaaaaucagacccagcagaacucuuugaaaacuugcauuuuaaauuuauggagaugaacauauauucaucuuccaaguggagcaccuccaagaacuauuuaccucauugaagaugcucucucuuggaauaaggauaaggacuuugacuugcugucugugggagcaauuauuacaggguggucugcuuuaacuucugucauaacggagaauugugaggaaguugccaaagaauauguuuucuggguaaugcaagguuuuaaugaacugaggucauccaauuuggagggcuucagccuugcacauuauccguugaggcaauggagauguaauggcuguuuguuuggauuguauccuccggcuguaaaaaggguuugugaaggauaaaagguccagguggcguuugcuaagagcaggucagauagaauagugggagaagcugaguuccaguggcucuggaauaaaaacgggaugcagaagccuguaucugaauguugauaauaaaugcaucaccaaaauggaaacuauaauuauguaaaacaucaguggauuuaugauucugaggugguuuuggucaaauaaaugcccuuuugaggggguuuuguuuuuuuuuuuaggugguggugguuaaaaaauaaguacacuaacaugacuuaaauacaguugguaagacaagaagauaugacauuugaucaucacuauuuuagcaaaaagauuuuaccugugcauggagaaauggaggaaaaccaaaaaaaaagaaguguggguaauaauggaaggcaaaggcacuggccucaugcuuucaccaagucaugcuuaguucagauucccaaauaaauuacaguuccagaucucagcaaaacuucaaaccauuaugauuucacacacugcuuuauaaacuaagaccaugcaguuguauuuaguguguuugacuuuuggggauuuagggaguuuauggacuuuggaaguuaaacaaguggacacuuacccucugugucaacauuggaucucaugagguagaauaaucuggucccacuuacauguuuuuaaaguggcuauagcacuuaucacacugcauuuaaguacugaguaggucucucuuuccuacuaaaccaugcuccucauuuuuugugcguauauccauagcaccuagcacagugucuggcacaucagagcauuaauguuauaaaaacucuuaucuggaggcauucagauagaauggaaauggaaaguggauuucuggcauuuugacauugguaugugcaacgcccucugccauuucacucaaauuaauugcaguuuuaaagagugguauagauaaguaaauuggacgguuaugagugaaaaauuccugcaugagagaaaaauugcacuucuacuuuuaauguucugaggguuuuuaagugagaaugauaauuuuugaauguagauaaaaauuggauaauacaugaaauaugagaaauggcauagaaauaagcagaugagagaacaacuugaaaggaugcacuuagaaaaacuaugauugguaaaaaaugcaaaagcguagaauuugauggcauuuugcaggaucacaagaaaagagccuagaaaaggucuugggaauauuucuggcaugaaggugaaggcuauuugauaaguugaaaggauguguagagaggucauucuacuccagacuugucuuggaagggaagcguuacaacaacacuucaguuuccuuuuaccagucugauguggcagggcuuuagcacuuaggaagaauuuagcaaaaaacgauucugaacucccugcccuguuacguuucuguuuauuguucguuccuuauauucucuuacucaaccccuucuuuaacugggacugacauaggggcuuggaggagaccauaacaaaggaaaagacacaguuucugacuuaaaguuuuuaauaacaagggaaacagauacuuauuguucaguuauuauauaaguuauauaauacaagucugugcagauuauauugcugugcugagaggaagugauuaugucuucuuggauuagagaagaauguacccuuugaguugaucaggaacgaagucaccaagguugauggugaaaggacauuucugguagaggggaaacuugaucaacagaaacauagagucaugagugugcaaggcuuguuccaggaaugagauguaguuucaugagguauuauaguaaugagcauuuucuccaccaaggaucaguuuuaugguauuugucccagggacucuguuuuggggaaaaaaugaacugcauguauuacuauucuuuuucaacauuucccagauuguauuuaaucagucauucauaguaaucgaauaaucauaaaaauauuuuauaauuauauaaauugcuuucuuuuuugagacagggucucacuguguugcccaggcuggucuugaaauccuaugcucaagcaguccuccugccucagucucccaaauagcugcgauuacuggcacaugcaccgaacccuaaaauuauauaaauuucuauuuuaggugugaugcugauaaacaaccaaauuaaguuaauuuauaguccacagauggcauauaguuuccauuucauaugccaauccugauuggucaugauuaccuggaacaaaacucuuaccuuuuaagaguuuugagaccuuuucuggguuuagugggaaagaguaacauauuugauaguaauguuucccauggcccuggaaaaaugaugugguaguguauguaccacauuuacuauuucugcugugaacccguaaauguuaguuuuuacugguucguuaauuucagugguuacucccuacuuauggccaagggugauuauauacuagcuguguuugauccuggugccaugacuggcugacaugauguaaucaacaaccaaucagaguucuuaaucaaccugaaaacuacugacuugauauaauacuagccagaaacugaguacuagacauuuuaauuuagcuuguacagauuuaucguagguaaauggaacauuuugagauauucacaggagugcaaagacccuuacuguuuuucauagacuuuaggggaucugcuauuucuagguugggagccugcgaggugccgugggagggagaauguugcaggauacuggaacauaguuugggaucagaugaugaaggaccccuuaaguuguguucaggaaucggaacuuuauguauugaauaguuaccagaaguuuuaaaguggagaaaugacacaaucuuacguuuguuuuaggaagaaaacucugggagcaauuuugagaaugguuuggggagggcaaaaagguauucuugacugaacucauuuuacuuacacugucuucuucugucauucuucuucuggaaucuucuucugucauuccucuuuggcaacuugaaaaucuccuacuugguucauuucccacuccuuucgcuucauuuugcuuccuuuaaaacuacacuuacauuuuuuccuuucuuugguguucacugucuuuacuuucucaucucccuuucauucaagcugucauagacuggcgugugcagcagcacauguguuggaacuguucuuguugaggugaacagugacacucuacucaccagaucugaucagauugacugcucuucauuucuuccuccuccuggaacuuugugucaugugauauugcugaccauuucguucuuuaagguguucuucccugacuuccuugacgugaucuuugucuguuucuccuguccucgccauuucuuuucagucuuuaucgucuuuucuacuaucuaccccuuaagcauugcuauucuguugaguucuccuuuguguacucuuuucuuuuuuauuuucuaagcucuuccugaugaaacucaacuguauccuugaccuaagccacugcuuuuaagcugacagcucuaaaaccugcauguucuccaggcucauauuuucagcugccucuccucuguagcacagguacccgcaauuaaacaugucugaaaucagucuuaucuuugugaaagcauaaacuucaaaagaagauauaauuaugacucucacaaauacagaaugaacaugugucagagauuuuauuuaacauauuaaucaaugagggaaccaguaagauacuaaaacuaguugaaagagaaaaagugccaacauuuuuaaucagauagggaaugcugaaaugccuguaaaacuggaaaauaccuaccaagcaauaauguguugcauuccacggacauaauuugucuuucugugaauaggagucauuugcauuauuuccaguuuucuacaaguuacuucugucucuagaguuaaaauagguuagucaaagacaaaggugcacuccucugcaggaauagauaauccuugaggauccagaaauugaaaggauagcuaguaauuuuuuuucuuccuaguucaaaaucuuccacaaguuuuccuugcaucuucuccaaacuugcuguuuuuuuuccuguauucauuaucuuagugaguaacauugucuacguaguaacucuaauuaaaaacuuugguaucauguucaacaucuccuuugauucuuguguaccccuuuacuuaccaaguccuauucuuuuucuuagcugcuaaaaucuguuucucccucauucgacuuuuugcaauacugccagaauugucuuucagaaauauauacuucuacauaaugcuauuguucucauacuuggaaacauuuuuguuuuugaauagcacaguugauaacauccuaacucuuuggugcagcauacaagauccucaacaguccuuauccaaacuugccuuccuagcuauauuuacuacucguuucuuccuaaauuuccccaaugcucaagcuucccugaauccaugauauuuuuugauacuuuuauacccuuaacacuugcuguuuccuuugccugaaacaaguuucauuauaccuuacuuguuuccgagauccagcccccauuucccuucuguugugaaucccauugcuaguguuuuuagacagucagccccuuguuccuuagcacacucaguugugcuuuucuugcuugcuagauucuucuucuagauggaggguucuugaggccacggaccugucuugucuuuuauucucuuuuugugcucaauacaaggccuaaugcccugcaucaucauuuuugaaaugaaaacaacuaaaguuuuuaaaagcucaagugacuaaguagaugcugauaguauuaacugauacacagagggauagauugguuuuugagcauguugaguuugagauauuuauguugcauuuagaaaauguucaggacauaguugagaauaggaggaggcaagaaaaacaguuacaagcauuacuaguauguagguaauauuccaaaucauggaaguuuuugagacuaugugcagaaugagaagagaagauagagaagaagauaaguugcacuagugacuagugggcaggaaacaagaaaaaaaugaaauggguagcaguuaauuuucucccucuuuuauaggauauaauggccuggaaaaaaauuuagacuagagguuguuuuuuuuuuuugaaggaucauuucaaaaaaauguguguguguguguguauggguguguguguguggauuuaaaaaaaaauaguaagauuaauauauauugagugaauacaguaauacauuuucauauaucauugauuccugaccuucaccaccccaaagaugguuuuuauacucuauguaauagaaaguuuuaaauguaaaacuaggacacucagugggagucacuuuaaaggcaaggaggagcucucccucucccucucccucucccucucccucuccgucuccgucuccgucuccgucuccgucuccccauggucucccucucaugcggagccgaagcuggacuguacugcugccaucucggcucacugcaaccucccugccugauucuccugccucagucugccgaaugccugcgauugcaggcacgcgccgccacgccugauugguuuugguggagacgggguuucgcuguguuggccgggccggucuccagccccuaaccgcgagugauccgccaaccucggccucccgaggugccgggauugcagauggagucucguucacucagugcucaauggugcccaggcuggagugcaguggcgugaucucggcucacuacaaccuacaccucccagccgccugccuuggccucccaaagugccgagauugcagccucugcccggccgccaccccgucugggaagugaggagcgucucugccuggccgcccaucgucugggaugugaggagccccucugcccggcugcccagucuggaaagugaggagcgucuccgcccggccgccaucccaucuaggaagugaggagcgccucuucccagccgccaucacaucuaggaagugaggagcgucucugcccggccgcccaucgucugagauguggggagcgccucugccccgccgccccaucugggaugugaggagcgccucugcccggccgagaccccgucugggaggugaggagcgucucugcccggccgccccgucugagaagugaggagacccucugccuggcaaccaccccgucugagaagugaggagccccuccgcccggcagcugccccgucugagaagugaggagccucuccgcccagcagccaccccaucugggaagugaggagcgucuccgcccggcagccaccccguccgggagggagguggggggggccagccccccgcccggccagccgccccauccgggagggagguggggggucagcccccccgcccggccagccgugccguccggccagccgugccguccgggagggaggugggggggucagccccccgccuggccagccgugccguccgggagggaggugggggggucagccccgcgcccggccagccgccccguccgggaggugaggggcgccucugcccggccgccccuacugggaagugaggagccccucagccuggccagccaccccguccgggagggagaugggggggucagcccccccacccggccagccgccccauccgggagggaggugggggggucagccccccgccuggccagccgccccguccgggagggaggugggggggucagcccuccccccggccagccgccccgucugggaggugaggggcgccucugcccggccgccccuacugggaagugaggagccccucugcccggccagccgccccauccgggagggaggugggggggucagccccccgcccggccagccgcccugucugggagggaggugggggggucagcccuccgcccggccagccgccccgucugggaggugaggggugccucugcccggccgccccuacugggaagugaggagccccucugcccggccagccgcccgguccgggagggaggugggggggucggaccccgcccggccagccgccccauccgggagggaggugggggggucggccccccgcccggccagccgccccguccgggagggaggugggggggucagccccccgcccggccagccgccccguccgggagggagguggggggggggucagccccccugcccggccagccaccccguccgggaggugaggggcgccucugcccggccgccccuacugggaagugaggagccccucugcccggccagccgccccguccgggagggagguggggggggucagcccccccgcccggccagccgccccguccgggaggugaggggcgccucugcccggccgccccuacugggaagugaggagccccucugcccagccagccgccccguccgggagggaggugggggguucagccccccgcccggccagccgccccguccgggagggagguggggggggucagccccccugcccggccagccgccccguccgggaggugaggggcgccucugcccggccgccccuacugggaagugaggagccccucugcccggccaccaccccgucugggaggugugcccaauagcucauugagaacgggccaggaugacaauggcggcuuuguggaauagaaaggcgggaaagguggggaaaagauugagagaucggaugguugccgugucuguguggaaggaaguagacaugggagacuuuucauuuuguucugcacuaagaaaaauuccucugccuugggauccuguugaucugugaccuuacccccaacccugugcucucugaaacaugugcuguguccacucagaguuaaauggauuaagggcggugcaagaugugcuuuguuaaacagaugcuugaaggcagcaugcucguuaagagucaucaccaaucccuaaucucaaguaaccagggacacaaacacugcggaaggccgcaggguccucugccuaggaaaaccagagaccuuuguucacuuguuuaucugcugaccuucccuccacuauugucccaugacccugccaaaucccccucugugagaaacacccaagaauuaucaauaaauaaauaaauaaauaaauaaauaaauaaauaaauaaaaaauaaauguaaaacuagcugcaauaucaaauuauuacaauuuauguacugagaucaaacaauucaugauuuccuucaagggcaggaacauaauauauuuuugccucuggggaggggggaugacccuuuaagagaaggaaggauucaguacuuucuuugcuuguggguuuccucuuguucacuuuugaucuagauauugguuauguuccaguccuccugcauaugcccaagaggauugggaguggaauggacaccagcagaagcaccacaguuauuccuguagagauuagaaacaaggagcuuauugcccugcuugucaaggcucaggacagacaggaggaagaaacaaguauaaagguuuugguuuuggaaagaaguuggaaucuccagacccugggaccuuaagauccacaaaauugcugaaagaaaaaguacuaccuuauugaaagguaagauauuaaacuguuuuaagguuuaagcuauguuagccacaguagcauauuuucauaaacuaugaauucaagcagucacuucugccaaacugaaguuuuuaugacaucgccacccauccagccuugcuggugagauggagaccuauguaguggagagaugcauauugcaaggaaaaaccuucacaaaaguucacucguuuuugaaauaauguuuacugaaugccaggcacuguacuaggccuuggaguuacccuaccuacuuuccagaacuucucauucuaagaaaagaaaaaaacugaugauuacaaugugauaagugcuauaauaaauagguaccaaguguaauaagaacgauccaacugucuggggcaguaauguuuacauucuaaaggauuaauaggacucaugagguucaaauuagagagaaauagacauuugaagacauagguaugaaaaggaacauuguguuggaauaacacaccaaauuccagaaauugcugucugaauguuugcuauggguaaaagaggggaaacugauaagggauguugcuagguagguaaguuuggaccaguugugaaggccugguggcaugcaaaggaaauuuuaacuuuggccaugggaaagcacuggagauuaaaaaaaaaaaaaaaauuguguggcuaccuuaguucaagaugaguacgaaaaaaauaagaauguaccuuagcuuucuacuugagucccagaaggaugguccuucuuauuaugucuuuucuuugcuaauauucuugguauccucuuguucuuacuagguugauucuaaacuuuguagguuacuaaagagcagaauuuugacuuaggcuguugagaacuccuaaguuuuaccuauuugugcugcucuugauucuaaaguauaugcaugccucacugaucaucaucaguaugcaugaaaacugaucauuuucuucauuuuggagagaaagcuuuaagcccuagaauggagauaaaauaaguugaauaaaugcuguaacgaggaaguggccaacuuuuuagucuaaucauggccaaaacagggucauaaauuuguggugacccuaaagaaaagaaaaccauccaaagagaagucagacuugacccugagaugucuugcaggaauuugguaguuugaggacuccauuaggggaccuugaacagauugcacaggcucugcuugcaguagagaggccagacacaagguauaaauuuuggaguugcuuguguuggagcauuaguugaccauuguguuaaaggaauucaggacuugguaaagucaauaaucuagaaaccagugagaaaauggugacccuggugaaagaucugagugaaauguuugaagagggaugauaucuacguucuguagaacagagauaagagaacaaaaagagaagauagucacuggacacaugauguccgcuuaccagauuucaacgacacuccaagaccuuacuccauauacuucaaccaggaggagugcagacagccggggcaaagggcugcacagagacaaugaggcucauaggagucugaucuccguguggcauuucguuuaaaagcuacauguaaucuaguuguagcaagaagaauuguacuugaagaaauacguuucaaaaggcaucugucaugauugggaugccgaguuaaagucaaggauuuaaggcgccaaaacggcauuucuauaaaauuagcccaaaaagcagagggagaaugggaaaauucucagaugauuucuugagguacucaaaaggagacacaugaagagacacaggcuuuagucuucagcgcugucugugugauccuuauauagguuuacccuuucuagguuaggagcucuggaauaggaugaugacuuaaagaaggagucacggauugacaguugaggcauauagcagcugccacaagaaaauccuuuuugacugaagagaacauacaaggagugaaucugaaaauaauacuagcuugagcucacaccucguuguauaacugagaguuuucauauuggcccuccauauaaauauauucguaucuaauuaagcuagcuacuaguuuacaucguuucauauacuggugagagguaagaaauuguuugaauguaaugaauaugggagaacuuacugagaaugaucucacacagauucaaaauuuuuuuuuuuuuuuuggagacagagucucgcucugucgcccaggcuggagugcagugguacagucucggcucacugcaaccuccaccucccagguucaagugauucucuugccucagccucccgaguagcugggauuauaagcacaagccaccacgacuggcuaauuuuuguauuuucaguagaaaugggauuuugccauguuggccaggcuggucucgaacuccugaccucaaguuaccugccugccuuggccucccaaagugcugggauuacaggagugagcgccugugcccggcccaaaauucuuaauagaaaauacguaaugauuuuaauggauacaagcaagauuuagucauuaacaaauuucuuacuuuaaaucuaaaaaacuacauguuggaggacucagaaggugauccuaaacagaccccagagaaucugucugcaguagcaaggcacuaaguuuagauuuugaaaugccuuuagcuaggaaucugcaguuaauaaauguugaauaauucauuccucuaagauaaaaaaaacuuuuuuuuuuggagacaggguuuugcugucuugcccagacuggagugugauggcaugaucacauaagugauuucccaccuggggaacauccugggaagcugggacuauaggcacaugccaccaugcccugugcaaauacaauuuuuuuuauuuuuuguaaagacaaggucucacuaugcugcccaggcugaucucagacuccugggcugaagcaauccucccgccuuggccuuccaaaguguugggauuacaggcaugagucaccacaccuggcaaaacagacuuuuguuuuuguaaugguuuuuauuauacucauauauagagauuaaauaauuuguuuugauuuuauaauaguuuuuaucuuuaauuuuuuugaaaauggggcaaguuggaaaauguaauagguuuccugugagauaaagaacaaaucgugaccugguuuaauaacucugcaaccugcauagcucaguacaacauugcauuuaucccuguuagaaauugauuagaaucagagaauauauuuuuuuaaauguuuuaucugugaacauacagagcagcauuuuggaaugcuauaauucuuucaaggaguugguaucgguaaggaagaucuauauguuaccucauuugugaccugggcuggacaacauauuauagugaugaaguacuacauguuuguaacauguuuuuguauaauguuuguuauuugauauucacaacaacagggauuguuagcucuuuuugugaaugaagaaggaggaggcucagagaggcuaaauauuuuaucuaaggucauaaagcuagacuuugaccguugggcugcaugggugucucaguguuucuuugggaugggcauaauucaguuuuguaggcacagacuggcuucaccuaguuuuugcuuuuagcagaaaacuaucuauacaaggcugggacgugauugugaauauauacaagaaauaagcauuaaaaaaaaaucaacaguuaagaguaguugugaacaggcuuuuauuagcaccaagcaucagcuaaaaaggcugaaugguuaauaaguguuuuuauuuuuccaggaggacuaacaauacucaagaacuuagagaaguauuuuuguuaugcuuuuauaucuaacauugaaguucugaaaauuuacauggcuuugaagagcaaugggaaauuuuuugauuuugacaauuucaguauuuuuacucagauuaaccuuacauaauuauaaaauucuauaugugauuuaacagauuauaaacuaaggccauuuaauggacuguccuaugaaguuggauaucuugucauuuuacaggaugaagaaacacgaaaagauuaugauuacaugcuggaucauccagaagaguacuacagccauuacuaccacuacuauagcaggcgcuuggccccuaagguggauguuagaguagugauuuuggucagcgugugugcuauuucgguguuucagguauguaucaauggauauuuuuaucuacauuuaugugcauugagugcacauugccuagugcuagucauuaaaaccuaacugcgaguaucuucuuguaaaauuuuacuucuaguugagaucuguuuuagucauuggcaauguuggaaucuuugucaguggcaaaucuaagaaauuguugaagaaugucauuacuacuacaaaacaaccccucaaaaauccagacccuuuuucauuguucccucuggaguauuuucuacauaauagccagagugaacgucagcuaauucauaucauuuaccucuguaggacuuuuccaugacuuaccauuaaacuugggagaaaucugaauuccuuaaccuggccuaacaaguccuggcaccagucaccaaaugccaguagugcuugccaucauuauuguaacaaccagaaaugucccaugcauuucugugugccccuuuaagggugcuucugcucagguugaaaaccacugaaauagauuaaaagaggcauaggaacuuucuguuuuuguuuuuguuuugagacagagucucguucuguugccaggcuggagugcaguggcacaauuucggcucacugcaaccuccgccuccuggguucaagcgauuccccugccucagccuccugaguagcugggacuacaggcgcgcaccaccacacccggcuaguguuuuguauuuuaguagagacgggguuucaccauguuggccaggauggucucaaacuccugaccucgugauccuccugccucggccuuccaaagugcuggaauuacaggcgugagccacugugcccggccaggaacuuuuuauguuguaaaguaucacaaaaauuuaacuucugccugaaauaaguuuucccuguuauuaaacuagccauuccuaucacaugcuccuuuaaaggaaaugaacaagucaaaugacuagaaugaagcaaucugcuuguuugaaaauuacuucuccaguuucauucccagaaacgauucaguuuuuuuuuuuuuuagagauggagucucacucugucacccagacuggagugcaguggagugaucaugacucacuguagccuugacuucuugggcucaggcgauccucccaccucagccuccugcauagcugggacuacaggcaugugccaccacaccuggcuaauuuuuguauuuuuuuuuuuuugguagagacacgguuuugccguguugcccaggcuggucucgagcuccugggcucaagcaauccacucaccgcagccucucaaagugcugggauuacaggcaugagccccugcacuuggccgacauucaauuuuuaugaauaaaaacuacauuggaaacuaaggugguauguuuaaaaugugucagcauuuguagaacgauuuacccuuucaaaggggagagcagggauaauuuuacuuuuuuguuuuaaacaaucuaauacuguaguaacuuuuaaaaaaauauucuuaauagauugcuacuauugcaggguauuauuuguaugucugcuauauucauucaguuaaucaggagcugaaauuuauggagguacuaugugaggagcagggcauuuucugacaaaugcuuuaugguugaauacauuuaugaaguaaguuaauguucuccuguccaaauagguagaguucaaccauauuugagucucgcaucagaauaggaugagugccacugugauauaugcagauuggcuuaggaaaagagaugggaaugaauguaguugccugagucuauacacuaugaguuuuuuaaacaaauuccucaccagcuagauuuugccauuuaacucuuucucuaguaaguagguugcuguuuaaaaaaaaagaaaaaaaauuuuuuaaagugaucuagggaagagccaaaugguaaagauacgaaccacaggugugguaugauacauugauuagccuuugaccuugggucacugacugcagcagugauuuuuggcucagcucagaguuuaccuuacuuauccagccuucagauccuguguacgcaugggcuucguucaguugugucuuuuacuuacaaaguaagaucuuugagaucccuauuuuuaauuguaaugguuucuugggagaugguauucaccgagacucuaucauuccuuuaauuuagaugaauuuggguaaugaaaaugacucauuguucucuguuaauuauucuaguuuuucagcugguggaauagcuacaauaaggcaaucagcuaccuagccacagugcccaaguaccguauccaagcuacagagauugccaagcagcagggacugcucaaaaaagccaaagaaaaaggcaaaaacaaaaaguccaaagaagaaauucgugacgaggaggagaacaucauaaagaacauuauaaaaaguaaaauagauauaaaggggggcuaucagaaaccccaaaucugugaucuucuccuguuucaaauuaucuuagcuccuuuucaccuaugcucauauauaguuugguauugucgguggaucuauaauuuuaacaucaaaggcaaagaauauggagaggaagagagauuauacauuauacguaaaucuaugaagaugucaaagucucaauuugauagucuagaagaucaucagaaagaaacuuuucuuaaacgagagcucuggaucaaggagaauuaugaggugaguagucacccugcugugauuuaagugucauccaccugaccaaguuaaaaucagguguauuauaaugagggaucacagaagugugcucacauuucugaaauccuagaguuaaacaauuaguaaagaccuuuuauugaaaguaggacucuauuugguagugagacgguggguuuuuaaccuguaauuucucuuuuuagaggaugaacuucaaauacuuuaaucaacaaauuaugaaaacguuuuaagaauguuaaacugcauuggaaugauaugcauguuugcaaggguguuacaacaacuuuuggguaacugcacuaaaauuuggcccuucccaaguuuucuuccaauacuguaaaccuagccacagagacuuaaaaaaaaaaaaaaacaacagaguaagacguggaaauuuuguugagaugacuucauuucaaaauaauugagcacaagauauucugcguaauaacugacaucuauagaaaguuacuuuuguuuuacuuuuaaauuaaaucgaauuacuguaaugccucuaaacuuucaggcauuuuaauaaaugcuuuaugcuacaguugucaccuacaaaaauuacuucgaggugauccgcuaccuagccaucauguuaaagggauuagcagucucauuaucauaaugacacuguuuuagauucaggauaaaauucauuggcuauuauguuaaauauaagaauagagcacagugaaaccuuuuuguuuucuuucuuauuuuuaucauauaguguugggguuuugccauguugucuaggauggucucaaacuccugagcucaagcaaucugcccaccuugaccuccuagagugcugggauuacaggcaucagccacugcacccagccaaaaccugcuuaagaagucugagauacauuaguuuuuuuaguuucauagucauuucauuuuguaugugauguccuaaauagauuucacugaaauuaaaguuuuggucugaauuauauuuauguaaauuaacuuacugugaauugcccgauguuuuaccaaguauaccuguucauaaaaguguuauuuagggcugggugugguggcucacacuuguaaucccagcauuuugggaggucgaggcagguggaucacuugagaucaggaguucaagaccagccuggccaacauagugaaacccugucucaaaauacaaaaaaauuagcugggccugguggugcgugcauguaauccuagcuacucgggaggcugaggcaggagaaucacucgaaccagggaggcagagguugcagugagccaagauuguaccacugcacucuggccugagcaacagagugagacucuaucucaaaaaaaaaaaaaaaaaaaaaauguuauuuaguuacagcguaccaguuagccaguuagcuccuaaacuauuugaaaagcuuguucuuuuaaguacuuuuuuaaaaguuuaaaaguuuucuuuuuuaagaagguaaagcagcucaaucugcaaaacugugucuuucuuagggugcuauuguggggugaauuauauguuauuguaugaaguugucuuagucuuuacuuccuaauauuuggaaguaaaauaauuucuuuccaaaauuugauguggcugugaaacuggcuaagacagcuuguucauuuugcuuuaguugacagcauuaaaaguuacagaauugcaggcuaggugcgguggcucaugccuguaaucccagcacuuugggaggcccaggcaggcagauugcuugagcucaggaguucgagaccagccugggcaacauggcgaaacccugucucuaccaagaaaauacaaaaaauuaacugggcgugguggugccugugguccuagcuacucggagguuacagugagccaagauugugccacuguauuccagccuggaugacagagugagaccccaucucaaaaaaaaaaaaaaaaaaguugcauaaaugcagauguucuguguucucacaaguuuuaacucugugguuuauuuaaccuucuuuggaaacuuuaauuuaaaaaaaugaaaaauucauaauuagaugaaaguagguguaaguucaguuuggagauaaacauguauguaaggucauuuuguuccuugguuaagaucaccaaaucugaaagucaucaguuaaauuuacaaagacuauauuaaaaaaauaaaguuuugauucuuuaauauuagacauuaguuguagagaggaaauguuaagcccuuuaaacucagucaauuuucauugaggaaaagaauguauuccuagguuacagaaaucagugacaaaaaauuacuaguucuaggcagggugcaguggcucacgccuguaaucccaacacuuugggaggccgagguagguggaucacuugaggccaggaguuugagaccagccuggccaacauggugaaaccccaucuguccuaaaaaaaaaaauacaaaaaaauuagccgggcgugguggcaugcuccuguaggcccagcuagggaggcugaggcaggagaauugcuugaauccaggaggcagagauugcagugagcugagaucacaccacugcacuccagccuaggcaaccaagagagacccugucucaaaaaaaaaaaaaaaaaaaguacuaguucuuuuuuuuuaaauuugagauggaguuucacucuuguugcccaggcuggagugcaauggcaugaucucagcucacugcaaccuccgccucccagguucaagcaguucuccugccucagccucccaaguagcugggauuauaggcaugugccaccacgcccagcuaauuuuuucuauuuuuuuuaggagagacggggguuucaccauguuggccaggcugguuuugaacuccugaccucaggugauccacccgccuuggccucccaaugugcugggauuacaggugugagccaccacgcccggccacaaaauuacuaguucuuauacagguuguucuuucauguuuaacacugaauguuaaaaugguaaauugcaaauaaauaaauaaauaaauaaauaaaaugcuuaauuguuuaguauuuuaggugaaugguuaucaauacauucacuggaaacuuuuuaccuaacauuauguuagaaaaauguaaauaugccauaaagcuaauggcaaauguuccucuuuggauugugaagucaucuaguuauuuauacuuacaggucuacaagcaagaacaagaggaagaauuaaagaaaaaguuggcaaaugaccccagauggaagagauacaggagauggaugaagaaugaagggccugggcgguuaacauuuguggaugacugaagauugauggaaugcuacuaugccaaaccuuaauugugauauuauuuucauaacugaauuauuuuagaaauguaucaauugacugcugcucagcaguaacuaaaauuccucaaguauuugauuaaacagaauaaugucaaaauuuaaaccuucccuuaaaacuuuauacauaagacauuuaugauuguucaauuuuuauaaucuauuuguggauuuuguuaaaagauuucacaugaagauuuauuaguugccauuuaaaauuuuuauauguuuaguuaaaagauuugacaugaaaauuuauuagauaccauuuaaaaauuuuauguguuauguguuuauucuuugagaauguuaccuuacuguuuguaauagugcuacauuuuucugcuuucauggccucuguauuuucacaaaacaccaaaaacagcauuuaauuauauuaucaugaguguguuucuggacacaaacuucugcaguagaaugaccuaacaugucguuuucauugcagucauuauaggauugaaauacguucaaaauaaccucucuaggaaagucuucugcuagaauuucuccccucuauucauuauaauauucuuuguuuuuaaagccagucaaauauaauagucuuaauaagaucagaaacucuccaggagagugagucuacccucacguccuuguaggaugaucuugauuauagucuuauuauaggacuauaacuguauucucaacauuucuccagaaaggaccuuguaaaaaggucuuuuguaccacaguauu

SEQ ID NO: 13982 - RNA, 1027 nt, Homo sapiens
uacaaugaauuuuucauauaaauucaauacuagacgguuaggucgaaaugcacucagauacuuaaauuguauacaaauuccaguccgggcagccucuuucaccucauucaucgucccagccacaccuauggggcuggugucggucccagcggucgacuccagcgccgggcugccagaggcuggucccuggacgugucaucuacagccucgcgcacccggggcaauuccaccucguuucugggguccuugugggacauuccuuccuacucuugggagucagguccccauagcuuuuccugccggcagagggaggcauucaaaccuggcaggcccggucugcgaagccggaaggcccgcggggccgcgggagggcgggcggggugcgcggcggagcgggaagcacaaggcgcgcgcucccgcgaacgcaggagggaggcugggggcgcgcgcgcgcgccgggccgaggggccgagaggcggggucuuacagcgaccgcgggaagagggcgccccagagcugagccggaggccggcugccagcggggcgagggugggcgcgagcgcaggggcgggccccgagggagggcggggacggugagggggcggggucgggcuaggcggggacgcgcucgcgggguggggaaggcgggggcgcggcgguggcgggagcgugcccgguccccgccccuguucccacucuccuuccaccucggaccggccggggcuccgcagagccaaagcucgcuuguccccggaaccgcccugcugccgccgccugcuuccucugcucgcgguuagcccgucagucccugcucugugcgcgccuccaucugggccauggauggguaaguacuaggcggcgcggcggccgcaccggguugccuuggcgccgcuuccacccggcucuccgcgggacgcguaagggcuggggagcagugcgcggcgccggcggccggaggagcggccccggccaagcccgacggcggggcuuccgggcgucucgguggggaucccggaaucgcggaguu

SEQ ID NO: 13983 - RNA, 1803 nt, Homo sapiens
guaacaaauugccuguaagaaaaccaaagagcaucuggcuucagacuucugcucuauagcaccaaaugccaggaaacaauagagaauugugagggggaaaaguugugacuuuggaauuuuauacauauuuuauauguuaagauacauaauuuuuuaguuaugauaaccauccaggaaauauaugagcuauguaauagucuuacaaagauaauaaguuguacagcaaccuacgaggcuugauuuaaauaaaacaauguuugcuuaguauccuaauuucagugggcucugggcuauuaaauaccaggacauuauccacuagaggaaggguauguaugcuuuuaaauagauaauauggcuagaagcuacauaucuaaaagcacccgaaguccucauaugaauaggcuaaauuaauacaauaagguguaauaaaugccauaccacagcaucauguuucuucauuuuuauuaccgaaauaauguauaaauugcucuugauuuuccccaccaucauuuaaaacacucuauccugaaagaguccacugcuuccaagugagaaaagccaaggaguccccugcguuggggguguaauaaccuagacuagagcuuauagacugaagcccaugugcuucuccaugcucaaacgcagaacuaaaaauggguauaaagucagaaaauugcagaauauaagucuguguuucaaaaagcaaucaggaaaaaacaaacaaaaaacuuguuuuagaauacaaaugcaagaaaaguucaauuucaacagcagaaagauggccuggggcagugagaugcuuuccuuagcuguacuugaaguuuuauggaacgccauuuaaauucagacaucaagggaaugaaugcaguuuuaaaaauccgaauuauuucuggagucuacaaugucaguguuagaacuaaugcuggguuguuuuguuuuuucauuugcuugcacuggaaggccuugaaaacacacaggaguguagaguaucgucagcucugaugcucaguuucuuccuggcaauagaaugguuuuaucugugccccaagcuuuugccaauuuaaacucuaaacuaaauuuucaaugacaccagcauguuugcuuuaaauuuagcaauagaauaggcaauggacugcuuugcauuuccuuaguuuuucauucugaaacagagcaaaacaucuucccaaagagauggagacaaucucuucuggguagauuccaaguauaaccugucccaggguccucuugcucagcugugacuaacaaaagucuguucaauuuaacuacuuagauaagaagcgcaaugcuuuuauuuaaaaauuuaauauuuucuauggggcuguauuuuccaaauaauagcaacaaaacuguccuaacguuuucacuguucuguaauuuuguuuuaauauagaggauacccauaauuucuuaacacuggaaacaucauucugaacgauguaggaagcggucaguaacgugaaugauguuauuguaccgucuccagcuuuuuccuucuucccccagauggucgcaccugugcauacaucccugugcaugugggggcacaugagugggaaagugggugucacuccuauuuucuguccuagagugucagcguuggaagggauuuuuuuuuguuccuccaguccggcccucuaguugauaguccaguagucuguuaacaauuuguaaggaccuggguuauauuuuaaaggugguuguuguuguuguuuggguucacuuauguauaugcagcuugacuguucaacccagauuuuuaaacaauaaaaagauuuaauguau

SEQ ID NO: 13984 - RNA, 1803 nt, Homo sapiens
auacauuaaaucuuuuuauuguuuaaaaaucuggguugaacagucaagcugcauauacauaagugaacccaaacaacaacaacaaccaccuuuaaaauauaacccagguccuuacaaauuguuaacagacuacuggacuaucaacuagagggccggacuggaggaacaaaaaaaaaucccuuccaacgcugacacucuaggacagaaaauaggagugacacccacuuucccacucaugugcccccacaugcacagggauguaugcacaggugcgaccaucugggggaagaaggaaaaagcuggagacgguacaauaacaucauucacguuacugaccgcuuccuacaucguucagaaugauguuuccaguguuaagaaauuauggguauccucuauauuaaaacaaaauuacagaacagugaaaacguuaggacaguuuuguugcuauuauuuggaaaauacagccccauagaaaauauuaaauuuuuaaauaaaagcauugcgcuucuuaucuaaguaguuaaauugaacagacuuuuguuagucacagcugagcaagaggacccugggacagguuauacuuggaaucuacccagaagagauugucuccaucucuuugggaagauguuuugcucuguuucagaaugaaaaacuaaggaaaugcaaagcaguccauugccuauucuauugcuaaauuuaaagcaaacaugcuggugucauugaaaauuuaguuuagaguuuaaauuggcaaaagcuuggggcacagauaaaaccauucuauugccaggaagaaacugagcaucagagcugacgauacucuacacuccuguguguuuucaaggccuuccagugcaagcaaaugaaaaaacaaaacaacccagcauuaguucuaacacugacauuguagacuccagaaauaauucggauuuuuaaaacugcauucauucccuugaugucugaauuuaaauggcguuccauaaaacuucaaguacagcuaaggaaagcaucucacugccccaggccaucuuucugcuguugaaauugaacuuuucuugcauuuguauucuaaaacaaguuuuuuguuuguuuuuuccugauugcuuuuugaaacacagacuuauauucugcaauuuucugacuuuauacccauuuuuaguucugcguuugagcauggagaagcacaugggcuucagucuauaagcucuagucuagguuauuacacccccaacgcaggggacuccuuggcuuuucucacuuggaagcaguggacucuuucaggauagaguguuuuaaaugaugguggggaaaaucaagagcaauuuauacauuauuucgguaauaaaaaugaagaaacaugaugcugugguauggcauuuauuacaccuuauuguauuaauuuagccuauucauaugaggacuucgggugcuuuuagauauguagcuucuagccauauuaucuauuuaaaagcauacauacccuuccucuaguggauaauguccugguauuuaauagcccagagcccacugaaauuaggauacuaagcaaacauuguuuuauuuaaaucaagccucguagguugcuguacaacuuauuaucuuuguaagacuauuacauagcucauauauuuccuggaugguuaucauaacuaaaaaauuauguaucuuaacauauaaaauauguauaaaauuccaaagucacaacuuuucccccucacaauucucuauuguuuccuggcauuuggugcuauagagcagaagucugaagccagaugcucuuugguuuucuuacaggcaauuuguuac

SEQ ID NO: 13985 - RNA, 1531 nt, Homo sapiens
acugcauauagaaauaggugguuuugccucaugaauauucuguuucuguguguuccuauauuuuacuuuguauuguguugguuuuuuaagagacaguccugcucugucauccaggcuggagugcagugguauaaucauagcucacugcaagacuccuugaaucccugggcucaagcaauccucaacccuuagccucccaaguagcugagacuacaggcacaugccaccaugcccagcuaauuuuuuuuuuuuuuuaauuuuuguagagacagcaucuugcuauguugcccaggcuggucuugaacucuuggccucaagcaguccucucgauccucccaccuuggccuccuaaagugcugagauuacaggugugagccacugcaucuggcuuacuuauuuugucuauugucuguuccacuaguauguaaagucuuagagagcaagaauuuuuguuuauuucuuucucuuccuccuuuccuuucuuccucuuuuacuucguucacuacuguauuccacauaaaauauauuuggcauauaguagguguucaauauguugaaggaaugaaagaauuuauagacuugaguugcaauauaaaauguauuuuuuuuuacugugaguuauggcaaaaaaaguuuugaaagccgcuucuaaauaaugcagaugucagugcuuugacccuggaauaaaaacugaaaugacuuagugauuucaaaggcauauuuguuuuccugaacaaucuauaaacugucucauuaaguugucucaguuauuugcuucacuucggcaacagaaccucagccuuuacauguguuuaaagccucuugaggcaaaggauuuggaaaauaugguuacauggagaauagaagauaaugagagagaguaucaauucauuagugcaguugaaccccucuauuggaaucccaucagcgagcacaagucccauuucaacagcaauaaaugcaacaaguauuugcugagugcuuuucuuauucaccucuauauccauggugacuucuacacaguugauacccacgauucuuuuuuaaagagauggggucucacuguguugcccaggcuggacacugggcucaagugauccucccaccucagccucccaaguagcugugacuauaggugugugccaccaugcucagccacaggcuuuuuuuuuuuuuaacagggucucacucuuguugcccagacuggagugcaauggcagcaucucagcucacugcaaccucugccucccaguuucaagugauucccaugcuacagccuccugaguagcuggaauuacaggugugcgccaccacgcccagcuaauuuuuuauguuuuuaguagagacgggguuuugccauguuggccaggcugcuucuccaacuccuggccuuaagugauccaccugcuucggccucccaaagugcugggauuacaggucugagccaccgcaccuggcuggccacaggcuuuuuaaaaaugugcaaauaaugaacauggacaaugaggaagagaaggaggacagucacugu

SEQ ID NO: 13986 - RNA, 8835 nt, Homo sapiens
cuguugaaguccaaagaccacaaauauaaaacuagcugaugcaacuugacuguuaauacagcaguuuggauucagcugucaaugccauguucuuaaaagauugauggguuuuaggggucugggcagcucagccuuggaaugaacuuuuuuuguaaucuuuuugaaaaauucuuaauuaacaaguaaaaauuuguguauauuuguuguauacaacaugauguugugacauauguauacauuguagaauucagcccuggaauuaaucuugacaagaguuaggacccuacucacuuggucucauaaaagagaagauccaaaggccaccucucuaggauggugacagauaaccaauguacacucgguccaucugguacuguuguacagaccaagacucauuaaucagaagugucguucgucaccuggcagaaaggaaggagucacuuccuuggggcccccaggcuuguaggacaacucaacucacuccuuucucccugcuggaaagcacagaaccuuuacuccccagagaaccuccacuguuucccucuccacuguaucaggagagguccauuaaagcuugcuggcuaggcgcgguggcucauaccuguaaucucagcacuuugggaggccaaggcgggcagaucacuugagcucaggaguucaagaccagccuggcaacauggugaaaccccaccucuccuaaaaauaccaaaaaaauuagccagguaugguggugcaugccuguggucccagcuacuuucagggcugaggugggaagaucgcuuaaacccaggaggcggagguugcagugagcuaagguggcaccaaugcacuccagccugggugacagagugacagagugagacaccgcccaaaaaauaaaaaauaaaaagcuugcuauguuccacucuuaccuuguaaauuugugugucuuagauaaaguccugcuuaucuguaggaaaaaaauuuucuggcuucauaccuagaauuagguggucagucuuucucuuguuacuccucuugaugauuacuauuggcaccucuguuuuccuaguuuuuuucacuuuagaccuuguaguuuguuuuuaaaucauucccacacuggccaggaguuucuugagggcacagccgccaucugguuuaucucuuuagcccucaaagugccugguauaggccuagcauagaagaggcacuugauaauguuaguugaauuaagucgaaucauuuuuuuaaaaaaauuauuuaauaucaucauuuccuaaagcaaauugcugcacuacagacaaauuacucuaaauccuauacccuguguaucuugcauuguacaauagauguauucccuacagauggguggucaagugaacuuuuauaaauuaaaucuuuguuucauguauuuauacuuucuauacugucugggagaugcuaacaucagugguuauucuuuuuucuuuuuugucauccuucucuaucuuucuacuucuuccaauccuccccacuaaagaagucuagaguucauuugaugcaauauuuauugaucaucuauaauuugugaaaguguugucagguuauuaaucuguaguuccuaccacaaauauuuaaacgcaguacuagaguauuauuuaauggaauucuaucauaaaccaaugcaucccuccugauugauuucacauuuuaauauuaguucagcuuuaguuugucuggguuuucuuucaccaauucccuagcuagauugcaucacaccucuuggguauuuuugcagccuagaccuugcuaucucagugaucacaggcuguucuggcaaugcuuaaaccaaccaccaaaaauaugguacauuugaaauggaagcaagcagccagagagugaaauauucaacucagauuuuaguaaguaagaucaucuaaacauaggcucugaucacaaacuuuaguccuaggcucuuccucuauuccugugguccaauaauauaaauuaggaugucaucacccaaauauaauauuccuauuuacaaaaggauuuucuagaagguugccucuaauaucaagaauccuuagugcuuuuaugauaggauuuaguauauaaacauuccaaaggugauacuauauauucaguacuaugguagguacaacaaagaaagaugucucaacuuucagaagggaguuuaccuucucauagggaauaaaaacagaagcagaguuacaauacggugcuguaagagugcagaguuaggaguggcagugggagggguuggaaugguggaugcugcgaugguagcugacucuccccucagcaugacccaggaagaguggggcuuguuuugcaaaucuguuggcucacaggcugccgucaguucuuggagagagucaaauggaggaaaucaaguacacagccuuugucaccacuugucaagcucaguucuuccaucucaggccaggagaacccacagccaccuaugauggugaaguuacauaggccucaaaacaccagugacugaacaucgguugagcaugaaccaggaaagcucacaugagggucugggaugacuuuuuaagcagucuacagacagagugucaccauuccuacguucauugcccugugcucagcuccucccaugaugcuaaacucuuucuagucuugggggugcagaagaagaccauuagcacaaggcagaaaugagcuauauaacaacccuggcugguggcaugagaucuuaucucaugauauuccucccuccuggaaugcuauucccacaugcacuccauaucuccauacccucccugacuuucaacaccuacuacaaguccuaccuuauccgggaagcauucucugacccaccagcucaaugugugcuagacaugaugcuggggguuuuacgcacaucaccccauugaaucccuagcaguguauuaaacaugucauuagcccuguuaagaggaacuaacaggcugggugugguggcucaugccuguaaucccagcacuuugggaggccaaggcagguggaucacgaggucaagagauggaggccauccuggccaacauggugaaaccccgucucuccuaaaaauacaaaauuagccaggagugguggcacaugccuacagucccagcuacucgggaggcugaggaggagaaucacuugaacccaggaggcagagguugcagugagccgagaucacaccauugccccccagccuggugacagagcgagauuccaucucaaaaaaaaaaaaaaagaggaaacuaacagagagaaggcucagagagaagucacagucugucuuuauggcuucaaaacagcagagauaggaaugaagcccaggucuucaugacuccaaaaccuguguucuuaggcucuuuugacaugaugcccccacuccagccccuuuucaauuguaccaugggaaaaguugacagggcuugggcaccuccauuauuaauauaaaccuuuauuaaaguuuauaauagugacuuuauuagguuacucaauugggucauuucaugugcuuguagguuuaaauuuuuacucaguaugugaaacauuuuuccaacuucacuaaagguucuuugaaggaaggaaugauaucuuguacuucuccuuuucucuuaugggcccauguguaugucucuuaugguaaagacauacacauagugacuaaauauuguucacuuauuguggggagagggaaggcugcagggguuggguucagagaauaaggaaaaggaauuugaauguacugaaaaccagacaccauacuuuaaagacuuuuucuguucaacccuauuuuaaugcuuugugauaggugcuuucaucuucgguagaacagucuguuucuggggcuuguaaaaauugaguaacucaccuaauuucacacauuguaugagaaguagaacagagauucuggcacauccuguuucucaguuaugcccauuccugccacacauaaucggcuuucugauuuuaggccagauccacaguuaaaucuaguuccaaaugacagccccuuagagcaucugcuauuuuucuugauaauguguucugggaaauuugaggucacuaacuagaucuaaaggagacggaauugccaaguuucaaaagggcaggaacaauccuugguugcacaccagugaaggaaagaccauuucauggagggggaagggaaagguaguacccccaugggcaaaacacuggacacagacuggauauaaagacagaugagcuggggaguggagcccacugcuagagaaagacccauccccagcaacuguggaggaggcagugcugucccuuaccaagaugaugcugcuguugcugugucugggguugacccucgucugugcccaggaggaagaaaacaaugaugcugugacaagcaacuucgaucugucaaagguagaguuauggaacgcauugacuucuggcucuggggagugguuucagggauucugaagccauguggauccuauuguagggcaggaguuccuuaacauaucagacaaaagcauugguuucugaucuuggguuaagagcaauuguaccauaugaaaagaugacaaugcuuggggaucuccauccucccuaaaggggcaguggaaagagcccuagguguggugccaacugaucugaguucuaucuucacuucaccauuaugagcccuggcccacaggccagaguucaaggaaagaaguguccaugugguauccccacuccucuuuucuuacccaaugaccuuauuuauugcagauuucaggagagugguauucgguucucuuggccucugacugcagggaaaagauagaagaagauggaagcaugaggguuuuugucaaacacauugauuaccuggggaauucuucucugacuuuuaaauugcaugaaauauaaguauggccuuuuuuaguuggggaaggaaaaacagaagccuggguauggucuugaacacacacacauucacugauccaggacuugauggaucuggggcuuuucaagauucagagacaagagucaguaacaagaauuuuaaauuuaauuggagugggagaagcaggagguagagggauaucagaaucauuaaguaguaugacaauauagcauagguuaagcaaacugaauuuggaacuaacagccugaauuugaaucuuccaguuaccaguuguguuaccaagaaaacuaaugucuuuccaccucccuuuucccauggguaaaaggggaugacaauaauuccuccucauguuguuuuguuuugagguguguguguguguguguguguguguguguguguguguguuuguguggaccaaggcaggucacauuuguaaagcacuuacuugagaggcuggcauguggugaacacucagcuaaugaucuagacaaguaguuguaguaauagcaacagugagaaguagcaacagugauagaaguugucauuuaagucauucuuaucaaaucaugugaaauaauacacauaaaaggucuuugauaauuguaccaaaaaauguucaaaaguugaaucagaaacucaaguuacugguagaggagaagguaagcaagccagccucaucaguagcccuugggcaucaauuuauuguuuuacagugaaaauggaaacuguacugaaauuaauuuggcuuguaaaccaacagaaaagaaugccauauguaguacugacuguaaguauuuuuuuaagucuuucuaaauuauacuuccaacugcaaggaauuuacuaaaccccaguaucuucaugaucuugaucaauuucugaucaaugacuauuuugauaauaaaauggggguuauauaauagccaauaaccugaagcugggagaaccuugcauguaaaagccagugccugccacauaauacaaucagcuucaggaaagugacuuggucauaugcaccuccugcaacaaaaguuaauuggcagggaaaaaauauaaauuggggcugggcaugguagcucacaccuguaaucccggcacuuugggaggccaagguagggggaucaccugaggucaggaguucgagaccagccugaccaacauggugaaacccugucucuacuaaaaauacaaaaauuagcugggcaucaugaugcacaccugugaucucagcuacucgggaggcugaggcaggagaaucgcuugaaccgugaaggaggagguugcagugagccaagauugcgccacugcacuccagccugggcaacaaagcgagaccuuaucuuuaaaaaaaaaaaaaaugguaaauugucaagacagcuucuuauucccucccuggcuuucugaugccugauggucaucgccacagcacauugcucaggauauagcaucaaguaaguaaugccagugggggcuuauagagaggacagagacacaucacugacagagaugcugcuggagguggguaggucucgggggggauguuaaagucugaguggcugcuggggcuaaauuuuuugacugcuaguggucaaccuacccuuuucucagaauuugccucaugaagcccagggcgaugcaaauggaagacauucaacauccucacuaucucuaacaggauacgcacuugaacuuguguugugggagagaccagguaaaggguuucaacugcuuucuauggaccaaaggaguucugagcuguguuguuuccuccacagauaacggacuuaaugucauugacauacuugaaacggacuaugauaauuauauauauuuuuauaacaagaauaucaagaauggggaaacauuccuaaugcuggagcucuaugguagaguauuuucaugcugacacucaucuugggguggggaaaggagggaaggcaagaaacuuagauacaaaguggucuuucccacguuauccugggccaucucuccuucucugcaaacagaggcuuaccuuugguaaucccucaagcucagugauaagaaauuaugaucuuccauugugcuacugaugucaaauuuaggacacauuauaucccacccccaagacuucugccuggcauccaauggcugccauucauuuucccaucugucuugagcccuguccccucauuugccucuaugacgaauacccaagacauggcaguuacugucacucuucccacaguucgaacaccggaugugagcucacaacucaaggagagguuugugaaauauugugaagaacaugggauugauaaggaaaacauauuugacuugaccaaaguugguaagucgggguuucugguauucucuuccuaaauucccauguuacagaagggagcaauccaggggaaguaauacccuccaaaucaguccccuuugugcuaacuuggagaaucaucugguuucucucugaaaaauaaacugggguuggugucugaauuuguucucuucucccucgacagaucgcugucuccaggcccgagaugagggagcagccuaggacuccggguuggugaucucugacaccgguggagagaggguggcccagggaccagugccuuccaaaagcauuagggguuugcacccaaagauaccauaaaaauaauuugguaggaaagcuugugggaaaaucuugaaaucuggaguuggaagaccuggauagaggacccaauucucccauaagcuuugagcaaauaaccuaagacuuaaaaaggagacaaugggccagguacaguggcucacaccuguaaucccagcacuuagggaggcaguggcaggaggaucgcuugagcccaggagcccaagaccagccugggcaacauaaugagauaccauucuccaugaaagggagaaaaaaaaaagaagaggaaacaaugaugccuaguuuacagaguugcuguguagauauaaugcuugcgaaaagggcccaguaauugaagaugugcuaaaaaucacuaggauuucacguucgaaauggaaaaaguaguagguuguaugaaacucaaauauguuucuguguuuguggaccaacucccaggaggccaucucacccuccaacuuauaauccacauuucuucuucuguacucuguauguccuugacgucuaaccugggaauggaacugucuucccauuuuccacaaaccuggaaaauagaucuugaguuuucucaacuaccuuagauuuaucguggggcuuucagauaauguaugugaaagucuuagcagcuugcauaaagcaaauauuuaauaagagauaucuacagauuuugccauuauuccucaauuuaucaaaaauucuucaaaacuucugauguugaagauggcagaaacaaaccugggacccuuuauuacuuccuuucucuuuuucauguauucagcugagagaagguuaagauggcauuagcaauagcaaaaaagcaaaagucauuuacucaacauccucccucccccuuuucugguauacaacauaaguuagaauacagggucagaacuauuucuucaucauuuuucucuguaauagaauuucucuucaucauucaugcaaugcaaggaauguuuaauaaguuccuguguucucucucuucucugcuuaauuagugcugagugaaugagugaugagugaaugagugaaugcugagugcugagugaauguuuccucaccuggacuccaguaucuucccuuccugauccccauguccucuuaugacaaguucugugaccugauuuccaucauaucacacaugaagacgucaucccugcaucuuuaggaucuucccuaacugccuaagaagacucagaaauucaccaagaaucaaagguuuucuuugaauuucugacugucuuugucacagccaggggaacucuacaugaauaacaccugacucuacaugaucaauaaaucauuaaccuugcaguca

SEQ ID NO: 13987 - RNA, 44270 nt, Homo sapiens
ggggcgggaaauccucggccucgguggcggugguggacacgucgagccggguagaaguggaggggccguucgaagagucgugagggggugacggguuaagauucggagagagaggugcuaguggcuggacuugaccuggaaagguaaggcuucucucggccccucuuucgcaccccugugcauggguaccguccuuuucccagcgggacaaggaccuuccucgccgcuuuccucagcuccgcggaaggagaaagagcucgggacuggaggguuaaagacuggggcuucggcccggccccugcaguggcauagccagagugaccuugggccggggugcucggugccucaguuuccccguguaugcaaccggccauuuguccaguucuuccaugugccugcugguccagaagauuuuagagcucagaggccauggauuucaaucccggccuccucguaaucucagaauuuacagauagggagacgaaggaacuaagcacccgggugacuaguccgaggucacaaagaguaaagggcagacugagacuggauuccucguccuuugauucaggacauagugagcuagugggugaacaagaaccuuaucagcccuuaagcacugugugcccuuacagagugacuauugaaagacuguagcauacaccucgaggaaaguccccuuucuagaguccaccuguauucuacgcggaugaggugcagaagagcuaagauauucuggcggugggugauggaaaggaggauacuuuggaggcagacacauccccaccccaacuuuggcguggguuucccugggucuuccugcgacagcccuaaaucaacaucaauuguggcggacuccucugccuccaguuuccacccuaucuguaucuuacauaaguauuucuuugguuaaccugguaucauucucgaaacaauccugggguaguccuggcuuagacaagguguggcuaaggagauagugucccagcguagcguccacagacucacuggaguucuugggcuuccccucacagucagguugguacuacaggugucccuuacgugaauguuucaaucugucaguaugaaauugaaaugaaaugauugguagcucccucccagagaacuuugcaccuccuggcaaagauguuaaagcagcgaaggcucacaguuggaaugaugcaacuggaaucuaagcacuagaaccggaacuggaacuagaaucuaaggacuagcacuagaacuguugcaguagcucuguuuagugugugaacuuggcuaccucuuggagguguugggggaguaacuggauuaaguaccauggcacuuucuaaucccucuccccaacaccggucacugugauugcagcacugaaacaucuaaauguuuaacagaaagagcuugcuagccccuggcuuacauuaucuaugguauuuuuaacauggaaugaauacuuaaagucacuugcaaagcagucucacugcagaaucuuucuagguguuuaugacauguccuuccagccuuuucuuuaaaaaaaaaaaauggccaagggaauauuugaacucuuaucuuguauucuuggguggagcugauuuuauccuggauguuuaaguagcuuuuguagguacucaggaauccuaaaaucaauagccuuuuuggugauuggaacaucacgaacaugcauacgcagauuaucacuguagaaacacagcugcugauucucauuagcaguaugaggaggaggaagaugauggugagucuugccaggcuuugaacugcaggacugggugcaccuaaaaaaaaaaaaaaagaaagccacugucuuccuaaauucguguaucuucagauugguaauacuggacuaggaaucaggaaaucugaauuccugucccagcccuuauaacucacucugaguuugggccaggcucccuaagcacuguaaaaugaguggauuagaccuggacuucuacugaguaacugcuggggauacaaagguaaguaaggcacaaccuugaucucaaguuuaaaguaagcauuuuuguuuauuuguuuugcuuaaguauacaacuuuuagaauacucauaaaauauauugucaacccccagaagauuggccaggaagcagcaauuuuuuuucuccacccuccacuccccuuacucccucagggaagcagcaauuuuaauaauuauuuucaaauuaucagcaauuuugcaacagagaugacagucuuuauauacgaguauacccauacuaaucuguaaugaugcaugcauuuuaaaauuaguaguuuaaaguuauaaccaaguuauaucaggcauaaugauaggaauaugaauuaaaugcagguucuaggggaucuauaacauuccguucacucagucacugaaagcagacuuagggccauuaguugguuaacugaagaaguaaguuaaagcagggaaucauacagauaauaguuauaugcauaacauuuuaacgaacacauaaacauucuuuugccauucuuuuaacauaaggccucagccuuuucuuggaguguaggacccuguugccuguuuuuauaaguaaagcuuuauuagaacacagccuuucucauuuguuuauguauugucuaugacuccucuuacccuccaaggcagaauugaauauuugugauugcaacagaaaccacauggccugcaacaucuaaaauguuuacuuuuggcccuuuauagaaagagcuugcuagccccuggccuacguuaucuaugguauuuuuaacauggaaugaauacuuaaagucacuugcaaagcagucucacugcagaaucuuucuagguguuuaugaaauguccuuccagacuuuucuguugucucccacaccuaacagcaaguuuauguguuaucuguaugcucacuuuuuuuuuuuuuuuugagacagaguuucgcucuuguugcccaggcuugaaugcaauggcacaaucucggcucaccacaaccuccaccucccggguucaagcgauucuccagccucacccucccgaguagcugggauuacaggcaugugccaccaugcccggcuaauuuuguauuuuuaguagagacgggguuucuccauguuggucaggcuggucuggaacucccgaccucaggugauccacccgccuuggccucccaaagugcuaggauuagaggcgugggccaacgcacccggccuugugugcucacuuuuaucuggucuuucgaaagcauucagugugguguuuuagaaauaacuacuagagagucuauguaguacaguaguuaaguacuugagcucuggagccaaauugcuuugccacuuauuaguuguauaggccauagacaaguuacucaguuuuugccuuuguaaaacaggcauaaugguaguauccauuucuagguuucuugugaauauuauaggaguuaauucauguaaagcauuuagaacagugccuggcagguaguaaguacucaguguuaauugcugcugucauuuuucucuucucauuuauacuucauugcuuuacauaguauuuacguacuuucaguaauaagcacaacuggcauaaauagguuugugaauaaacacacugucaccauugauaagcacacuucacagagggggaaccagaaguguuguucccaucacauuggagaauagccuaauggugugaugucaguuaaauuggauaagagaguucugugggauaguuugcuaagaguauaaggcaacaguucacagaagaaaguaauggauuaaaauugaaaaggaauccaggaccauauuugucaaauaccuugaaggucaaggugacaaguuuguacuuagauugguaggaaguggaauuuuuuauucuaaauggcaugauugauguaaaaaaguucaaauggcuuaggaguguaugaaguaaaaaguuacauuucccuagcuccauuccaugucaguagccacuucauuuucuaauggccccuagaacaugagguuguugugaaggcaugguaaacaccacuuggggcacugguauuaaucuguuaaaauuuucaauucagcuuuccuuuggauuauaaucucaauuuugaauugagaaaaauaaaguuuccauacuaaaugugaauaaaaugaaaugacuguuuugaaaguagauaccauacucauaagagucuuugauuccuaagucuuucucuaccucuuuuguccaacuuggaagucuugguagagaaggacuuaggaaucagagacucaucucuacuguuaauuccuuuuugcaccuuucccaccagaagugcuacaagagagaaagaugauauaauaaucacuagaaaagcaaaguguucggccaggugugguggcucccgccuguaaucccagcucaggcagaucaccugaggucaggaguucgagaccagccuggccaacauggugaaaccccgugucugcugaaaauacaaaaauuagucaggcaugguggcgggcaccuguagucccagcuacucaggagacggaggcacgagaauugcuugagcuccggagaggcggagguugcagugagcugaggucacgccacugugcgccaaccugggcgacagagugagacuccaucucaaaaaaaaaaaaaaagaaauaaagaaagcaaaguguuuacagugacaaguugauuucaacuagcaguugucaguuaaguuaguaacagggcaucacccaaauaacugcauuuuaaaguggacagggcaggccugacuggggaaaagggagggaagggguaggggguuccugaugccuguacucccacaugcagcucuuaaauccauuuuaaaaacuuaaaaguuuucuguaguuuugugacuuaaguauaacaagucaucaaaagucugauacuuaauacauuacaaugaacaguuuaugccaaaagaaaucuuauaguagggccugggaaggaaaugcuuuugaaguuccauugcuuugaguaauaucauuuuaugauuuagguaacauccccaagcagaggaggggcccauccuuaggaaugcaaagcccugcagagaaggaaaggguugagaaggguccacccuaccucuuuuccuuuacacaauggcccuaggcuuuuguauacaaccugcuuuuguaggcuuaggacauuaugaaauacagcaugguaagauggaagccugaaucucaaaaguaaauaugagaaaugauuuggagggaacauauaaagagagcaaaauucuagcaacaggugacauauuucccuagauagaagaguuauuguagaacuaugaugaguguuuauauaauuuugaagcaguuuacagcaucuagaauguagucauuuaauuuaugaaaugaaagggaaaugguguaacucauacacccgcauccucucuccuaccuuuucugauggcuuuuuaugaguucucacacaaccccuaugcauaaucuauaccuuaguacauuuuacauuauuuuuaaauuauuuacaugugucccucuuucaccagaauggguuucuuaugguuagaguuucaucaugguaccuucauucgauagguaugcaauaaauagugaaagaauagucugaguuccuugaaauugcauagcaaaugagaccuaagagccagaucuagaaugcagauguagaaccucuuucaguuccuagcccaguacuuuuacugccacaccauacagccucuaucugagauauugaacaauuuuuuucuuuuuucuuuuauuuuuucuugaaacaggaucuugcuuuguugcccaggcuggagugcaggagcacaaucucagcucacugcaaccucugucucccaggcucaagcaaucuucccaucucagccuuucgaguagccgggacuacaggcaugcaccaccacgcccagcuaauuuuuuguauuuuugauagagucggggcuuugccauguugcccaggcuggucucaaacuccugagcuuaagcagucugcccaccuuggccucuuagagugcugggauuacaggcaugagccaccauguccagccucauuugcauucuuguacugcauuuucauuaaaucauucaaguuccuuuuaucuuguguaacauauuuaauugcauuuuccuacugaauaaaaaaaagggaacaguucaaauguuuucuaguuucugucuuaugccauauuaauuuccaauauuacucauaggcaaaccaacaacauuauuauccaaacaguuuaaaugcuauguaauauaacuaaagcaaaguuuagacaaggaggaccauugucuacauuugauuauaacaauaaagcaguuaaagcaaugcuuugccaauguauauuugucugacuagcuaguuuuguuuaaaucaaacugugaaaggcuguauacuucaagaaacaugaaagugagccuuaugugugacuuaguuccuuucagagauuaauuuugucaucuaaugagcaagcaagcuauuauauuucauauuuacuguaccuuaaaauuggaaaguauuuaacauauuuuauuugacccuuacaauacuaugagauuggcagcguagguauuuuaauaucuguuuugcaaauuuugcaaauuuuggugauuugccuaaugucacauggcuaguauauggcaaauguggguccagagcucagagccuuugaugccucgugcugcaugcuuucuccacucuaagauacuaucuagaaaacacugaaauugucacauaaaucauacuaaagcacaguuagcggacuggaagugcgucaaggcuacaaaaggauccuguaagaggagcaugaaagggugcaucaugugauuacauuauuccaggauguggcuuacccaacaacaaaagguaucacagaaauggaguaaaguagcugggagauccacuccccauuggacuuaggcccuguuaucauuacauaacuaaaagaccuuuucaguuuguuuguuugacauaucaaauuugaguuguccuauuagaaccaggcaaauaaaagcuuuuguaaaggccuuuggaagaauguaguuguacacuugaucuucuuuguacagaagggugggagugggcaagagaaauaggagcuucuauguuauuugccaccagaacaggauauguaaagcucagaaacccauccugcuuagcugcuucccagcaagccauccggagaaauggggcuggagaaagcgguuagucuaguguuauggagccuucuaucagaagcagauguuauggauucaccuaacuaaagaauguuagugucaucauuuaauaacauaagccucaguuuccacaucuguaaaauaaaggaguuggauuugaugauacuuuuuuuuuucuuuugaguuggaguuucgcucuuguugcccaggcugaagugcaauagugugaucucggcucauugcaaccucugccuccuggguucaagugauucuccugccuuagccucccuaguaucugggauuacaggcaugugccaccacgaccggcugauuuuauauuuuuaguagagauggcguuucuccauguuggucaggcuggucuugaacuccugaccucaggugauccgcccgccauggccucccaaagugcugggauuauaggcgugauccacugcgccugacugauaauuuaauuuuuuaaauaggaaauauauucauaugguuuguaauucaaaaaguacacaaggauauucagugaaaaguauuucauuuacuccuacccacuucugaccagcucuccuuagggaccacgguccuauuuugccucccaggcucaaccaacaacuuuguuguuuccccccaacuccccugcagauaguauagguguauaaaaauaacaugaacauacucuguuuccuuuuuaaguuuuuuacaaauuauagcauacaguauauucugcuuuuauuucauuucauaauacgucuuacagaucauucuauaucaauauauaugaucguucucauucuuauucugcuaaguauuccauuguaugaaaauaugauaacucauuuaaucagugcccuaucaaugaacauuuagguuguauuuuuaauauuuugcuauuacaaacacuccuguuauaaguaacuuuguacauacacauuucacauaugugccaguuuaucuguagaaugaauauuuagaagugggauuacuguguuaaagaaugugggcagacugaugacuguucuaguuuugaucuucuaugagacuuuaacugaaaaugauuaguggaaaagaaaaaguaucauuuucuugguaauaucuuaauuuuuaucucuuacuauucagaacuaagucuuaaguaagagccaagaauagguaaucucuccaaaauuauguugaauugcagacuucacuaaagucaccugcaucauggucuuguagauuuuucuauugcuuuucaguauaauacuauucaagcuauuugcaaggugaauauuauaaacucagaacaaaaggagacugucucccaacuauguuuacuagcauuuaccaaguagaggauucagaagauuugcucuuuauuacaauuuauguagggagugaagauggaaagaugaaacaaagagagccuaacaaauaucugccucugucuguguuuuacugucuucccaaauuuuuggaugguuaugaggugugugauaacuuuacaaaguguaugauaccauaacaauuacuaaucuuuuggggauuuguuuguuuguucguuuguuugagagacagagucuuggucugucgcccaggcuggagugcgguggcgcgaucucagcucacugcagccucaaccucccuggcucaggcuauccuccugccucagccuaccaaaguaguacaaaaguagauccuauggccucagccuauagcugagacuacaggcaugcaucuccacgccuggcuacuuuucuugauuuuuugaggagacaaggccucacuauguugcccgggcuggucuugaacuccuggacucaagagauccuuccaccucagccucccaaaguucugggauuauaggcaugagccacuguacccugccuguuuuguuuuuaauuaauacauaauaauuguacauauuuaugggguacagugugauauuuuaauacguauauaaauugcauaaugaucaaacgaugguguuuagcguauacaucaccucaaacauuuaucauuucuuuaugguaagaacauucagaauucucucuucuagauauuuugaaauagccacaauaacauuguuuacuauagucacuagucuuuuggggaagcuagggaccauaaagcagaucagaauuguaucagccccucaugcuuucuugacuauaaccuacuaacuuuucuuuucuccccaucucaccucccucauucucuuucuagguacaauaagccauuugugaaauuuucccuguucaauagcaaguuuaagccagagccuccauccuuuccaucucugaauucccuauagccucuggggcagaggguacuucauaauacuuguugaguugaauugagguagaugucaaagugaucugaccucacuuugcuccccucucaagugccauauccuuccuuuucccugcucagccuugacacaccuaucaagccaucccuuugcaugcuuaauuugguucaggaaaggacaagagaccaaguaaauuaucuugaagaggagucugugucugccuauguuuaaguaaaugcgcacacacaccuaucuuucuggcuccugcugccauucuuuguguugcgcuuaaaaauugggggccggguacgguggcuuacaccuguaauccgagcauuuugggagacugaggcagaagaaucacuuaagggcuggaguucaagaccagccugggcaacauagggagaccccuucucuacaaaaaguuuuaaaauuagcugagcauaaugguauguaccuauguucccagcuacucuggaggcugaggugggaggaucacuugagcccaggagguguaggccgcagugagcuguaaucaugcuacugcacuccagccgggacaacagaauaugaucuugucucaaaaaaaaaaaaaauggggaaauuauuuauuuaguuaugcauuagugguagcuguggaguuaggcacaccugguaggaacagcauuggaauguauaauucaaaauacacauguaucuuuuuauucacaugaauuccauuuuauguguaugaaaucaucaagaucaaagugaauauuagaugaauaugaacucuagcuuauuggacauuuagaagauagaguuugauuaguguugauuuuuuuuuauuuuagauuuuaaaaacuugucuaugggccauacguuaaguacucauaguaucucuguggaagaguucugauaaacucugggauaggcgauagccaggcccacauguggacuauaacuccuguaaaguuacagauaacagaauuauauggucuaacaugcagcucacuuaggcaguccuaccuuuccaaauguuuucuucaaugccauauucccagggaaaauugcugcuggguaguugaaacuaggugccucacuggacuucuuccuauuauuugggcaacuuguaaaagcuuacaaacuuucuagaaaguagcccugaaaacaguuccuucguuauguuuuuagcaauaccacagaauacaugguucuauguuauagcuuagaauugcuacuacucuuacaaaauuggaacauagaaaagauggacaaaaaccuaguauaauguaucauuauuuccauuucaagauggcguuuugaacucaucucuuuuccuucccaaaauccuagugaaauuaucauaggaauaugaagaagcauuauuuauagucagaaaacagggagaaagaagccagaaacuuuaaaacauuucaaagaaaaugugauacagaugggaaucaaauugaaaaaaaugacugaccaccugauucaacauagauaaaggccaucucugucgguaaauuuaaauggguuagauucauuugcacaccccugcaagcucccaaaucaagaacagcagagauggccaggcacgguggcuuacacugguaaucucagcacuuugggaggcuaaggcguguggaucaccugaggucaggaguuugagaccagccuggccaacauggugaaaccccaucucuacuaaaaauuaaaaaaaaaaaaaaaaaacuagucaggugugguggcgggcacccauaaucccagccacuugguaggcugaggcaggacaaucacuugaacccaggagguggagguugcagugagccgagaucgcaccacugcacuccagccugggugacgagagugaaacucugucucaaaaaaaaaagaacagcagacauaaggaagaaguguuagcuaugggguaguugguggacaaaucaaggauuugaggaauugcacuuauaccauauauagagagaacaguagauugagaaguaaaaaugaguauuuaucaagaacuuccuguguuuagacacugugcuuaaguaaguguuuaaguguauacugucaagagguaguugcuauaaacauccuuaguuuagaggaaacuaacuuacccucuuaaccacugugcuguggccucagugaacuccugcuaauaauucuuuaaaacaauccuaugaaauagguuaguuuuauuuucccaauuuuagagcugaggcaagaagauauuaaguaauuugccaaagggcccacaaccaguagguacaguuuuaccgguuagagaaugaguagaucuccuuguguauuugaauagcugccauaauaaagaaaggggaaauaucuuuucuacccacagcuuccuccuuguguuuuuuuguuuuuggugggcuauucaggaucucagaucgaaucccaaucucagaaagacaguugacaaacccuggagaggucagcugggaacaaauguaaaagucucagcaaaacgguguacuuccuguuugaggucugucuuucugguaguucaaucccuguauuucacaacuagucuacaaaaauaaaacuacaaaaauauuuaauuuccccucccucugggauuuagagauuuuacuuacacagugcguuagaaaaccucucucaaaucccaaagacgagugauuugguauuaaauucaguguuaacccccaaguucuuugauuauuaggugguggucugugcaaauuuuaugugagacugggcuaacucugugaccuuuuuggaauuucaaaauaaacaaaugcauuauuuuaguuccugguugaaucuuggcuuucuuuucuuuauuacugauacauaauaauugcacauauuuaugggcacaauaauuaauaauugcacaauguauaaugaucaaaucaggguauuuaggauauccaucaccuucagcauuuaucauuucuuuguauugggaacauuucaaaucuucuaauuauuuugaaauauacaguguauuguuguugacuauagucacccuucugugcugucaaacacuagaacuuacuccuucuaucuaagcaucuauuuguucuguuaacccaucugucuucaaucccacccucaccccaccuugaguacacacauauacacccuucccagccucuggugacuguucuacucucuaccuccguaggaucaacuuuuuuggcucccacuuaugacugagaacaugcaauauuugucuuuuuguuugacuuuuuuuuuuuauuuuuugagacugagucuugcucugucacccaggcuggaguacaguggcgugaucuuggcucacugcaaccucugccucccggguuccugaguagcugggauuauaggcaccuaccgcuacguccagcuaauuuuuguauuuuuaguagagaugggguuucaccauguuggccaggcuggucucaaacuccugaccucaagugauccacccaccucagccucccaaagugcugggauuacaggcaugaaccaccgcuccuggccaucauuuuuuuuuuuuuuuuuuuuuuuuuuuuagcucucacuuguugaacauccaguucuuagauucuguguacuaaguaucuauguuguacaucucuguaauucagaacugugguucucaagcuuuagcaugcauaagaauuguccauggaacuugauaagcaccuaaauuuugaggcccuacucccuaagaggugauucagugguguggcauaggguccauaauuuuuauuuuuacccaaacuucccugaugauucugauccaggugguccuuggaccacacuuugagaagcacuugaguuaggaaaguaauuaacauuuauuguuuacuauauauguuauuaacauggcagucucuucaauauguauuuuuacauuugauauucauacuguugugagauuuuuaucccaguuuuacguguacuuauuauccuuacaaaguuuuuguaacuuguuacgaguuuuaaggauggcagugccccuuaggauaacaaauaaagcaugauaaauagacuacauuaacaguaaaaacuucuguucguucaucuaaagacacaauaaaagaaaugaaaagggaagccacagacugggagaagauauuugcaaugugugugaugauagaagacucauccagaauauguaaagaaccuuugcaaaucaguaagaaaaagaccucacagaaaaauaagccacaaacuugaacaaauaguuaacaaaagaaaggauauccaaaagccaauacauguaugaaaaaguuuccacuucaauagucauuaggaagaugcaaauuaaaguucaauuuauacccaccagaauggcuaaaauuaaguagacugacucuaauaagugcugagaagaaugugaccaaucuuggggagggaaaguauuugcaaauguucacagcaguguuauuaaaaacccugaaaacaguuuagaugccaagagcagaaaugaaaaguuaaguugcauauugauucaaaggaaacuauagagcaaugaaaaauaacaaacugcugcuacacacaauauggaugaaccucccaaaaauuauguugagcaaaggacccagacacaauaguacauucuuucugcuuccauuuauauaaauuucaaaaucacagaagacuguguaugauuuuagaagucaggagagaagauccccccggagaggaggaggaagcaugacugggagaggcaggaggggagcuccuggaguacuggcaauaguuacuguucuggguaacaauuaaauaaaauauacuuacuuuaugggggaaaaaagacggcaaugcccugcaacagugagcagccugacucugagaacagagugggcucuugcccuugcuguuucugcuuuggcaaggugccucucagagcagaugauuguuuaagauugguucuggaaaguaauaugaacaguauguucuggaauguguuuaaucaauguuaaagccacugaaauguuagaauggcuaaaguauaucaaucauuauucagaaugcguuucauuuuuuuguuuuguuuuguuuugagacagucuugcugugucgcccaggcuagcgugcaguggcgcaaucucggcucacugcaaccucugccucccaaguucaagcaauucucgugccucagcuuccugaguugcuggaauuacaggugcacgccaccaaaccuggcuaguuuuuguauuuuuaguagagacagcguuuugccauguuggccaggcuggucucagacuccuggccucaagugaucugcccgucuuggccucccaaagugcugggauuacaggugugagccacugcgcccagcccuauuauucagagugcauuucgacaagucaagugugcauuuguuucucacugaaacuauucuuuuuuuguuguuuuuuguuuguuuguuuuuuugagauggagucucacucugucgcccagguuggagugcaguggugcgaucucggcucacugcaagcuccaccucccggguucacgccauucuccugccucaaccucccgaguagcugggacuacaggugccugccaccacgcccggcuaauuuuuguauuuuuaguagagacaggguuucaccguguuagccaggaugguuucaaucuccugaccucgugauccgcccaccuuggccucccaaagugcugggauuacaggcaugagccaccacacccggcccucacugaaacuauucuuauauguaccuaaacuuuucagaccgaaauaggcucuaaagaugaauuagucuguuccuugacucaggaagcuaugaccagaaaggcuaaauuaccuaauguaauagaaaaccagggcuagaacaaaaauuucuagucuuacauuuuucaaauuguaaucauuauaaagauuaaggugggcuucagcccaccaauuccccuugccugggaauuauccagaacacuguugagucaguguuugagagugacagcacugugacaacauucagcauaugaaaguucacacaaagccaugauaaucagagaugaucugauauuuuaaaggaguagaauaaauggugacauuuuuaugaauuauucucaaaauuucuguuucugacccugaaaauacaaauaguagaaaggcauuuggggcuuuuaugcauuauucacagaaugccaaaauguagccuagagcuuggggcuguauggaaguccauuuucaccccacuuagagccacuuagagguagagcagccaagaguacugcagauaacaguuguagcgcauacuguaugccagaagcauggcauaaagcauugcaggacacaacugcucuggagggggguaacgauuagauuuagcuccuccuggacaacuuaaugggcaaggauuucauagacuugucagagcacuaggauagcuugacauugguuuacccggaauguagagaauauccaauugugccucaacaggaauaggucuacguuuuuuuuuuccaagccucucucaaaacuacagcuguuuccuugccuccguuuuucugaguugcccuuagaacgcaaaaaaagcuuacuugauguugagagacuaggaacauaaagacaggagauaguuggauagaaggaccaugcuacgaauaaugaaaagaacacugggcuugaggucagaaucaggcuucuaaugaugaccacuagacuaacugcccugugaccuuggcuagccuuuuaaccuuuauaccucaguuuuccaucugaaaaaugaauaacuauucuuguuuaaucuaggccuauucuuuuaaguggaguuaaguuuggaaacauacuacaauguuguggcucagcaauucucagaaaaagcgugcaugaaagcaaaaguaaaugaacuuacuguuggacccagacuuagaaucaaucaaucaacaaguauuuauugaauagccaccuaaaggguauauuagacugcauauagccuuuaccuaagccuuauagugaauucuguaaacaagauaugaaugcauuaaccucauugcugagcucucacagagcauaaugauaauauuaccacagaguaauaauaaggcuuuuacauauauggucuuuucuccccucuuuuuccccauucauuaucuuauuugaaucauauaguaacccugaaggaggacaaaauagauguuaucuccauguuuccaugaguuucagaugagacauugaaauucagaguaugaaaaugcuucucaaggggguaggacaaauugagaaaugucuggagacauuuuugguugucacaacuggggcaaugcuacuggcauugagucgguagaggucagggauacuguuaaacauccagugauacacaagacagcucagacaacaaagaauuauccaguccaaaauguuguuaauacugagguugaaacccugagauagguguuuccccaaaagaacucaaagugauagagucggaaccagaauccacaucuuugacucacucuaguguguuuucacuaugucuaaagcagggcauuaaaaucuggauuuuaaggcugggugcggugguucacaccuuaaaucccagcacuuugaggggccgaggcagguggaucaccugaggucaggagcucaagaccagccuggccaacaugaugaaacccuguuucuacuaaaaauacaaaaaguagccggguaugguggcacacgccuguaaucccgccuacuuggaaggcugaggcacaggaauugcuugaaccugggaggcagagguugcagagaucgugacacugcacucaagccugggcgacagacugugacucugccucagaauccuuuuuaaauuaaaaaauaaguaaauaaaaucuggaguucacaagucuuagauuaaucacuaauguuuugaugagguaugagugacaagucgaguuuguuuagaucacuguugaagguguauaguauagauuauguagucuauuaaacacuugcugugugucucacagucugcugcccaugucccucccagaggcuaguucaccuucaucguauuuauugauuuuuuauugagcaaguaccaaauuugaaucauuugaccaaaaugcuguugaaaucuggacacgaucccuguagcaaucucuaugcguaggaccuguugccaaacuaaaaacccaugggacuuuuacaggaaaugucaccaggagacucagcuagaaauuaguagagccgggauuugaauaccuucugacuccagacuuuuuuuuuuuuaacuccuaccccuagaccuagacucuuaacaauagucuguaagaucaaaugucaccugcaaaggguggcaugugacuuuuagaagcucuuaaaauccaggaauaaauucuucuuacuaauucuuguagaauagucuuaaguugugccccucaaaccauuuuaugcccagaaauuagaugauucuucucaucuuccuaaaguuuuaacagaugccauucuggauccuggaaaauuaaacagcuguagccauaaggauuuaaucuauaaagauuuuuuuccuucuguaaaucugccucaaagaagaacuuaagcaggaaacaugagugccugcauauuaccuuuaaauagcuuccaauugcccuggaaauaaaauuuagaauccuuaaaaugaccuuuaagauuuuuuuuuugagacacagucucgcucugucacccaggcugcggugcaguggugugaucuuggccucacugcaaccucugccuccuggguucaagugauucuucugccucagccucccgaguagcugggaguacaggcaugcgccaccacgcccagcuaacuuuuguauuuuuaguagagaugggguuucaccccguuggccagucuggucuugaacuccugaccucaagugauucacccuucuuggccucccaaaguguugggauuacaggcgugagccaccaugccuagacauucuuaauugaguauccuuuaugcuucccucuucaaccucauuagccucuccuccgcucacucaguauguucuguucauacuaaccuugaucccuuauuucuucucucgacucaggaaggcucuuaccuuuccuucuacuaaacuccaauaauuaauuuaucagucuguuuaaagucagcuccuuuaagaaagcuccucucuuucgcuucccaccuguccuccaucuaaauuaguucuuucaccguuauucucugccacaguucauuuuuguaccuccuucauaccacuuacacaaaugauaauuauaccuaccuauauauauuuauuugcuuacauuuuuacugagagagccuucuuccucuugaguagccccacaaaggcaaguaccuugucuuuuugcaucagacuccuuauagguagauauugaaaccuacauggauuuuguaagaauuaauaaauacuuuuugaaugaaugaauauuugguaaguauucuuccagaugcuguaaggaaguaaaaauuagaaaguuucuugcgcucaagaagcuugcuguguauauauggcauuuuuuaucuuguauuuuaaaaacuauaagucaauuucuguaagagaagauugcuagggaaauucaaaaaagggagauuucuuaggaauucaagaaaaaccuccuggaaugaguuagauuauaaaucaaaaagaucaagguccauguuuuagcuuuauccuuaauucuggcacauuuuugugcaugauaaauguugaauaaauaauggcaggauuuguacauauauagaaaaugaggggaaaaaauaaaaggaauuccagggaauuacaaaagccugaaaacgcauacaaaugucaaaaugcugaauuuuauugaggggccaggcacgguggcucacaccuguaauccuagcacuuugggaggccgaggcaggcaaaucacuugaggucaggaguuugagaccagccuggccaacauggugaaaccccaucucuacuaaaaauacaaaaauuagcugggugugguggcgcuuggcuguaaucccagcuacucuggaggcugaggcaggagaaucgcuugaacccaggagguggaaguugcagugagccgagaucgugccacuguacuccagucagggcgacagagcgagacucugucucaaaaaaaaaaaaaaaaaaaauuauugaggaaaagugaguaggucaguuucaguggaacauaugaaugugaagcggaguagauugagauaaggcuggaaagauaagucuguaacagacuuaaaugccacauagugagcuuaaaaaucaguguaucaauaucagaaguugggggugaagauacuuagguuucuuuuugcaggcagaaauuaguuuuucggagugcagccuaagaagcaaauuauagcuugagaaauacaugcaaguaguaucugcaguacaaauacugguuuagcuuggaguaccgguucaucagcaucaucacugucaaauagcaagauucagauuccaauggggcaucuucuguauuuggcuugacuagaaagagaacuuugcuuccuuauauuucuggaagggagcaacacacuugccugacaaguccccagagguauuugaacaguuauuauagaauuuguguauuacugaggagcaccaugcaaugacugcuaagguccuuccaauucuuagugggauucugugacccgcaaauuaagagacagaacacucagguuucaauuucaggugaucuacauauagcugaagaaauggcucauccaucucuuugcagaccgaauuguuuggagccagacuucucuccuuggcugacucaagaaagaguagcauccaagaggggcucauuaagcaucugcaguugauaaagaugagaaggaauuuuagaauacuuugauucaacuguuucuccuaccauuucucaauaccauucuaucagugugauauaugggcacugauucaaaauaucauaaaaacauuuucgaguauuuugugagaccuaguuccaguuagaauuauuaggaaaggcacaauauacuauggcucuucagagcucuuaaaacuagaggaucacgaggucaggagaucgagaccauccuggcuaacauggugaaaccccaucucuacuaaaaauacaaacaauuagccaggcaugguagcgggcgccuguagucccagcuacuugggaggcugaggcaggagaauggugugaacccgggaggcggagcuugcggugagcugagaucacgccaccgcacuccagucugggugacacagcgagacuccgucucaaaaaaaaaaaacuagacguuggaguauggcauggauuuguugcacuagagauuguaaggaugggcauuucagacuuaagaaacaauguaggcaaagauaccagacagaaaagugggggauguguuuccuaggagugcuagaaacuuuuggccauuggacuuguuuggcuggaauacaaaguacauacaggcagaagagguagguuggguucuuuuuguuuuguuuuguuuugagacagagucuuacucuugcccaggcuggaguacagugguaugaucauggcacacugcagcuuugacuucccaggcuuaaagcaauccucccacuucagggccucccucaguagcugacacuacaaguacaugacaccacacccagcuaauuuuuugcuuuuuuguagagauggggucucacuguauuucccaggcuggucucaaacuccugggcucauguaauccucccaccucagccucccaaagcacugggauuacauuacaggcaugagccaccaugcccagccuaaaaucauuuuuaaguugaucuuaucuuauaguuuguuccauuuccccgaugucauuuuaugugacacuugucaaggcuucaugccuuagagacuuaauucacauaaaaaguuuugguuuagcauuucagaccacuuaaaggucaauagcagccaguauaaucucuucccuucuucuacucuuagaaacagguaugaguuuuguuuacagucucucucauauuuuucacaaaacacauauuuuccaaaaguauaugaagguaaauuuggcgagaaaauguaaauguucagaucucccaagagcuuuguguuuuauacgcuaggcuucuaagccucccaagggcuuuguguuuuuauacucuaggcuuuuuuuuuuuuguuuaaguuuuagcucuagguggaacuuuauggauuauguaauucaguauucuuacaguuaaggaaaaugaagcucuaaaauauaaaauaacuuacccaauguaguauaugucaccuguguccucucucacauuuaaacuaauucuuugccuuuauauuuuguuguuuauguaguaauuacaugguccauucauguuuacucagaagacauaggugaccuagggauuggacaaugggcauuuuaaaaauugaguuugacuuuagcauguuuucucuugcaaauaauagccuucaauggcuguauaauucaucacguuaucacuuuuuccaggauuugucuugccucaacagguuucucaucuccuuugcugaguuugaacagcuugauaagcuggagugauguagaaagaugaaacuuaugauagaaggggaugaccuucaaccgauaucuggagauaaaguguuucuuugucuuauuccuucuuuuuaagagauguggggcgggggugggugugggucucacuauguugcccaggcuagauucaaacucccaggcuccagugauccucugaguaguugggacugcaggcaugcaccacugcccccagcuuuuuccugucuuguucugauuagaauuaaaucacagguuuuuuguuuuuguuuuuuaucuuuccauaaguacaguuaaaguaagauucucagggcagcuccugaguuaucgucccuuuuugcuaaaauagauauuuuuagccaagaguuuaugaguaaagaagcuauuccuacuggccaagcgcaguggcucacgccuguaaucccagcacuuugggaggccaaggcaggcagaucaccugaggucaggaguuugagaccagccuggccaacauggugaaaccucgucucuacuaaaaauacaaaaaauuagccaggcgugguggugggcaccuguaaucccagcuacucgagaggcugaggcaggagaaucgcuugaacccaggaggcggagcuuucagugagccgagaucauaccacuguacuccagccugggugacaagagcaaaacuccaucucaaaaaaaaaaaaaaaaaaaaaaaaggcuauuccuacuacuucauagcuucuguuuuauucuuuuaaaaacuugucaguccaugcagcauuucuuguuugccuagaucauuggccacucauaaaugaaggcacuuaaaaguuuuaaguguaauuauuugaaguaguuuucuccuuuaugucucugacaguugguuacuuuuuaugcagcuuauuagucugauguaugaguaauucauccacauaaauucugcuauuacuugaguauggcauaguuuggcuuuuuuacaugaaaagugcuucagggaagguauauggugaagaaagagaaaauaucuccaucugucagggucagaaaaaaacaagagugagagagagaauaauauaaggauuauugaaaucugcagauaaucacuaaauuaauucuuggccaauucuauuaauauccuucucagccccaacauugcuaugaagaaaagcaaguaagaauuuauuauagaugaucccuuggaguuauuaucaacaaaggcaaaaggcaaaacaguagccagguuuuauuggagaaguuuuaaaaagauaaaaucuaagauuuguaugugggcgugugagguaauuauaaugguggguuugggauaacuacuuuccugagugcagacuauccuuguaagacuacaguuguagcaagugccguguggacugcugucacuugacagacuuaaucuggggagaacaauauguguuugaauguauauaauuguaagguauuuuacauuucuuuuuuuucuuguugaccugaccuauuuucuuaguaccuccacucaucguuuuacuuaccauuuuuaauacauugguauggcacaacuuuaggagucuuuaaguuuuugccaguucuggccgagacccauaguuuaaucaaggcuacccuuuauaagaggaauugaucaaauuaaguauaccuacgaucacuguaccucaagaaagacauaggcaagggaaaggcagcuagaauaucaaaaggauuauaugguuauauucauccaauuauggucacauuucuguugguuaauuuggguuuuguuuuguuuguuguuguuguuuuguuuuuuguuuuucuuaguagagacaagguuucaccauguuggccaggcaguucucaaacuccugaccucaagugaucuacccaccucagccucccaaagugcugggauuacagcacuuuguaauguaaaaugggauugcauuuuauacacuuuauaauguaaugggauuacagcucacuuugugagccaucgcacccggccucugucaguuaauuuggaauaggaauaugaagccagcacccggggaaugaguaggaaacauuacagccuucaaagggaagucuucucccuaaauauuuaucaaauuguauuuccccucccacuuacugggagcuacuacguuuuuuccaagcaacugcacuauuuuggccuagaaugccacuaaguuuuuuuuuuuuuaagacaagacauuccuguugcccaggcuggagugcauggcacaaucauggcucacugcagccaugaccucccaagaucaggucgauucucccaccugagccucucaaguaguugagacuacgggcacacaucaccacaccuggcuaacuuuuuuguauuuuuaguagagaugggguuuccucauguugcccaggcgggucugaaacuccugggcuuaagcgaucugccugccucggccucccaaaggguuaggauuacaggugugagccacuguacccagcucuaaguucuguuuauugcaguauuauaucaaggucuccccuuuguuuuccuacaucuccuuugccaccacuccuccccaaaaggugugugggauuuauugagccaucaucaagauaauuguuguuuuuauuuuuugagacagggccucacccugucacccacgcuggagugcaguggugcaaucaccacucacugcagccaugacuucccaggcacaagcgauccucccacacccucucaagcugggaccacaggugcacaccagcaugcccagcaaauuuuuauauuuuuaguacagacgagguuucaccauguugcccagccugguaucaaacuccuggguucaagcgaucugccugccucagcuucccaaagugcugggauuacaugugugagccaccaugcccggccauuaagauuuuuuuuuucuuuuuuugagauggagucucgcucugucacccaggcuggagugcaguggcacaaucucagcucacugcaaccuccgccucccggauucaagcgauuuuccugccucagccuccugaguagcugggacuauaggcgcgugccaccacgcccggcuaauuuuuuguauuuuuaguagagacaagguuucaccaugcuagccaggauggucuugaucuucugaccucgugaucugccugccuuggccucccaaagugcugggauuauaggcgugagccacugcacgcggccgauaauuuuuauuuuuauuuuauuuuauuuauugagaaagaaucuugcucuauaucccaggcuggagugcaguggcacuaucucagcucacugcaaccuccacauuaucgugccucagccucccaaguagcuggaacuacagacacaccaccacauccagcuaauuuuuaguagagaugggguuuugccauguuggccaggcuggucucaaacuccuagccucaagugauucaccugccucggccucccuaagugcugagauuacaggcgugagccaccgcacccgaccaagauaauuuuaaaauucaccuauaggggcaaucaaaacaaagccagagccauuucugagaguaucuacuaaccccauacaggucgucaaaaggcaagauucgcccaguuaaacugguugcuugaucauguggacauaguccauaagcacgcaucccuguuuaugguaguguacugucuuugaccuugaauuuucuguauaagugcuugccagaaacuuacaguuaccaauuauaaguaaugacuacagaaagcagaagagaaacuagauagauuucucuuuguuuaauguuuucacaaaucuaaaaaggaauaugacccuaaucguuuuaagaaaaaagacuuucuuccuuaucauggaagccaggaaagacaggcaggcuccaaaagaacugucccgggcuccagauuauaucugucugagcuagagaaaagagcccaugugcagauguaugacuacuucuguguagucuuuuugugcaaucuaaucuccauagucccuauggauuauuauaucuuauucuuauuguaccauagaaauaaggccaauacucaaugcuaagacucagaauaggcaucagaauuuagccgucuugcuaauucccuaacuucugaccauaaauucauauguauuuuuguuaaacauauuagauuuuacagacugugucugucuugcaggugauggggcagguacagggaaaacuuuuuugauaaucuucagagguugacugugaaacacucuugacuauaaggagguuuugaaagcuguuuggaaaaauaucauaccauacuuauuaaaugggggagaggggaaagcaacagaagugcugagcucuucaacagucaauauagcauuuacuguuuccuauauuuaauagcauucagaacaauagaaacaaguuggcacauagccaacuucagguaccuaacugaagauaaauguucccuagaaacugaauaguuuaaagccuuccugagaaagaaacuccuuuuauuaacuauuuuaugugaacuaaauuccacauaaacuccugcuuaauuuuuuaaaauagucaauuccuagaccauuucucaucuuccuuaaugauccaagaagauggccaggcaugguggcucacgccuguaaucccagcauuuugggaggcugaggcaggcagaucaccugaggucaggaguuccagagcagccuggccaacauggcgaaaccccguuucugcuaaaaauacaacaaaaaaauuagccaggugugguggugugcaccuguagucccggcuacuugggaggcuuaggcaggagaaucacuugaacucaggaggcggagguugcaaugagcugagauugugccacugcacuccagccugggugacagagacucugucucaaaaaacaaacaaacaaacaaacaaaaauccaagauuucugugcuagaaggaagagcucuuaugaacuauucacaugaguguucauagccacuucauggucucaggaaaucaggacaggcagaaagauacuugaaagcaguccuuuuuuuuuuuuuuuuuuuuuuuugaaacagaguuuugcucuuguugcccaggcuggagugcaauggugcagucucagcucacugcaacauggccucccagguucaagugauucucuugccucagccucccaaguagcuaggauuacaggugcccgccaccacacccggcuaauuuuuguaauuuuguaauuuuuuaguagagaugggguuucacuauguuggccaggcuggucucaaacuccugaccucaagugauccucccaccuuggccucccaaagugcugggauuauaggcaugagccacugugcgcaggcuugaaaguagucuugacgcaaauacuuuguaggagagaagcuaacagacaagucaaggguugucuuaauaaagucaagugaggagagaaacccagcuaauauuuugauuaaugccuucucccacaaaguucacucauuggauuuucccuacucaaguucuuuuauccccuaauauuccacauaaugauaauagcugccauuuaucagguacuuugguagaugcuuuauguauguuaucucauauaauccucccaagaauccuccaaguuguacaggcuggaaaccagcuccagaaaggcuaaguaacuuucccaggacauacaaucagaucaccuucuuuuucuuuuaaaauucaccuucaccuuccaaauucuuuuuacagauguguuccaguuagguaguuaaguccugucacuccguuauucuaaugcaaaggugauucuccaguauugcaaagaugauucuccaguauugaacgauuuugaauucuguuaaagaaaacuaguauaccucaauuggcaaaaaaaaaaaaaaaaaaguaaaugaaagggcaguacaguaauucuaaucuuucuuuguuuuuuuuuuauuuuuuuauuuuuuuugagauggaguuuugcucucauugcccaggcuggagugcaauggcaggaccuucccucacugcaacccccaccucccggguucaagcaauuauccugccucagccucccagguaguugggauuacaggcacgcaccaccaugcccagcuaauuuuauauuuuuaguagagaugauguuucacuauguugguuaggcuggucucgaacucuugaccucaggugauccacccaccuuggccucccaaagugcugagauuacaggcgugagccaccacacccggccacaguaauucuaaucuuucuacccuaguuauaagcucaacuugguaaauaaaauauuuuagguagauuuuaucauagauuaaagguuaggaaaauuuucgcaaccuacucaucugacaaagggcuaauauccagaaucuacaaugaacucaaacaaauuuacaagaaaaaaaacagacaaccccaucaaaaagugggcaaaggacaugaacagacacuucucaaaagaagacauuuaugcagccaaaaaacacaugaaaaaaugcucaccaucacuggccaucagagaaaugcaaaucaaaaccacagugagauaccauuucacaccaguuagaauggcaaucauuaaaaagucaggaaauaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacauauguuuauugcggcauuauucacaauagcaaagacuuggaaccaacccaaauguccaaaaaugauagacuggauuaagaaaauguggcacauauacaccauggaauacuaugcagccauaaaaaaugaugaguucauguccuuuguagggacauggauggaauuggaaaucaucauucucaguaaacuaucgcaagaacaaaaaaccaaacaccgcauauucucacuuauaggugggaauugaacaaugagaacacauggacacaggaaggggaacaucacacucuggggacuguugugggguugggggaggggggagggauagcacugggagauauaccuaaugcuagaugacaaguuagugggugcagugcaccagcauggcacauguauacauauguaacuaaccugcacauugugcacauguacccuaaaacuuaaaguauaaaaaaaaaaaacuucaaaaaaaaaaaaggaauccuaaggguuuuuuuauuguuuguauuucaguucugucccugaguuauauauucagauuuuuuugguuaguauuuguaaugguggugagaacugguaggcauuugggucauuagggauccacccucaugaguaaauuaauguccacucucaggagugagugaguuauugcucucauaggaauggauucguuccugcaagauuggguugcuauaaagugagcccgugucucuuugcacaugcccacuugccuuucugcuucucugccagaagccccaaagaugcuggcaccaugcucuuggacuguccagucaccagaaucaugaggcaaauaaaccucuuuucuuuauaaauuacccagccugagguauucuguuauagccacacaaaacagauuuagacaguauucuucuuuacaaauaauuuguaaauuuggccuggcauggugguucaugccuguuaugccagcacuuugggaggccaaggugggcagaucauuugaggucaggaguucaacaccagccuugccaacauggugaaaccucaucuccacuaaaaauaaaaaauuagcugggcaugguggcacaugccuguaaucccagcuacuagggaggcugaggcuggagaaucgcuugaaccugagagguggauguugcagugagccaagauggcaccacugcacucuagccugggugacagagugagacucuaucuaaaaaaauaaaaaauaaaaaauaaaaauagagcaaagauuguaugacccuggauuuuaacuuauuguuacaugaguacccauuuuuauuuuggaagaagcugagcuuaagucagauuaaagcuaccaaaggaaacaggcuaaaaagaaccaaugcuaguuuaccuccuguaaguugaauuucuauucuagagagaauggguuagguguguucgauugcuuuagaagauaacuuauccaaauacauacagcacaucacugaaaauuuaagugggaagagaaaaaaauauaaucacuuuuauuuauuaugcuuuaauaauuaauuuguaaguuuuaacuuuuuugauguaauuuagcuuuggcauauucccgugggaucuuuuccuaaaauaaagcuuuuagugagcguaaggacuuaucaggauugguuuguguuugagccuacaguguauguuuauauauuaaucuccaccggcuuuguaucuuccuauucauacaccauucgguaagccuugcauaggauuccauuacaauauauccauugucuacugacaaugagagcaaguagauucugcucuuguucuaucuccuaguauauuuggaugugaaauauauccugcacaaaugacacuucaaaacaggugcauacuuugaaagguuuucuugggauuuguauauaccuugcccugggucacugauaugucugaagagauuugauaauguggcaucauugaguagauuucucuaauugauaaugagggaccugaauaauuaagaaccugugggucuucaaaauuaguucaugguaauaauuaauguuauaaagguucaucaaggaaaucaucaagguuacaacuuuuagauaguuugugguacuauaguccugcuuuuuuuugagauggagucucggucugucacgcaggcuggagugcaauggcacaaucucggcucacugcaaccuccgccucccggguucaagcgauucuccugccucagccucccaaguagcugggacuacaggugccugccacuagguccggguacuuuuuguauuuucaguagagacgggguuuuuagucaggcuggucuugaacuccugaccucaggugaucugcccgccuuggccucccaaagugcugggauuacagggugagccaccgcacccagccuagucuugcuuuuuuaacaguccucuacauguuaucuuauaucucaaaaugaaaauuaugacuguucaguuucccuuucuagcuuuuagccuuaaagcuccuugaggaaagacuccaugugauguucauuucuuuauuuccuuuggucuuaagaaggcacucuugcaaauauucauucccuccuccugaccaggauucauauugauaauauggaaugaaguaaauccuuugugguuuucuuaugcuauaaucauuuuucagacucucauuggaagagaacaguauuugugucuucugccucuagcucuuuaugaggaugugucaguagucuuccuggcuagcgaaagucuuuucuuuucuuuuuuucuuuuuuuuuuuuuuuuugagacggagucuugcucuguagcccaagcuggagugcaguggcgcggucucgcuuuacugcaagcuccgccucccggguucacgccauucuccuaccucagccuccagaguagcugggacuacaggcacccgccaccaugcccggcuaauuuuuuuguguuuuuaguagagacgggguuucacccauguuagccaggauggucuugaucuccuaaccucgugauccgccugccucggccucccaaagugcucggauuacaagcgugagccaccgcgccuggccaagucuuuucauucuuauugcauuuguuugguucaauaucauaauuuaugaucacucagaugccagugaucucuccauccuaccauaauuaccucuuuaucugaaaacagcugcccaccugccauuugccccaucacugacacuuugagcauggucuuuauuuuauuguguauuguauuuuuuaguguuuacucuaaaaacauuguagacaaagacucuguuuuauaucuuuuuauaccucugauguaaucucuuuaugguaaugguaucaauaauaccagauugucgagcucuguaauuuuuuuuuuuuuuuuuuuugaaauggagucuugcucugcugaccaggcuggagugcaguggcaugaucucugcucaccacaaccuccgccucccagguuugagcaauucucugccucagccucccgaguagcugggauuacaggcgcgugccaccaagcccagcuaauuuuuguauuuuuaguaaagacgggguuucacuguugagcucuauaauuauaaaauaauguagugucuggcaugaaaguggaucuuugauuaugccuaccugaugcuuugccuuauccuucacuagaaauaagaaccuauuucuuaagccagcugucauagaacuaugggguaggaguuaacaaggagaaaauaaauagauggcucccugaaucuauauaaauuuccuacccacagucuuuuuuuuuuuuuuuuuuugagauagucuccugucaccuaggcuggagugcgguaguccaaccuugacucacugaaaccuccaccucccagguucaagugauucucaugccucagccacccgaguaacugggauuacaggugcaugccaccacaccuggcuaauuuuuuuguuuuaguagagaugggguuucaucauguuggccaggcuggucucgaacuccuggccucaagugaucugccugccucagccucccaaagugcugggauaacaggcaugagccaccgcgccuggccaauuuauucuuuaccucuugguaauugugucuuauuucucagcuuauuuccuucacagcaugaaauuauauuuauuguuucucucccuaucaggaaccuugucuuauucauuguugaauuauuagcaccuagcucagaguuugguauauaauaggagcuugauaaauauugagugaaugaauaaugaaaagcauacuugguuucaugaacaugaauaccuacuuggaauuuuuaaaaccacuuuuucuuccacagacuggacuugagggacacauaaagagaauccaccaacaccucccccuccacacacaccagcuucccauucucccacuccaacucuagcuauaggaguuauuguuccugggccgggcacgguagcucaagccuauaaucccaguacuuugggaggccgaguuggacagaucacuugagcucaggaguuugagaccagcauggccaacauggugaaaccccaucucuacuaaaaauuuaaaaauuagccaggugugguagcaugcaccuguaaucccagcuacucggcaagcugaggcaugagagucacuugaauccaggaggcagagguugcagugagccgagaucacaccacugcacuccagccugggcaaccaugcaaaacucugucucaaaaauaaauaaauaaaaggaauuauugcuccuugguuuaugucccagauggacuuuugcagcaauacagugaugugguaguaaagauacaaggcugaauuugcaguugucuagacuuaauuuaauauagaguauccaauuuauaccuuguuuuucauguucuucacucuaauguccugguaggauugaaauuguaucugaagucugagcacacugcgugccuagggccauaguagaccuuucuucaaauuuaaauuagcugaaggcugguuguccuguaugugaaaauguaauccaaauauccugauuaggcacaggccaucccaauuaggugaauuaucugaaguccuugcuuuuuaucugcugacauuuaugauuagaaagccuuaaagcaguuaaauuucauuaauggcauucauuuguaucuuauuacagauugccuguuuccugcaacccaaagaagcugcuuuccuucuccuuaucuaauauuuaaguuugaacauauauuaagcauaccuauuaaaggaacuauacugguggggcacaguggcuuacaccuguaaucccaacacuuugggaggccaaggcaagaggauugcuugagcucaggaguucgagaccugccugggcaacacgagaccucaucuguacgauaaaacaaaaaauuagcugagcgugguaguggugcaggccugugauuccaccuacucaggaggcugagguugaggcuguggugaguugcacuccagccugggugauggagcaagacccugucucaaaaaaaaaggaacaauucugcagaauaaggaaggguuaggcaucuguagcccuacguguaaacccuuucugcuacagucuccaaaagugaucccuauuagcacgaguucuuucucucuccaucuguagauuaugaaaaauaauucugaguaaagaugcuaggagagcauucauuuauuagaugcauuccauauagacaaaguauuuaccaagaaacaagcccaggagcagggaaccaccagguugccuggugaaccagccuagaucagaaauggagcaggucaaaacuccuguacugaucaguagugggaucaugccugugaauagccauugcauuccagccugggcaacauagcaagauuccaucucuaaaaauaaaaaaaagagauaagauuuuuauauccuuaaauuauuauauauaauucuuucucuuaaaagaaucuucugcugacucucaacuuuuccuggaaaaaauggaucauucccaccauauggggaugagcuauauggacuccaacaguaccaugcaaccuucucaccaucacccaaccacuucagccucacacucccaugguggaggagacagcagcaugaugaugauggugagugccauaggaggggcaaugcaggcccuuucccacccacuuggguaauagaaauaauggaauuuuaguacuggaagcuuauuaucuuuaaaggucaguuuaccagugaggauaacuaaagcagacccaagcaagucaagucauuugcuccagauuauguggcaagcuacuuacagagucacaccagaaccaagauuuuaggcuucuuucuuugguggucccuucugaaaucgacucuuuucugaauuagggguucuggucuuuaugccuuggguggaaaagagaaaaagacaaaaguuggccaggcacaguggcucaugccuguaaucccaacacuuugggaggccaaggcagguggaucacaaggucaggagaucgagaccauccuagcuaacacggugaaaccccaucucuacuaaaaauacaaaaaauuagcugggcaugauggcauucgccuguagucccagcuacuugggaggcugaggcaggagaaucgcuugaacccaggagguggagguuguagugagccgagaucucgccacugcauuccagccugggcuacagagcgagaauccguaucaaaaaaaaaaaaaaaaaagauaaaaguugauggugggggcccaggagaaaaguugauggugggggccuaguagaauacucaugcucggugccuguggugguaacgcuaacaugagggcaaaagccucccacucacgugaaugucucuuauuauccagaucuucuacuuuuaaauguucuaagcuucuuugccccaaauucucauuuagaauuuucauucaucucuaacugacuuguuuugguuuucuggcagccuaugaccuucuacuuuggcuuuaagaauguggaacuacuguuuuccgguuuggugaucaauacagcuggaggugaguaagccauuagguaguguuggaaggugauagucacaugagagacagugacaaauaauuuggaaguccagcaccucuuucuguccuaauuacuaagucaacaugguaaugaugcauaaccaucuugguuccuauuuccuaccuagaagguaggaaacacaguacuuuuuugguccucugguaaaccucuguuaacuaacauguauguuuuggagcucuaaaaaauaauuuagauaccagauagaaucuuuugcaauccauuuucuuucauucuuuuccagaguguuuaauuuuuuuuuuuuuuuuuuuuuuugagacggaguuucacucuugucacccaggcuggagugcaauggcagcuaucuuggcucacugcaaucucugccucccagguucaagcgauucuccugccucagccuccugaguagcuggaguuaaacaggcaccuaccgccaugccuggcuaauuuuuguauuuuuaauagagacgggguuuugccauguuugccaggcuggucucgaacuccucaccucaagugauccacccaccucagccucccaaagugcugggauuacaggcaugagccaccaugcccggccucagaguguuuacuuauuugauaaguuauuaguccuggacauaagacuaacucaaauuaaguaccacaaaauaaguuuaaaacuauuguucuaauacuucaauuuuacaauaaauuaagugccacaaauugugaaaugacucgccaucaaucauagaguuaauaugucagagcuaggacaaggacccagaccuucuagagcuaccuagaccaguguucuuuuagucuaccaaacuauggcccacauccuuccugauucuuggcacggcccaucuuagacacuccuaguuuugagguagaugauuacccaucuguuugugucuauuauguuguaugguauacuuuaaauuuaacuugcgcaaacucaauagucaguuggacugccuuagguaccagaugucuguuuggagccauaaaaucaauuuguuuugggaagaaggagagcauuuaguucagguaauguguuaaauuagcaguuugaauacauuuauaucauuaccaacacuucacagugugaaagacuuagaauugaaaugccuauucaggaaauguagucagccacugaugaaacuaaauuguuuuauucccuguuccauauucuacauuguguguuucaguguaacaaaccuaauuuaaugauaucaagcagucugaccaaaagguuauuguuguucugauuauuuuucuuaucuuaaucagaaaguaaauauguucuuggcagaggcaauaguuuucaguuacaccaucuuagccguucuccuaucugagcaagagaagagguaaaaauauaaugucuucaaaagcugagaguagcauuuuuucuaugugucuuucuagcuggacagcacauuggcuaaugauuuugcacauguuugacaguaccuccauauuuuccuuccauacuuagaaauggcuggagcuuuuguggcaguguuuuuacuagcaauguucuaugaaggacucaagauagcccgagagagccugcugcguaagucacaagucagcauucgcuacaauuccaugccugucccaggaccaaauggaaccauccuuauggagacacacaaaacuguuggguaagaacugaacagauccagaugaaguccuaaagaacucgaucaguuaagcagcaaagcgcagcugugugaucagcagcagcccucuucuugaguuaggaguucuguaugaccuugaucaaaacuguccuuggagguuuggguuuguaggucaugagcaggccaaaggaggaaugagagggagucuucugcaaauaugaauguuuguucugaguuguacggauuggccacuuuggaagaagggaagugaggaauccauauuuuaaaauauuuaccaaaauaauaaugaacaaguuaagaaauucagaucaagauauaaaagaauggcagauugcaguugauucuauaaaguuacaccuagucagcccuguccucuuuuucuuuacaauguaagacuguauugauuucuguguucugucuaagaaaguauuuggaugauuauugguuuuucccauagauuggcaaauguuuuuugagauuguuuuaauaaaaauguaagucuuaaaaccaaauuggaccuuaagaaauccuauagacugauauccugcuuucaaacaagcaguguuauuuauuguacugaugagcuuacuggggcccagaaggauugugaccuaccuaagguggcacaggggaugaguagccaggucuccuuaucccuaauuaaguaauuucuucuauacuacccaacccucaauucuauuuuuuuuucuuuuuuucuuucuuuuuuuuuuuuuuuucuggagacagggucucccucuauugcccaggcugaagugcaguggcacuaucuuggcucacugcaaucucugccuuccagacucaagugauccucccaccucagccuccuaaguagcuggaacuacaggcaugagccaccacacccagcuaauuuuuuuuauuuuuuguagagacaagguuucgccauguugcccaggcuggucugaaacuccugagcucaagcaaucagcccaccucggccucccaaagugcugggauuaaaggcauuagccaccacccccagccucuguuucuguuuuuguagaauguaaacuuugcaaaggugggaagccuaaaaauauucgggcagaugagcgugagaggguuuacggcuucccuuucaggaucuaagguggagguaagucgggauuacuccucguccuuuucuccuccuccggaaaaggguuccuucuacuggaggaaccacagccauaucuggccaauguuuauaagccugacagcccugugcuguuucauuuccauggaccaaucaaagaacauucaaguacccaugaguugccagaguggcuguccaguuccagcugagcucauggcaagaacucuucccucuuucuccugaucugcagaacuccuaggagucccugauuguugugucccuguuuacucuccaggcaacagaugcugagcuuuccucaccuccugcaaacagugcugcacaucauccagguggucauaagcuacuuccucaugcucaucuucaugaccuacaacggguaccucugcauugcaguagcagcaggggccgguacaggauacuuccucuucagcuggaagaaggcagugguaguggauaucacagagcauugccauugacaucaaacucuauggcguggccuuaucgauugcagugggaaguuguugaagacuugaagacgugauuccugcuccaaucaucccuucuugcuccucuuugugcacguacacacacacacacacacacacacacacacaccccugcucaacagagguuuaguuuacagucucugaacuaaaguaguaaccucccaaauuguuuuuucuaauaagcugagauucccauuucucuuaaggagaagccacccaugagaugucuuuuccuucuccaucaucuuagagccaaguuauauguucuugucuaauccauguagcuuuuuguucaaugacuugaucaucugcuuccuuuuugaauuuuuaacagauaguaaguaaauuuggugguuuuuuccccugggucagugauggaaagggguuaacuucagccaggauugauggcagcugagggaaauucuugcccaacuaaacccagaacucaaacuuaacauuagaaaauaagguccagggccggacacaguggcccaugccuguaaucccagcacuuuggggggccaaggcaggcuggaucaccugaggacaggaguucgagaccagucuggccaacauggggaaaccccgucucuacuaaaaauacaaaaauuagccgggcaugguggugggcgccuguaaucccagcuacucagaaggcugaggcaggagaaucacuugaaccuaggaggcggagguugcagugagccaagauggcgccauugcacuccagccugggugacaagagugaaacuccaucucaaaaaaaaagaaaagaagguccagcuuuuggauucaaugagugggaaauacauugugccuuucucuagaugugauacguuauaccaaaaucuuuguagugugcagagcggugguuugagacuaaauacaggcuuagaacuugcagaguguguauucuuggauggcugaugcaucgacuugcauucccacuuaacacuuugauuagcaugaacuugccaaucaaaaaaugacaaucaauuugagaaaauagaaauagauauuuuuaaauaaaaccauucacaguuuacuuugucuugauaccuugguuugucccagcugaagugaagcaagagaguuugaauuaauuuuuccauuauaauguuuucgcaugucugccucuaaaacugugauuuucaagcuuuagcgugcaucagaaucaccuguagggcuuguuaaaacacuaauugcugggccucaacccaaaagcccccaaaguggcacuucugaguuccugcugauguuacaagggaccacacuuuugagaaucugugcuuuaagcuaaggaaauauugccugguggguuggcugccugguauugggcauggaaauuugaauugcugauugguagauggugugucuggacuuaacucacguaguaaauacugcugaucaauaccuaaucauuccacauuuauugagcuccaccuguguguauguguacccaagcacacaugugugaagggcuauagccaaaguauuuuuacuagccuguaugaaaucacuaguccuuauuuuuaaaggucuaugguuucuuggaaguaguuugauuguugagagagaccuuugaucugcaguguaaaucuaccagucaugggccagaagggcaaaagcccagcuuucucuuuggaaagacucaggcugugguuuguugauggccagguuuuccucaggcuccaacaacugugcuuauaccaagcagauccucauccuccauauaaucaucuuuguuauucguggggguuuaauuacauuacaaguggccaaaaccccuguucucagugaagaaccacauuggauuuguauucuguucaguuguagucuacacugcagucuuauuccugguucaaacuaccucuuuaaauugauuugucuugugcuggucuguuaaauccugcccuccuuggugcuagauccaguugugccucagggcagaggaaacaaaacacagcuauccuguuggccuguguugugguuuugaaguuuguacuuucucugugggugccaguuaaauauuggagagcaaggaauguggacuuguauggcuuugaaccaagagaggguuaugagccuacuggauugagguuaaaauccaagaaccaacauuuagagcuuugugcuuuucucucauuccaucacuuuguaaugaugauacuuaacaugagcagggugaaugacagguacugacgaaguccaacacaaagguauaauacagccuguugucuaaagccaaggagucauaaaaccaugagaaauaaauaggaaucaauaguuaguagugacauuggugcucucuagaaaucucagcaugagcugcuauagaauacccucccagcaacaaaaccuaaucaguaaggccagcuagacccaauggcucaugccuguaaucccaacacuuugggaggccaaggugggaggauggcuuguguccagaaguucgagaccagccuggacaacauagugagauccuaucucuauaaaaaaucaaaaauuagccaggcaugguggugcauaccuauaguccuggcuauuugggaggcugaggcaggaggauugcuuuagcccuggaggucgaggcugcaguaagccaugauugcgccacugcacucagcccgggugacaaagcaagacccugucucagaaaaaaagaaaauucaaggccaguuaagacaaaaugcuaugacuuugaaauucacagaaagaaauaacaguuuagauuaggucuucagguauucaggauagagauaaucuccugaaaaaccugaauuucagagauucuuagacuggcugccaaaggaugaagcuagugaaggagaaaaagcuuaaauuccaucuugagcucuuggauugugauaauacaaugauuucauuaacuuuucauuucuguauaccuguucauuuggaauuuaaugcuugacuucuuuguucauuuuggaucuaaacuucucuuuucuuccuuccccauucacaucuauuagaagacugcaucaccauuucuuuggcccccuuacucuguuguccuuucccuuuucuuucaguuuuuuuaaucgcaugucuaguauauuaagucuccauagcccuccugaugcaguagacagugcuaugcuguggauauaauaccaaccagaaauuggcauuuauaaaccuguuaagagacuuuaagcaugcuucaagaggcaguugacccacuggaauuucuauaaggcugguacccuucccagaguuacagaaucuuaggugccgucucuagucugugagggaggaacucccagcauccccauugcccacaaauggaauccucacuguauccacuaggagauuagaaauuaagguuucuucacuacuucuaugguaggguugucugaaauucccuuucaggcuguggguacuggucuuggguucuagucauaagggguuccuuauaaggagcaggcggaggggaguacacuuucaugugauuuaauuuugauccugcccucuccagcugcuccuucaaaagauacaucaaaagauagaaacucugggcugggcacaguggcucacacacuuugggaggccaagcgggggugcagaucaccugaggucaggaguuugagaccagccuggccaauguggugaaaccccaucucuacuaaaaauacaaaaauuagcugggcgugguggugcaugccuguaaucccagcuacucgggaggcugaggcaggagaaucgcuugaacccaggaggcggagguugcagugagccaagauggcgccauugcacuccagccugggcgacaagagcaaaacuccgucucaaaaaaaaaaaaaagauacaaagucugcauuugauauaaugccuuaauuacugggucuacaauuaauguugacuguuuuagauuguaagcuccuggagagcaguauugcuguaguaggaauguuuuaacagugucauaugaaaaagaacaaaauaaauauuuugauuuugugauucuaugcaagucuuucugcccagagugauaaugcaauaagcuagucuuuucauagucugcauagagucuggccauuaccaucaguuuuuaagauguccauauuguggccgggcgcgguggcucacgccugguaaucccagcacuuugggaggcugaggcagguggaucaugaggucaggagaucgagaccauccuggcuaacacggugaaacccgucucuacuaaaaaaaauauuaaaaaauuagccaggccugguggugggcgccuguagucccagcuacuugggaggcugaggcaggagaauggugugaacccggaagucagagguugcagugagccaagauugcaccugggcaacacagcgagacuccgucucaaaaaaaaaaaaaaaaaaagauguccguauuuuaggugguaugauccuuuuagguuuucaucucacucucccccuacucgacuuaaaaugacaugccuaguacaugccagaagauccaugugaccuucugcacaggagacagggucuucaugaagccacaaguauuucaguauacugaggauuccucaguuuaaaagccaacuuuugucacaucauaaucccuucccugugucugcuguuaggcaagaggcucugagcugggccuauaagaaguucaccgcccaaccuugagaugcacagugacccugccagucccuuugguaaugccaaaaugcugacguuacuugcucuucccacuggcccccagugggcaucuugccaucaccaccauuccuagucucuuccgaguguagugucaugaacauggacuuagaggagucaaugaguuuggauucugguuccaucaccuacuagcaguaugaccuuaggaaguuagucuaaugaucccuaagccuuaguuuucuuauuuagagauggagucucacuccgucaccuaggcuggagugcagugguacagucucggcucacugccaccuccaucuccuggguucaagugauucuccugccucagccucccaaguagcuggggcuacaggcacacaccaucaugucuggcuaauuuuuguauuuuuaguagagaugaguuuuugccauguuggccaggcuagucuugaacuccugagcucaggugauccgcccgucucggccucccaaagugcugggauugggaaaggugugagccacugugcccggccauaauaccuguuugaauuaggcaccuagcacaaaauagguauucgagccuuaguauuuuuuuuauuaucuacaauuguuguuacuccagcuuucagaaugaaaaguaacacucuucuugauaaggu

SEQ ID NO: 13988 - RNA, 6607 nt, Homo sapiens
uaaugaauacagaacacuuuuacugcaaccaguggcaagacauucaaagagaaacaaacacacauuuacccacagaauugaagcucacuucccaauuuuuuuuuuuuuuuuagcaacccauaguaaaagagcaacucaaaaaaauaugcacugauuuugaagcagcuccagugagaaaugcaacuugcuauuugggcuagucagguuccuggauaccacugugcagcccuuuggcacaacuugcuguggagcucuguggucagaaccgcuucucugcccuuccaugacgccacacucacacccggaggucgcuccacaucucccaguccuucaagcuuuucguuuuuuuguuuuuuuuuaaaauuguucccagaagcaaacacauggccugaacaaucccuggauuguaaaauaaacaacacuacaaaggaagacaauaccaaaugaggcuccguagucaccauacccagcagcaaccgaaaaagguuugguuucuugucugggaacagcacucaccccacaccccaaaggaacugcuugguccaaaagauggagaauaugagcaacagagugacacugaggaugacggccaucagguaggcaaagaugcggaacugaggguugcggaaacacucccucaaagagugguggcuggggaugaggaugggcguagacacgguggcagaggccgugucugggggcggcccagucuggcccccaggcugggggccaagguccagcguguagacuugaggcuggcgcaggaaguagcggcucuugggcugguccuugaggcacagcugauggccuuccaggaugacaugguggggcuccaggcggagcagggcgagcauggcaguguccgugggcaagucagugacaggcugcccugaggccagcacugugggcuggcgacagagugggcacagcaggcggcgccgggcuggagucacaaggcugaggugggccagacauuccacgcagaaggaguggcagcaauccagcauuuuggggguauggaacguguuguugaagggguuccagcagacggggcacucagccucaagcucccggcccugcugcucagccauccucagccacacacggggaggcuucgcgggagacguccuggcagaagggggaaaggagcaaaggaacagccaugaagucccauccuugugcuuggccuggggcaaaguguucuguggguguugaaagguguaaucaccacguuuuacuuagguucaaaagcguuuuguucuugaucaccaguuccuaacccaucgaguugagucaaaugcuccuacagccuccccucugucaaggugaaggccugggccaccccuaccaagagcccccaagagagccggcauuggagcagaugucgcccugggcuuuggagcuggacgcaaaugcuccuuauggucauugucugugcccuuggcugcccugaauccagggagcuggggguaagcugcagucugcggguuuugcuacaggacaaauguuuccuucccugcuaccucaaaucccugacuagcgcagagauggguuuugugaauucccuggucugucccuccuauggggacaaaugccagcccucuuucccuccuccccuugagcuagagggccaacccuccacauccuacucacccaguccuuggccuggcaaggaagccccuggaaaggccuuucuccuuaccuggaagccuugcagaagcuucccugccccaguccccagaucagcccuuccagagccucuuccccuuccagagccucuuccccuuccagagccucuuccccauccucugccuacccuggcuccuccucccucccuuuguccugggaaaccuucagggcacgcaccugggcuucugugggcuccaggguggucaggcagacuacucuggagggccugaggcuccaguugcucccuccccugaaucggcaaagcuuugggagacugccuucuugccaccaacccaggggccugucuccauggcagcaugcacgcagcaccuggggcugccagguggcccagucggcagccucuugagcacaccugcuuggagccaaggccagagagcuuccuggggggugggguggggaggaagaugggggaccugaguuccccccagggcauggcaacuaauugaaccuggaagccaagcaccugugagauugugggcagucccuucaacaccuggagucccuggucuggaaagguaggguggcaauuucgucuuuguagaugugaagaggguaacugagucuucugggcuuccucucucuggggcccucauuucucuucgaaaguggcuggaaccuccuccuugcacaaaggggcugccugcucagcacuuugguugcugugaaagucaccuacuucgaagcuuaagagcuccgacuaucagauucaguccagucacccgcugaucuuuuaaugugccuaaguaacugcaaucagcguguacaaaccucgcugccuucugcuuuguucuuagcacacagcuggucagccuucugagaucuuagagcuggccaucccaccaaccuuagggaguuaaagcggggaguuggagggaggcgcacuccagcccagcuucuccguuucaaccagaaauacuuggcuuuucucuguuucucauaugggucauucgaauaauuugaagaguugaucugcuggggaaaagaaaaaguuuaaaaaccaauucuccaucugaacuacucacuuugcagaugagagacaagaagugacucacccaaagucacccagcuaguuaauggugacaugggacccaugucuucagacucaugguuuucguaaagacagaaggcugcauccaugccgucccccuacucagugcguguuacuagcuagauaauaaguguuugcaugugaucaggaauccuucacggccagaagacucaugguagaaauccaggaacuguggaagaggggaucugggggaagggagucucccuagagccccugauaugacaucaucuaccccgacugagccgaugucugaagcaaaaccugcuuauacucucggaccuguggcuuccugguuuucuucuagaccucuggcacugcuccaaacagggaaggaggaaaugaagauaugcagagggagauggagcccuaagcgaaacuaggguaguuuagcagggcucugcaccagugcuuuauucugcaguccauucauccacucggacauuauugagugcuuacucuagcccaggugcugugcaagguauuauggugaacaaaauagacauugucuuugaccucaugacauuuagaguguagugaggcaaaaagacauuuaaugaauaaugggcaauaaauaaauacacaauuuuaaugguuguuaauaaagggcaaaaaggaaaaugggcuucgggugcuugguggcugcucccaaugagaccaccagagaagguuucugcaaagagaugacagaagagcugagaccaaaguauauaggaauccagccacgcacaguggaggaagagcguugcaggcccagggaacagcauguguggccccgaggugagaaaagcucuuccaauuugagaaagugaaaggagcccagggugaucaagguguggugaccggaguaggcaaggugggaggguauaguacucgggaccugugaacucaggagcucaucuggauuuuauuccaggggugagcgguaggguaagguaccugauccuauuuccauuuuuaaaacaccauucuagcugcagagcagaggacaggcugagagggauaagaucgggaagggaacacccguucgggcugcagcaguguggcucaggcgugugaugguggugcagguuaggcaguggcagaggagauaaaaggggaugggauaagugauaucuuuggggacagaaucaaagccacuucccaagaagcaguggaguucuagggauccaguuguaguuucugucaagguucaugaugccagauccauggcuauuuagggcugugauuccaguugaauugcuugaccucucugugccucuauuucuccuugugcaaaggaagccaaaacuaguaaagcuuuuaguuagagcccagcacccaguaaagaccacaaagcaaugcaugaccuaaaaaugggacuauguucucagaaacacaucguuguaugaacagcacagagaguauuuacacaaaccuagaugguagagccugcuacaugccuaggcuauacggucuagccuguugcuccuaggcuacaaacccauacagcuuauuauguucugaacacuguaggcaauuguaacacaaugauaauugcgugugucuuucaacauaaacuuagaaaaggcaagguaaauauaugguauuauaaucuuagguggccaccaucacauauguaauucacuguugaucaaaacauuguuauggauauaugaggcaguugaaauuauuaaugcaaauggauuugagagaaaggaagggucaagguugauuucaaagccgugacaaaguccucugcaucaagcuuugagaagccccugaaucccagaguguguuagaagcagaucuuuaauacuuaccagaggccguaaacuguauguaaccuugacucaucauuucccccacugggaaucgauuccacggaaaccaucaaggacuucugcaaagaugugaguaaagagaugcccauccaggcgcugguuuaacggugacguauggagaacuacgucaucauccaguaauaggacauugauuaaguagauucugcuccauccauaggaagagauauuaugcagccuuuaauaugaugugguaaaacuauuaauauggauauauaccuaggauauaaugucauuaagcgaaaaagaaccagcaacaaaaccauauuaccauauaauccaauuuccaaaagugugugugcaauggaaaaaaugucuggagagauaaacaaccagauauuagcagugguuaucucugggggcaagauuauaaguuuuuuuuuuuuuuuuaauucucuuaccugaaaauucuaacuuuacuccauccaguaagcuuguauuacuacacgucaagaucuccuguuuccccccaaaucagaccuaccuucucugaaguuccauggccagaacuguaaaaggcuguccaagaggaggaagcaucauuauugccuggaucuuuaucugugcugcucucccagggauccacugcuguuucaggaucagcuggggagagauucuggccauguaucaccuccaccccaagccaggacaucucagcuacaguaaauccuaaacaccgccccaaagucaucuccuuggucuaugaacaagucaucgccaaauaucaauuguccccagcaucacuccauuguuuucaaccaagaacuggcauuuccauagcacuucacaguuuacaaagggcccuggcccuugcuaagaucuaaguguggugauccaucuagauagguuacuagccuuuugggauuuuuuguuguuguuugcagaaagccauuugauacucuaaaaccacccugugagagaggcugaauggggaguagaaaggugccggcuuuggaaccagauuuggaacaauuugucuuggacaaauggcuuaaccucucugaacuucauuuuccucuguaaaaaaggcuaaucaucccacuccuacaagguugcucuggggaaggaauagucuauacggugcccaguagaauacggaaggcgcucaauacagaguuagcaugauuauuuuuagacccauuuucuagauggggaagccaaggcucagaagggugaggcaacuugccgaagucuucccagcuaaagaguggcugaguuugaaagaugaacccaguagccugcccucccaggccagaguucaccugucgcgcgcugcacggcugcugccucucuggacucuggagcccugugacccgucccuccgcgacccucucugucuccuuaccugcucccucggagccgccuccuccgccuccguucgugcagcccugcacgcaugugcuuuguuuucugacuucccaggcccgauuuccagguagcgugggugggucuuauuugcauaggucuuagcagcguuuggccagcucucgcuguuucagguuuucuucuuccuucuggugacuuuggaccuccuguacacccuggaagcuuugguugcuuugucuuucuccugugagucacucuggcuuuuucucugaggggaucaagugcgcucauccuugcaggccucuguucuggguccgauugaucuccugccauccccucggauuccacuguccucugugcgcugaccugccucgacuccuggcuucugccgagauggauccuucccuaugcugagucccuguaaccaaaauacagauagcucuugcaaaauacugacaaaagcggccacuaauacagcagaaaaauagucgggagacgguugagcgucugccugaagagccaggguucucaagcaaggcacacuucuaggucagaguucagcccucacugagaauccaaacuccguuuaacuaccgauggagacuugagcaaauuaauuaacuucugccagccucaguuuccucaccugaaaauggccauaaua

SEQ ID NO: 13989 - RNA, 4716 nt, Homo sapiens
cugcagcuaaguagggacuucauuagggucaaggccugggccuggcuuauuucuguagguccagugcaggacccagggccuggcggauggcagauacucaguagaauuuugguugugugacugacugaaggagaacgacuuggguugccucugaggcuuuggagucuggucguggaggaggggggcuggagaagugugcugccuggagugggcccaugcacacaggcuggugucugggguugauuccuucucaguugagagguacuucugugucucccuucugugcucccagccuguauccauguuucauuccccucugagaguauaauacauaguaagucagcaagagcacaguuaucuaagccauggggaaagggacaagugaggaaaugaugaugauauuaauaaccaugcuagcucuuugaaugcauuguauuaagauccugaccuuacuuuauguauucuucauaauaauaaaucuucacucuuuaccagggaucaagucuuuguagcucacaauuuuaggauucagaggaaagggugaaauucagggcacacaauuucccuuaaacacacuugggauuguccagagguuaaggcugucaccagggugcuggcuucuuagucccccuccucuggcugggcugccaagagauagcccuucaggaguguugggucauccugaguugaauaggagggagaguuaagccauccugaguugaauagggucuggugcccuuccggagcccagagugccugcccggcugugguuggcauguuucccagggcugcuggugcccuuggcauugucccugcccuguaaaggugaccuggccucagauucgccacugccagggcaggguggcugccagggcucgccucagaaucugggagcaaagcccuguaauuacuguauuuggucggugaagcagguguuggaggagaaaagggugauauggggguuuggaccagacaucgguagcaggugggaaguaaaugaguuugccuucacagagcucaguaacuggguugcaagcuguacuguucuaaaaaaaaaaaaaaaucaguuuuacagagccacucccacuagccacauauuauccagggguggguggagauugggcacaagggcaugacugcugcauagguuggguuaauccugccuuguauaauuuacuagccaaaugaccagucacccuaccauuccagaccucaguuuccuugucuacaaaauggggcugagccgacuuuuccucucugaaggcagaauuauguguuggguacuucaggugaggcccuuggugaggauucugugacagcccugggccccugggcuagagaagggaagaaaucaauuuuuuaagaaguccgagacugggggcccaggacccagauuuuggcauuuacaguugguacccaucuuuacuuuuggucuauuuuguuccagucaucugcuugucaguccugcaugguuuugccuucucugcuguaggcuuaaccauguuaaauuagacugucuagauccaggcuggccaugggguuucauucacagcaugguuugagaccgagcagcccugccuauccuucuacuaacccugguagguggauuacuuggaggcuuaggauuugugauaauccccugacuacucacacugugguacaauccaccaagcucuuuuccaucaggucucuugugugaaccucccacuggcccuggggcaagcgaggcagcaaucaguauuaucuccacuucaaaguggagaaaacuuugauucagagaaggaaggaagcuguucaggguuacacagacugucucugacuugggaagucagugaucaagcucgggugucuuauccaacucaaauucagugaugaucuugagacugaggauggugcuuuaaacaaaggguccagggccuggcagcacacaucccucugggacugauauguagggccagaucagacaaggagcuaugugacaucuuccuuguaucuguuccuccugugcccauccagggcucaugcucauucuacuccucucuccgugacucacagaagaggcaggaagugguuugaguuaucaugguuugagcgcugcccccagauuugucuaugaucaguggucacuugucaggggcacggggggagucaacuuguuuuucuuaccuugcuuggugagaaggggcugggggugggaggaggaagcaagugugaaaccuucugaggugaguuuuaucuccgaggcugugggugcgcguugguggggagcuucccugagguauagcuggggucaggccaccuguuccccccucgcugccagggcugcuggcagcagaagacagccugcacccaggacccaggcugggcacccaggucagugaggaccugguaguugcccauacaguagcaggaaugccuuagaaggggcccaggaguguguggagccugacugcuuuggaguuucccucccaccugcuugguccaggaaccccugacuuuuuagcgacuuuguguuuugucccucugccuacuagacggaauguaacaaaaaccugugcacaggcugggcaugguggcucaugccuguaaucccagcacuuugggaggcugaggcgggcggaucaccugagguugggaguucgagaccagccugaccaacauggagaaacugugucucuacuaaaaauacaaaauuagccgggcgugguggugcaugccuguaaucccagcuacuugggggacugaggcaggagaaucacuugaaccugggagguggggguuguggugagccgagaucggccacugcacuccagccugagcaauaagagggaaacuccgucucaaacaaacaaacaaaaaaacaacaacaaaaacgugugcaccaccccuuguucagggugagggguguguguccaucaguguccccuuaaagagggaccccuccccccacaccgccguugcagccucugcuguccuuccuggggguggucuuguuucucuguuucucucucucucuccuuaugauuagaaugauuugugaguugguggccaagccggaguaccuccuggguacagugaagccugggauucccagaguccuauggggcaccugacucccaaacuugcuuuuccaaguggagaaaucacaacaacgaaacaacacugaguuugcagcuaacuuuuaucacacacuuacuaggucccaggcacuguucuaaagacucuaagugaacuuagaguauuucauuuaaucuucacuguaacccagugagcuuggcacuauuguuacaguugaggaaaucaagacucugagggugaaauaaguugcccaagcucacugagcugguaagcaggggagcaggauuugagcacagccaccuggcuuugaagcuugugcgcuuuccugugaccuggggcagcaagugccacuccuuauucuagacugacuggagugggccaggcugcucuagcucccuuggcuacagagggaggacuccaguacauccugggaaagccuuuggucuccgcugccacugcugcagagaguggauuuuugucuguggggcagggagggaggaaacagauugggcugggcugagcuugugcagggaguagugggaauggugugggggucuguuaaggagagcgcguacccugccacacaggcuggucaccacucugcuccaacugauuguuccacgugggacugugggcucagugaggacagaucuucugauuuuucaaauaugagcgauuucuugauuuuuaaaagacugaggccaaaauggaaauucugauccggggccugggucagcagguggagugugcugccuccaucauagcugguggugcccagcgcugugcuagcccuggacuugcuugcucacgugucaacgucucucacuagagugcgagggaauuccuugaagcccgagcccaugugaagccucccuguguuucagcaucgugcgcagggccuggcacaaaguagcugcucagaaagugguuguugacggaaugaguccguguccccuguuucuacagaggggacaccuuugcaggagugacggaaaugucucauagucccccaucucuguuucacagaaucagggagucccaguaaagggaaguccuacacaggccuggggaagaagucccggcugaugaagacagugcagaccaugaagggccacgggaacuaccaaaacugcccgguugugaggccgcaugccacgcacucaagcuauggcaccuacgucacccuggcccccaaaguccugguguucccugucuuuguucaggugagcccguggcuggucuuaaagguucccucaggaggaacggagaaagaggagggcccuugccccaggacucagggaugaugacuuaucccaggacugagggcccuguuuugggaaagauaaguagcuuuagaugcauaggauucuaggggcuuauacugagggagcagagauuuccagggagauacacaggaaaaagugaggccgggauagcccaguaaggaaaggguccucuccuucccccaccucgccuccccuuucucuggggaaagggcaggugcaccccagcugcuuguugccaugucacagggacuguuugccaaagcucccgcucccuggcucacccagugguuuuuuauuugaaaauaacugagggagacccuuggggucugugccuuaucugcucucccugguc

SEQ ID NO: 13990 - RNA, 10966 nt, Homo sapiens
ccgaaucacagaaguucaagagcggucagcugaugcuacgcugugcggucacgugacaacgggggcgaagcgcaggcgcaaggagcaagcgcagauugugggcggcugugucagcugacccaaggggccuucgaggugccuuaggccgcuugccuugcucucagaaucgcugccgccauggcuagucagucucaggggauucagcagcugcugcaggccgagaagcgggcagccgagaagguguccgaggcccgcaaaagugaguuucaggguggggcugcccggcguggcgcgagucgaagaaagaccgcugggccucaggugguggguagauuaggcccgaaaaacugcggggugcgggcgugcguauagucgcggaagguuguguguuucgaagcuuugaggagcugaggcucuggaaggcuugcggaucgccuggaagccacgaugugagaugguaaauugggcguggaaacaauaauggguuaccguccuuggggccuggaggcaugugaaaugggcucuccaaacggagcucuuuguucuucuucucucccacuuaaccgcucugggguggucagucucggugaagggagccagcauccacacaguugcuuggucuagaaaccuggaguccugcuugccucuucucccucccucauuuagucagucgccaaggcuugcguaucuuucacuuuuucccccaugucuacuaccagcgucuuaguccaggacaccaguuucucuaaagguacuguaguugucuaaaucguuggcgugugugcguguguguguuucugauauguggcaagcgcaguguguguguguuucuaacauguggcaagcgcaguguguguguguguguguguguguguguguuucugucuaauauguggcaagcgcagugcccagugcaucaguugucuccccuaacguggcauucagugucgcagugaaggaagcagguauugggucaguuaauuaauugcaggagagaugagggcuggaguggagaaauguaagguugcuaaagaauuuaacaggugaguuuaaucuagacuggggaguggaagaacccguucugguccccuccagucaauccauucuccucucugcaaucagucauccuucuaaaaugcaaauaugugacuuccugcugguaaggaacaaaauaaauaaauaagugcagauaugauuucccuaccgccuuuguagucagacguuuaguuccugcagaagaaagcucaaauuccuuaaugaaguuggggaggcucuugugggucaggccuggugcuuuccuccagcuauacugaaucguuguggucccucagaagcagcaugaugucuuucaccugcagguuuuugcacacgcuguuucuucugacgugagaagccuuuuccaauucuccuccccuuuguucucugacccuuagucuuccaucagaccucaauuuaggaaacacuucuucccgggaagccuuuccugacucaugcuugucccccggacuaggcuuggagucccucccaagugcugauuucugccacugccgugcaauaaccuguuuguuuauauggcucagucacuagacuaagcuucuggagaacagaaacuaugucucauuuaacuuuauguauccaguuucccgucuggugagaaagaugcuucuaucccuauuuuacagauaguaaaaaugaggcucagagagaaaugauuuauccauacccugggaagcaacauaguugggacucagaagccucuuuuuccaugcaaggcgaagauacugaucuuaguaauuccuugguguuucuccuaguauaggaguuauucuaucugacauccaacuagauuucaagcaugucuccucuacuugugcaguuagggguugugugguacuuggaaagcuuucuuugaggguguugggaaugagaagaagccuuuuguucuugcuccggugacuggaaaguucuuuguucuucccagaauauuuccagucaugcccuugauaguguauuuccagaaugacuucucacaguuuguguucugauggcucaucaguaacagaaguuguaucugucgggagggauaggagaauagauuggggaagugcaggaaaaaaugcuuggaauagguaagaauaauucugagugcccuagccagguaggauuuauguuuuauaccuuuauccugucaagccuggugcaggguuuuguauaugucagguagcugugaauugguuuuaaaaaguauuaauuuggcugggcgugguggcucacgccuguaaucccagcacuuugggaggcugagguggguggaucaccugagaucaagaguuugagaccagccugggcaauauggagaaacuccgugucuacuaaaaauacaaaaguuagcugggcgugguggugugcgcguguagucccagcuacuugggaggcugagacaggagaaacgcuugaacccaggaggcagagguugcagugagcggagaucugucccacagcacuccagccuuggggacagagggagacgccgucucaaaaaaaaaaaaaaacaaaaaacaaaccaaaguauuaguuuauggcuuacauacuucucagauuuuuuuuuuuuuuuuugagacagagucucacucugucacucaggcuagagugcaguggcaccaucuuggcucacugcauccuccaccuccagaguucgagauuuugugccucaggcucccaaguagcugggauuacaggugccuaccaccaugcccaucucuacuaaaaauacaaaaacauauaaauuaauacauaaauaaaaaaauaaauuuuuguauuuuuaguagagacaguguuuuacuaugucggccggguucuucucaaacucucggccucccaaagugcugggauuacagauaugagcgacugcgccuugccugucucagaauuguuaauaguuaggaacagagagguagucagaagaacugcaguuugaaaauuugccuuucuugauuuauaauuaugguugauuugcccaguuaagaguugggaagaggcaguauauaaaaugaucccauccaguuuuuuuaaugaaaucauugaguuggaccuuaaauuuuuuuuauuauuuuuuauuuuauuuuauauauuuuguuuauuuauuuuuuugagauggauucucgcucugucgcccccaggcaggagggcaguggcgugaucucggcucacuacaaucucugccucccagguucaagcgauucuucugccucagccgcccgaguagcugggacuacaggugccugccaccaugcccggcuaguuuuuguguuuuuaguagagacaggguuucaccauaguggccagguuggucucgaacuccugaccuugugaucugcucaccuuggccucucaaagugcugggauuacaggcgugagccagcgcgcccggcguggaccuuaaaauuuuaaaaaaguuuguguuaauggcauauuucauuggagugaaacaaaacacuggcucccauauguaaggcccaagaagaacaagauuuaagagaaauacgauuuucuguuuaaauauuuuugauuuuuagaggccccugucaaaauugaauguugaagauguuugccaaaggcaguaaaugguauuauccugaguuauaaaugcagggagccaugggaguugggaggugaugucuugugaaaucaugcggagcuacugcauaauguucaggccaugaguguuauuuauagauuguugguuucgaaaguaucuuuagcuuugaaauacagcccauuauagcugaugggaagauagcaugugaaggauugggguacagguggccgaagcagacaguaguaggccagaaauaauacuggagugaauguggacuugcagaaauaguucuuggaguuuugagagagagaccuguuaauuguuucagacuagcaucagggaauguugaugucauggggucauuucauuacagguccaaaguucuguucugaaucaggauguggaagguuaaguucauuuucacucauucgcguggacucuagacaguugguauacaaugauguacaguguuguauaacaaagcuuaauuuuagaugcaggaugucuuuugcucucaaauaaauagguugauggucuagaaccucucuuuuuuuuuuuuuauuggugagcggagacucaaagcagagauuauauguuggcuguccuuguggucuguuuucauguagacucugaccaaaccuagagauuuuuuccagcuguauguuaagccacucacuucuagaaaccaaaauaccugugucuccucuucucucagccacuugugcagucuuacuguccaguacuccucauucagcauuccuucucagucaccacuguccuuacuuccuugugacagggacugcuuuuaguuuccaguguuacauuauauaguugguucauuaguuacauuauauguugcugucccuugcgagcuuauuagccuucuugcuaagcaucugaguaggguugcaccuuuaaucagcagcauacuuaagguguuuacuucuggagaagaguucccuagaugguuaauguuacucauuuuauguugguucuuaauaguugagauugagagaauauucugacacauucuacaauuuuuuuccaucuuuuuaaugggcuguaguuacagaagguauucauuuuugucuugucacuuccuaguuaaguacagccuauaggagggaggaaccuguacuguuuguuagcucugaauucccucuuucccaugcacaucucuucggacugugucauaauuuauucuuggcuuauuguuauaauauaccaucuugucucugcuugcuuuucuacuuuuaaccacuuccugauauagcucucuccuuugaaaacaggaaagaaccggaggcugaagcaggccaaagaagaagcucaggcugaaauugaacaguaccgccugcagagggagaaagaauucaaggccaaggaagcugcgguggggcaccauuuguuuuuguuacugcuuuaguuucugauccccugucccgccaaggcuuucagaauauccagcauagcucagagauccuggucgaaguuugaaaaugugguagcuguguguuuuauuggcugcucaggcaucugucuuuuaggaugaucaguuuuuccauucauauugauuucuaauuuucauuuauucacucauuuaacacguaucuguuaagcaguuaacaugcgccagguacugugcuagaugcuagggaucaguugugaccaggaauagacauggucccuucccucauggaguguagcuuaccauccaguggucagggagacucaguaauacagugcaaaucaugcagagcuacuacugaaaaaugcugugacggucauaaacauaaaucaaauggagccccacuuuaguauauuguauauaguacagacauuuaccagugauguaggcuauacuauggugcauacaauaauaguacaaaaacagaucacagaaagcauagaggaggcagggacaauuguggaaaggggaaaggauggauaagggccucacagagaaaagaaacuaucaggacucuugggugcagguaacaaaauauaauuaaaacugauucuaaaugggauguauuggccuauauaauuaaaaacccaagagcuuaaauaauaugcucaggacuuucucucaccucuguguuuggcuuuguaucauucucaaguucuacacuguggccucuaguaguuccagcauacacacuuccaggcccaaguccagugaguaaaggcacauaccucccuccuugcauuaaguagcaaaaauuuugaucaauuuuuuauuuuuucuuuuuaagagacagagucacacucuaucauucaggcuuuagugcaguggugugaucauagcucacggugaccuggagcuucuaggcuuaagcgauccuccccugcccagccuucugaguagcuaggacuguaggcaugauccaucaugcucagcuaauuuuuuuuuuguuuuuguagagauagggucuugcuguguugccuuggcuggucucgaacuccuggccucaagugauccucacaucucaaccucccaaagugcuggaucaucuuuguucuuggcaauuacagugccauuaaaacguggcugggcauagugacucacaccuguaaucccaauacuuugggaggcugaggugggaggauugcuugaagccacaaguucaaaaccagccugggcaauaaaccaagacccugucucuacaaaaaaauaagacaaauacaaauaaaacuuaacauguuucuuugauucuugaacuggggcugauaggugcuguaaguugucaggcugcucauaaaacaauguagaaauacccuugugucagggcagccaucaucuucauuuuuuuuuuuuuuuuucugagacggggaguuuugcucuuguugcccaggcuggagugcaauggcaugaucucggcucacugcaaccucugccucccagguucuagcgauucuuccaccucaaccucccgaguagcugaaauugcaggcaugcgccaccacauccggcuaaauuuguauuuuuaguagagaugggguuucuccuuguuggucaggcuugucuugaacucccgaccgcaggugaucugccugccccggccucccagagugcuaggaugacaggugugagccaccgcgcccagcgccccccgccccuuuuuuuuuuuuuuuccuguccgagauguagucuugcucugucacccaggcuggagcgcaguggcgucaucucaguucacuacgaccuccaccucccagguucaaaugauucuccugccucagccucccaaguagcugagacugcaggugugcgccaccaugcccggcuaauuuuuguauuuuuagaagagacggggguuucacuguguuggccaggcuggucuugaacuccugaccuugugaucugccuaccuuggccucccaaaaugcugggauuacaggcgugagccaccacgccuggcccaucuucauauuuuuacauucuuuuuucuuuuucguggcacaggccuaggaggucccaaugacaugugcccucauauucuuacauucugugcuguaguugauuauagagaugguacugguauugcacuguaaagcacaagcucugauuccuuuuuucuuucuuuucuuuucuuuuuuucuuuuuuuuuuuuuuuuugagacaguuucacucuuguugcccaggcuggagugcaauggcgcgaucuuggcucacugcaucccccaccucccagguucaagugauucuccugccucagccucccaaguagcugggauuacaggugcccaccaccacgccuggcaguuuuuuuuuuuuuugucuuuuuaguagagacaggguuucaccauguuggccaggcuggucuugaacuccugaccucaggugauccaccugccucagccucccaaagugcagggauuagaggugugagcuaccaugcucagccaagcucugaaucuuucuagcaguguuccauuguaaccucuuuaguuuuugagacaacuuagcggagcuuggcguaugguuuauauucaagaaacagguaaugggguucugaacauaaaagaaugaguuagcaacugagcuguuaaugaaaugccccaggagauuccuguaauaugaacaguuauaguauaguaugaagagcccuaagggcacaguggcucaugccuguaaugcuagcauuuugggaggccaagguggguggaucguuugagcccaggaguucaagaccugccugggcaacauggugaaacucugacucuacaaaaaaaauacagaaauuagccgggcauggugguguauacguguaguuccagcuacuugggaggcucagguuggaggauggcuugagcccaggagguggagauugcagugagccgagaucguaccacugcacuccagccuaggcaacagagugagacuccaucucuuaagagaaaauggagugauaaagucaggcacaguggugcacaccuguggucccagcucugcaggaggaucucuugagcuuggagucugaggccauccugggcaacauagugagaucccaucucuucgggaaaaaaaaauggagugauagccuccuuauaggucguugugaggaauagguaauggagagacuccuuugcaaauuaauauauuaugcaaauaugaagggauguuauuagcauauauauauauguauauauagugaggcaagaacagguuaggugaauaaaaagggucagacaaaaaaguuacgucuuccagaacguuauagguuaaguucuaauaaagaaggcacagcaguuaacaaaaagcuggcuguauugugaagaucauagaaaguaaaagaaaauucaugucagugugugugaaauugcuaagagaaacugaagagguaaaauguuuacgcuaaaaauucagguaauaaaaaggggcaggcugaggcagauggaucaugaggucaggagaucgagaccauccuggcuaauauggugaaacccugucucuacuaaaaacacagaaaaaaaaauuagccgggcgugguggcuggcgccuguagucccagcuacucaggaggcugaggcaggagaauggcgugaacccgggaggcggagcuugcagugaacggagaucgcgccacugcacuccagccuggacgacagagcgagacuccaacucaaaaaaaaaaaaaaaaaagugugggggcagcaaugagaaauuaguuuuccucucucucagaccugcaguccuccucagagccagucacuguuaacagguuucuuuuuuuauucuucuagaauauuuauauuugcaagaauagaugugacacacuggugaauccacuguugaacuuaagaacuaaaacacuaaccaauaauggugaaacuccuuguauauuccuccuaaauuguaucuuccuuguguuuguuauucuuguuuggagauggggucuucuugcaguuuugcucagguagggcuccaagucaugauccuccugcuucagucucucgaauagcugagacuacaggcaugcaccaccacgacuggcuuguguuuauuauuauuuaggaguuuuuaaaaaccuuguaucuccccacauuuaaaaccacagguacaaaaacauacuaaccacauugauacuguuguauaucuugcuuuucccccuccuuaagcuguauuuuacaguucacugcaauuccugaauaguucucuugcacagaagcaaguugaguuuuuagguugauuccuaucuuugguuaaggcuauauagcagauucuuuuuuuuuuuuuuuuuuuuuugagacggagucucgcucugucgcccaggcuggagugcaguggcgcgaucuuggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccuauauagcagauucuuagaggagagaugcgaauacaugucuuuggaauaauuuccuagcagugggaauacuguguaguuuacuuuugguagauguggcuccuguuaacucugagaauaccucacaugugcuccagccaugaggucauauugccagcuucugaguauacugauaggugagccuggguuucuccaaaagucaacaaguagcuuacgaaauguaccugaccaaccagagcauuguucugauaaucccuccgugacaucacuccccaucuccaggcauugggaucccguggcaguugcagcacugaaguggagaaggagacccaggagaagaugaccauccuccagacauacuuccggcagaacagggaugaagucuuggacaaccucuuggcuuuugucugugacauucggccagaaauccaugaaaacuaccgcauaaauggauagaagagagaagcaccugugcuguggaguggcauuuuagaugcccucacgaauaugaagcuuagcacagcucuaguuacauucuuaugauauggcauuaaauuauuuccauauauuauauaauagguccuuccacuuuuuggagaguagcaaaucuagcuuuuuuguacagacuuagaaauuaucuaaagauuucaucuuuuuaccucauauuucuuaggaauuuaaugguuauauguugucuuuuuuuccuaugucuuuuggcucaagcaacauguauaucaguguugacuuuuucuuucuuagaucuaguuuaaaaaaaaaaaaaaccacauaacaauucuuugaagaaaggaagggauuaaauaauuuuuuucccuaacacuuucuugaaggucaggggcuuuaucuaugaaaaaguaguaaauaguucuuuguaaccugugugaagcagcagccagccuuaaaguaguccauucuugcuaaugguuagaacagugaauacuaguggaauuguuugggcugcuuuuaguuucucuuaaucaaaauuacuagaugauagaauucaagaacuuguuacauguauuacuugguguaucgauaaucauuuaaaaguaaagacucugucaugcauuuuuccccauucuuuuuuuuuucccugucuccgugacaaccagugguucuucauuuuugaucaugcgaaaugcauuuugacccagauggucugcagaacuucacuuaggacauuagcacacaaauagcacacauaucacauacccauuuauauacauaauuagaaaauguuccugauacaugugucaugugauuucuuccaacaaauguuuuggaaaacagcaagcaacuagucuguagguugucuuuucucu

SEQ ID NO: 13991 - RNA, 1040 nt, Homo sapiens
uugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccaug

SEQ ID NO: 13992 - RNA, 97701 nt, Homo sapiens
ggaugucuggaggcgaggcgucccauuacagaggaaggagcucgcuauauaagccagccaaaguuggcugcaccggccacagccugccuacugucacccgccucucccgcgcgcagauacacgcccccgccuccgugggcacaaaggcagcgcugcuggggaacucgggggaacgcgcacgugggaaccgccgcagcuccacacuccagguacuucuuccaaggaccuaggucucucgcccaucggaaagguaagucuguuuugcccucaucacuagagauccuuaugauguaaggauugcauuccugguaccaaaugaguugugauuuuauauuauaauuacaaaacauaugggguuuuuuuuuccaccgcuggaaaaaaaaggaguguguauugguuauaucagaugcaccuugacuuuucuggucuuguaauuuuguuuguuuuaacuuuaugaauagucagacuuggaaggaacuuuucguaaaguuguuaucuucugcuguucugcagaggaaaaguaaaaauuuucucuucaacugcucuccuacuucuagucuggcugauucaccuguauauaucuuuuauuuugaggguuagggcaguagaguuuuaaggcagacuuugcucauagccugccccugggauggguuagagggaguuugauagaggagugcagggagaauauaaaaguuuauaucuaaacagcacuuacauaaaguuuacaaagaguuuuguacccauucccucauuugguccucaaaauauucacccuggaaaugagagcugggggacagaagagaggagguggcuccugggccagaugaauaacugacaggcagcuagagagugguggagaacagcuuuacuggggugccuagagccagcagcgucccacaugucucuagaaucaccuccuccuccucaccucucaucacagaaagaucugagcaacaacaucccccagguaugggaacccugcugccccugguguacuuuggaaagaacacagggguucuucucacccaucaguguuguaagaggaauaagagcuuagguuugaagccagagguguuugguauucuccccaccaccauacauaugacccugagaaagauacaucacuuccuuaauccucaguuuucacaucucuaaaauggggacaauagcgucugcugucguuuugaggagaaaaugagguauagaaagaucagcaaugacugcuuaauaacuggaaguuuggauaaucauugucauugccaaaaacugccaucacucuggaaguuaaaagaggcauugagccagucuuggauuguuucuuguguguuguuccucagcccgcccccagcccccgcuuuuuaucucacccaaucugagggugucucacuaggcuggcaggucugagacuuggcuguauuuuacaagcaggagguuguguuggcacagguuggagaaaagguaguagcccggggcuggaaguuaaugucaaauuuugauuccagaaugucaggagguuuugaguuuaggcaucugcagauucuaaagcugacagcuaugaaguacgaugcuguuggaaacucuuuggaaaagcuuucuguccggagggagggcaggacagggagcaccacuugaagaaugaaugccucuuuuucauguuuuuguagacuuuuucccccauuuuuacagagcuuucccauauguguuuuagaaaggaaaacuacuauccaucccagccaggcaagcccaauucaggacugaagaagauuuauucaguccuagacaaccaagugaagaguuucuggcuuugugcgcauacaagucauuugcaggagauguaagucagcgugcuuuggcccuugcauuucaggaaggugacugcuuuguggggaagaaaaaggugcacaauaugaguauucucugguuugcucaaacaggguaaauuggacaaggauugaaagggauguugccaagcucuacagucauuaaauauuuuuuuccucuaugcuuuguuuuaaaaaccuagcuucucuauuuuaucccacacuaaccuccuccuuccccacucuaagaagugacuaacguuucagcccucaacuuugucauucauauaauggagaugacaaacuaugucucacagggcucuugcaacauucaaaugagguaauauauggcaaacacuuggcauaguaccuuccacauauuaaggguucaauaaauggaaacuuuucuuaguuucucuguuuaucauuuuacaaggacuuguccaagauuaauauucuaagaucaugauuuuuaaacuuauuuuuaaugaugaaaauauucauuacaugaauuuagggcaaacccccaguauaugacagguaaaugcagggcugcuuugguugaaguggggucacaaggucuaaaacuuacaccuuugcucuuagccucugggacauugccacagaaucuucaaugacaaaaagcacauuuacaaaucaugaaaccaggcugugugcauucugguugccauucugcccuucaacaaggauuuuugccccucugagucaccaucuguagcagaaguaagagcaaguccacaaauaguguaauagacaggaauaugaaugagaaauaaaagacuuaacaaaggcuauuuuaauuaauucuaaugacaaugauagccaaaauauaugaugagccuacucucuaaacuguaggcuuuugugggaucauccacagcaugucucugagguauggacuauauuuguuggacaaagagauggcuucaagaacagggagacugaauaacuuuaccaagguccuagaacucagagugauacagccagguuucacacccagguccccgugaucaccaagucagagguacauucugccguguuccuucugaaugcuucucugcuucuugccugccuuuagaaggaaaacacuuccuuucugacuaaauaugccccuccaggcagacuguggccacccauaaauacagcaguagccugaucauauaaccagaauggaauuuggaaagagaauucaagcugacagaaugaaaaacauaucccccuuaauccuacccuuucuaaugcuaacaauaaauuaagagcacauauucucuccucucucucuagauuucuauagacaccuagcugugcuuucuuacaagaaaacauauccacuggaccaaagcgcagcccccuucaugcugaagccacuucaguuugaaacguaaaaaguagguugcaaacauuuaguuggcucgaaauauauguccuuuugugaugguaaaacacacaaacacaaaguuaauagugucacauauguaauaggaggguuugccaaugguuucucaucucauucucacucagacacuacaaauuauaaauuacuagcucaauuuuaaagaaaucgacacucaaggaaguuaggugacucaucugaggucuuuccguaauugaggggcagagcuggcuuugacccaagcuuucuaacuaauaccccacuguucuuucugcugugcuauauugccuucugaagucaggcugugcugaccaaguuuagaaccuuaaauggugucuuucagugaaugaucaagaugguggagaagcccccagcuggcauuggugccuauugauuuuacagaauagcccugcauguaucauuuuucaugguucucagcaaaggucagcucucaauggugcaacucucugccuggaaacaggaaaguucaaauuucagcccuggaagagagaagaaugaaacuagagguagcagucaggucacuccugcugauuuucaucucagaaaaguaggcacacaggugagccaaacaucugguuuuaaaagggcugauugguagguaaagugaaaucggccuuggggccaugaaucccaggacagcuuggaaaugguuguaggcuccgagccacaaauugagccacaaauucagcggaagccucagagaggaagauuaugauucaaauaccucucacucugagaagauuguagggaauccccuugaaucuuaucccgggccaguuugaacaccuucaacaugugggaaacauuagaugaaggcucccuuccaaggaggaaaaccccccucaaagugugacaugaccagccuccugcaaaccccaggccauaauuccauucaauguaaaagacagagauggugaacuuaccuaccuucgggggcuauacaugcuuugugacuucucuguaaaggagaaaagucugcaaaccaaccugauucuaauccugguggccagacauuuuucaguuaugcccuuaagccuaaacuccuuucccuccaccuugucucacauuuccagcuucucuuccacuuuagaaacaacccugucacuaucauuacucucuuuggcccuucaucauggaauaaaagcaaaaugcccaagucaaaagcagaucgcgaacggaaaaucccuuccaugugcauuuuuagucuaucugugaauggagauuuuaaaaauauguauuucaugccacgucgucucagaauuuugaaguuuccugaaguucauagguccuucaugauauagccaugguaacuuaaauagcuuuguuugguccuuuaacccuccucaaauacccuauaccaagagccagagauauaucaugaguucugaacauagauagcuuugcuucagaauugaccguuguucaccucuaacccuaaagcuggcugcugcuaacuucgacaagaaugugucugaaauguucuccuaggagaauccuaggggauaaucguaauagcuaauauuuacugaggacucuauaggcaucaugccauuuagucaaccauagcuucuaguaagucuuaucacccacccuauucaaauaugcacaauguaaggcugaaaacguuuaaguagcuuacccaauaccaugcagaaaguacuugguggaguuaaaaaucaaacccaguucccaguccugagaggcuaguuauaaccauuucaguaaggaagucaugcucagcucccuaauucuauucaucuucugacaagagagagggcuagacacagcaaagcuaagaaagacacaaaagcuugucuuuuuggcccugguguucuuugacagacugguuaauuuugcuaucuccagcuugcuccuucaggcuucaccucuugaaaaaaacuguaauuaaaugauuagcaugugacccauaauguaauacguuuucucuacuagacuuuaagcuacaugagggcaaagcccgauccacaucacaucccugcaaccagccugagaccugaagcauagacacacauaagcaagugcugcccaagggaagccaugagugcccugcaggcugccuggaaucccccugcuccagguuccaacugagcucugcacgucccccacugucugugucauaauuaccccuaugauugccuucccugccacacuggacuguacaccacugaggucaagaauguuagggaggcgggagcuuugucugcuggaguucauuuuccccaaaaacggacccaccaugggcagacgcaccauuagcacaguccccaaaggagaugcccaggacugugggauggucuugugaaggucgaugcacagauauugcagaggaaugcuuuaacuucuagguagguuacuauuuucuuaaaucuccuuagggaauacagaauuuucaaacuaaaagggcuuacgggcagccucuaagccagaaucuugcagacuggauuuuaaaaagaauuuaaaaagauuugggggcugcuguggagagacagggaggccaagcaggggauuccccucaaccuuauuucaaugaaagccccuccacuuaucuauuuuguacacugagccuccucaugaaauuuuauuugaugaaagggcucugugcagaaaaaacagaauguuuuuguaaauugcuggccuagguuagcauaccucauuuuaaagagggugaaacugagacauagagaagggaaagaucuuucuaagaucuuccgccaguuggcaacagggucagguuggaauccuaggucuucugacucuugcucuuggaagccagggacaaucuuaaaaguuucagaauuaagacauucuuuuagaaaagaaaaaugagcagagucuuauucucucaacagccuuaacucacacggaccgagccaaggaugacuaguaucuccguauucauuaucuauuacugcauaccaaauuacuuuaaaucaacacucauuuauuaucucaugguuucuagaggucuaagcacagcuuaguuggauuuucugccucauggucucucaugagguuauugucuguguuggacaggguugaugucucaucuaaaggcugaauugggggaugauuagcuuccaagcuuguugaugugguuguuggcuggacuccauuucuugagagauauugaacugagggccucaguuccuucaaagcuguugguccaaggcuacccucaguuccuugccacaugggcuucuccaacaaggccauuuacauuaacaaagccaaugagaaagagaguuaccgggcauggucgcucacaccucuuaaucccagcacuuugggagcccgaggcggguggaucacuugagguuaggaguucgagaccagccuggccaauaugcugaaaccccguaucuacuaaaaauacaaaaaaauuagccuggcaugguggugggcaccuguaaucccagcuacucaggaagcugaagcaggagaaucacuugaacuugggagucguagguugcagugagccaagaucgagccauuccacuccagccugugcaacaagagcgagauuccaucucaaaaaaaaaaaaaaaaaaaaaaaaaagagagagagagagaaagucuauaagcaagaggcacaucacaauccuguguaaccuaaucauggaagggauauuccaucaccuuagucauauucuguuuguuagaagaaagucacugggccaucccacacucaaggggagguaauugcacacguaugagaaugccgggaggcaguaucaauggggccaccuuagagucugccugccacagccuccagcacuccagugucaccaauuucuggcaaccucuuaucaaugacaaguucacucaacccuucaguacccucacugaugaguaauaaaaaaauugaucgagaccauggugaaaccccgucucuacuaaaaauacaaaaaauuagcugggugugguggcgggcaccuguagucccagcuacucaggaggcugaggcaggagacuggcgugaaccugggaggcggagcuugcaguuagccgagaucacaccacugcacuccagccugggcaacacagugagacucugucucaaaaaaaaaaaaaaaaaaauucuggcagccacuaaaguggacuaguuuuuauuuaacauccucccauguauauaguggagccaaguguuuugauuaguuguuuuaacucauugguuagccauaauuucucuugaauuucaccccagggaggggccuuucacggcaaugauuccaaauguauuuuauucuaaagcaagacagucagugugaccaaaacuaaaacucauccauuguuccucccucaaucuauuccucucagcagauauaaugaauaguaacaucuucgauuaauucuuuuuucuuuacuaaccccacacacaaaauguuguagucucuacugccuugacaagcaaaucuguucacugccuccccacuuucuugaucaccacccccugccccaccuccauuaccccuguaguucagaucuuagcaucucacagaugggccacugcaacagcuuucccacuggcccccagcaacccagccuuccccuucuucaaccugagacauagagguuaacauuccugggccucaagauuuccaaaugcuuuucuucugccugcaaaaaaguccagauauucugacauucaagauucuccaugaucuugcuucuggucucuaaacagauccuguacuucagcugucauucauacuguucacaucaacccuuuuauucuuuuuauauccuuguaaaugccauucccucgugccuagaauauccuuuuuuauguuuuucaccuauucauauuuuucucucaaaauucaguucaggcaccacuuccuccagguaaauuagaugcccuuuuacugucaucucauucuaccuauguuucuuuuuuuaaaucuaucaucuccuuuaucauccuggaauggccugucugccccucuugacaauauaguuccuaaaagaaaaaauuguaucugguuuaucugaaaccuagcacaacuggaauaaaguuaaucuuuagcaauuaauaggaguccuugcugugucccagauuuggacauccucuuccuuagcaguuugcucagaaagcccagagcuugaaguuguuuucacgcuucacccacuggcuugcaaguaugcagugugaugacacaacaugugauaggaggaaaccaucccagcccuaggacaggaaacugucucaggacacagaccucaaggaauguguuugcuuucagagguggccuucaggauaaaaacacaaauugcuuuggauuuggaaaaaccaguaccaaggacagaggaguccugucuggggauuugaggcugagucacaagagauagcugaaaaucuggagguuauaacaaagauuagucaacaacuaauaggaggaaagaacaggcucaagggugggauggagacaaagagcucucuaucuuaggacauggagaagcucacagcccacaagaagaaaugaauaaugguuaagaguaugacuuuggcauaagaauccucuggguuugagagguauuugcuugcuaugugaucuuggccaaguuacuuagcuucuuuaagcuaauuucuucuuauccauauuaaaagcaaaguaguagcaccuaguuuaaaguuuauugugaugauuaaaugauguaguucaugaacacugcuuagcacagaaacuggcauucaauauaaauguuuuguuguugucauuguuuuguuaccuguugaucaaauaguucuugaugauaagaucccacuagagaagcaguucccaaaagugugucauguggaaaagcauucucaugggaaucaccuaaaaaaggguuuuguggccaaaugaguuugggaaacacuugguacucuucuguucuuggaaaugcacagcucauauguccauucaauacauaguuuuagggcuggugauacaauagaaagcaauacagucaagauccuuuuauucaugguguuuacauuaugguggcauaucuuaguuuguacaagcugcuacaacaaaauaccauaaacugagugacuuacaaacaacagaaauuacuuucucacaguucuggaggcugggaaguccaagaucaagauggcaccuuauauguccucacauggcagaagacauaaggcagcucuauggggucucuuuuaauaagggcacaaauucuauuuaugaagccucugcccucaugaucuaaguaccucccaaagacucugccaacuaauauugucacacuggugauuauguuccaauguguggauuuugagggaacacaaacauucagaccauagcagggggaaggcagacaauaaaaaggaaucacauaaacuuauagcacaauuucagguagugauauuugcuaagaagaaagacaaaacaagguaagggcauaaacaaugacugguggugagaggagugcucuuuuagauggggugagaggugaaugugccauugugcagaugucugaaugaaaugagagaaggagcucuguaggcaauggcuaggaguuugaauuucauucugagugugguuagaagccaauggaugguucagggaaguagagugcaucaucugagauaucuugcuguaauuaaucuguucaacuuucguuagcccaguaucuccaaacauaccugaccauaggacaucuaccuaaaaacaucuugcaacguagucugggaaauucuucacuggagcacaaggcuucauagauuuuaaagggacugcaaauuugcucuuguucaucuagaucugcacuaaaaauccaaacauacugcuugggacaaaauaggcaugcccaggaaggaaaaccuagcucuagagguagagacaagcaggaugucauccuaauuagcagcucuuuuuggcaaagacaaucaaugagcacagccaggccucagcagauucuggaagcccauuugaugccaacggaaacucgccaauaucuacccaaggcuaauaaguguuugcaaacaguacaccuuggcuuaaguauucuccaaaaaggaaguacauaaaacuugagauccagccagagguucugggagaaaaacagaggucaaauauuuuggugcuuacaugugcacagccaccaaagagcugcugaaggucuaggaaauggaaagugaguucauccacuugaaugcugaucucuuucuuuauggagcaguaaaaauuuaaguuuuuaccuuaucugaacuaagaaaauuccuuuaggagucagcccaguguagcucaauguaguugaaagcagacauuuuagaaccacaaauaaaucaggauucaaaagcuggcucugccucuuaagccagucauggaaacucccugagucucaaauuaauuuucaaauaagcauaauaauaccuaacucaccagguugucaugacaaaugacaagauaaaugauagcaugaauaaaaagcauuuaguguaagauuuggcauaaaaauguauauaauaggcacucaacaaaauguuaguuuccuuauuguucaauucaaucuguauuuaguuucauaauagaagcugucauuuauugaauaacuacuauauuccagcagagguuagcaaaccauaggguggcagccuauuuuuguaaauaaaguuuuauuggaacacagccaugcucauuuguuuguguauuaucuauagcugcugccucuacaauagcagaguugaauaguugugacugaaaucaucuaacugcaaagcuuuacauauuuucuauuuggucauuuaaggaaauguuuacugaucccuuccagucaaccuuacuaaauuuuuauacuuacuuuccagucaccuuaaccuaacaagguggauauuaucauacuuguguauauagagauugaagcagaaaaaaaaaaucaucuaguaaguuccccuccaaaaacauaaugccaaacucuauaccuaaaagaaguucagaauaaugauuaaaaguuauucauuuguaugauucaucuucauuugccucugccuuccucugacuaguauuucucucuggcuaauuucuugaauuuccugccauaugcugaauuaaaugauccuauuuagaaggaauuuucccuccuuuccuuacuuauacaaauaaguuguuuguucauagaaguccaugcuuucaaaacugaaagugguaauuuccagccccucugaaacgcucucugaucuugacugauuucuuggaaaccacacguuuuuuagauaguacauagugugaagcccaguuuuccagaaaugauagauuuuuagcucccccaucugcuacuucucacuguaucuuccucucacuuauuaaccuucucuucaggucagacucaaggagagcaggcuuuucuccaggggcuuuaaagauuugccuaagacacagauauuauaguccaccuggccuaugcccuccccucaaguucacaacaguaaauaaaauaguuauguaaaccccaauucccaaacaccauccuaccuuguuccauuuugcaaauccaacaacucuauucauauuaaugauauuguguuucucucugauaguuaguagauaaauauuaauucuuuaacuugaacaaugaaucuuacuucaaagguaacuugauauagcagaaagagcauagacuuuggaauuauaagacuguucuuaauucugauucaaauaauugcugacuaggccacuuacuuaaccuucuuaagccuucaguucucuuaccaguaaaauacaaacaaugcucccuaauucccagaguugguaacaugauuaaacagcauuuguaaagugccacgcacaguauaaauauugaccuacuugcuucacucuuaguuuaaauugcucaagauccucuaacauagagcuucacauuuuaucccagagaggucauaguuagguauaucucuacuuccuucuaauacaggaagaaaugaaaggaguaagggucuaggauuuguucucuaucaguucuucccccaucgugugccauccaaccuaauccugugacucacuucaaacagaauaaucaaguagauuugggaaacacucuauaaacuguccccuucuucgagauuuccaacgagcaugaaccuauuaaacacccuggaaaaaccugaaguaaagaaaguuguguaauuuguuuggcuuaaaaucauauuugguuuaaaauaacauuuuccaaacguguuuaauuaggaaaucuuuuucccucagauuaguaccuaucaacguguuguagauuacacuuuagaaaaugcuguuuaaaguuacacagcuaaguuaaagccaaguuaaggggguuagacauaucucuauuuuucagauuuuucugcaguuuuuccuguccugccuguagaucauaaagauauuucauuaccaguaguuucucuggaccccgaccuuaguuaugcaaaccacccuuuaacauaauuaaaacaagugaaucaguucaccugauuuaaauuucuguuccccguuucuagcuaugugaucuugagcugugugagccucaguuuucuccuccauaaacugugaaaaauaaagacaacuaccucagaagucuuggggaggauucaaugagauaauccacagaagacacaaaaagcagugucuggcacagacgacauaugcaaucaauguucauuauuauuauagcauuuagauggucccauuuugggaaagggaaaauagacaaugaaaguauguuugcuuugccugaggucacacaaauuaauuacgggaguagucuuaguuuucccugagagucugguuuccugcuuccaguccuagagacguauuuuuguuucaugagucauauucuaucaaaauguaugagacuuuauugaacuugauuuaaacaggauuuuguaauugucaauggcuccaucuggcuccuucugaugcaaaucccacucaagcaggauuccauucauuugaauauuagcacauuggaucgggaaagauuuccaaagcugucuaguuuugcuaugccaaauauuugguguacacgucaacacucuccacuccuguacccaugguggauauugcuaauccaucacagcaccuuuucccgaaagccuaaucauagccacagaaucuuucucaaggcaguuccagguagcuaugucagcucuuugaguugaaacauaauugaucccaaaccaauucuacuucuuaaccagugcuugaaccaccucuacacuauuacucuuuuauuuuuuaauaugcccaaugucauggagcucucucauaaagggagacaggaaaaggaaagaagaggagaagauauacuaacauauguguaacguuuauuauuaauaugucaggcacuuauagcuuuguugucccauucacugccucaaacaacccuggagagauuuuauaguugaauaagccacaauucagaagguauaggacguuguccaaggcuccccagcagauaaguagaaauuggucuuaagucuuccugacucuaaaggcaaugccccugucucucccaucacaaugccuucuuaaaauuuuucagggucuuucgggacuaaauuucugacuuuggguggcugauaacaguuucacaaaggcaaccaucucacagaccccuauucagaaguucucuuauuuaggguuguguuguaagucugucuguaaucgguucuuccuagauaaaucucuuccauuucuuaaccuuggcucaagacuuugagaacucacuauucaaugcuucugaaagagccaacuagauuucuuaaaauucuggaugaagaccaaaauagaagaggucauuguuccauugggaaaugaauucaaauuuauuuuugaaauaauuuuccagaauuuuacaggaaucuauauuguugccacuuguccagaaccacuuuuuauuuucuuuucugucuaggcaagaaauagaagagagaaagcaagugcucugcaguuuuauuucaaaaauugaaaccagaccacaccagggcaguuuguggucugaauguaucaauggaucuagucauauuucaucugagcauuucuuagguauacuaaaccacaaauaugaaucucauuauugugucuggauggaaauauuuuauggauuaagauuuguggauuuaauuugguugguaauggaacuucuguucaaggggcaggagggaggaagucgugaggcaccaccaaugcuuaagccaaacuauggaaagaaacacuauuuggaggguuuguacuuaauguuggccaguugacuugggucuaaagugaaauucaaaauuaaguucaacaaaaauauugugaaauuagcaauggaccacagaucacuggaaccaaagggaucuuagaauuggaaaccauacacaguugcucauuuuacaagagaaacugagaccucaagaguggaugcgacuugcccaaggucacacaaugacccuguuggucagaccugcuuggcagaagaggagcucagagcuucuccuccagaucuuccauuuauugcacuuccuguuauauggccucauaagaggccaaguaucugggaacuuaaaaaaaaguaaugaagguaaaaauuuaaaaugagaaagggagaccuauauuuaacaacaguacaacaaaaugauaaauacugcaaugaaauugaaaggguuacuaacuaauaacccaggaugcuuccuucacaccaaaaccaaauuuucaugcugagugcaucuuaggccuggccaauuccaccuucugccaaaggaguuuacuugaucauagagaaaucuugucucaaaguagaaaguacugagcucuuaaaagcccuuggguugaugucuagaaucucaugggaaggagcuaggucugucuuugucacuuuuguaccuucugcacuuaguguggugucuggaacguaguaaauacucacugaauaacugaaugaauuaaaacgaacuaauuacagaacugaggcugugacaaauuccuugauacaucuuacuguagaagagauuacaggagagcuaauuacauuagggccaucaggaaaguaagaguauuuguucauucauuaauuccacaauauaagaaccugcuauguguaaguucaaaccaagaaauacauucagcuucauuucauuuaauauaaacauauugugcauuuacuauguucuagauaaaguguuuuguguugugcauucagagaugaaugucucagauauaucccugcccucauagagcuuauagucuacauacaaucuaacugcacauaugcaaaccaacuguuuauagacuaauauaaauacaaucuagaauuagcuaauuuccuaagagaaggaguuaugcaugcauaauaaagccauuccaaaucuuuuuuuaaaugauaaaucaaauaauaucauaucaauuccccagacaauucagaagagagaaagauaaauuuaggccaaaguuaccugauaaaccuuucaauaguagauuucuuuaagcagcaucuugaaggacugauagauuuauucaugcagagauggcaaaaaggcuucuagaagccuucaaggcaucuggaacccucgcugaaugaucacugagaaauggaagcaucccaaauguaucugucagcuugcuucaucuccacagcagccacaggcugucuggcaucuuaauggucuacuucuggaggauugauaguauucugcuuugagccagguguugggaaguuauauagucagagguuggggcuggucuugacucauagcuccuuugcuuggcccuccagcacaaaaggcuguauaaaaucaugguucagagcccugacuuuggacucagaugggauuugguucaaauccugacuccauaacuuaauaaugucugaacuugcacaagccauguaaagacucuaugccucaguuuuuucagcugcaaaaugaggguacaaauacuaucucauaauuguaugugaauuugaaauuggaaauguaaaaugcuaacuaagcacaggcucuggcaaaaucaacacuuaauaaauuauaguuaaugauaucuguauuacuuaugauggugaugaugaugaugucaacuuccugauuauuauuauuaugucaacuucuuaaugaucuuccaaggccuuuucaaccacuauuuggugauuguaauucuuuccuuuucuaggaagccccccaugaacuucccagugcaaagugucacauaauuaucucauucaggcuggcauuaauaccagaccuugcuuguguaugauauucuaguuucugagaucucuaggaacaaaaaauagcuccuuacuuggccuauuuuccaaaguacccagcacauugggagguccauacuaaguaaauagcauuucgcucuugaaagaauguuaacauuuauacucuugcuauuggcuugggagagugcaccauguucccaaccugcaguggcacuuaagaauaucacaaauacuaaaucaacuguacauggaguuaaaaucaauugcggccaggugcaguggcucacgccuguaacccuagcauuuugggaggcagaggugggcagaucaccugaggucaggaguucgagaccagccuggucaacaugaugaaauccugucucuacuaaaaauacaaaaaguuagcugagcgugguggugggcaccuguaaucacagcuacucaggaggcugagacaagagaaucgcuugaaccuggaagguagaaguugcaaugagcugagaucgcaccacugcacuccagccugggcaacagagcgagacuucaucucaaaaaauaaauaaauuguauuuugugacucuuugggaggaaauuaugagcuuugcgauuauacagaacauguuuaucuucuuugguguuguaucguuuauacuuaacucagggcuuggcacguauguacugaaaaaguagauaguuggaugaauugauggauagauagacagaaaaguaaaaaacucaucagggccaagaagucuagaaauacuuuaacacaaaugcucuccaggaucccaccacugauauuucucucuggagaucauuacaaugaccucagacuaagaauuacugaaagacuuucauaugcauuuuuaaagguuuuuuucccccagcuuuauugagguauaauugacaaauuaaaauuaaaauuuuauacauuuaagguauacaacgugauaauuuaauauauguauacauugugauaugauuacuagauucaagcuaauuaacacauccaucgcuuuacauaguuaccucugugugucaaugauaaagacacuuaaggucuacuacuaucuuagcaaauuugaaguauacaaugcauuauuauuaacuguagucaccaugccguacauaugcacuccuuuuugaaggccucccaauggucuagaggaagagauagaucuuaaucgaauuccuugacccaaaggcaaaaucucuggauuuuaauaucagcuuuaggaguuaauuaguaaagucaccacugauuagcuagugacucuggguguuucaauucaguuauucucuuaaauaacuagguauuauggcaaauaaguuucaugugauauacuaccucuauuuauauacuacuuaauuggcugccugaagugaugauuuagaaugauucuuaaguggggcuccucagaauuguguuguuaucgauuagcugugucugccccaugcacuagaaugaaguguuuugugccacagacuugccaugccuauaccaaaugaucuucuacaguugcuucuaaguccugcucaagcaugauuuugauccuauaauuugaugucugucugugucuuuggaaaguacugagaagcugggccaaauguuucccguuaggaacacagucuugaaagacuaaaccacaggcagucuauucaguagaaagcccuggcucagcagcauggacagccaucccaacagcagcacugccccugaggaaccuuggccaggguccugaccucccagaaaagagccccacaccaggcuaauucauuugcuuuucuugcuacugaguuagaagagauaggauaacaggaaaaccagggcuguagccacagccuccucauuuuccuaaaaauuuuagagugucccugcuacuugacaaauugaaauacuaagauuuauacauuuccauggaaaaagcaacagugggaaagagagggcuucccagauuugucuuauagaucucauccuucagagacuagccuucuguuagaaaugcugucuccaagcacaagacagaauaaucauauaauaccaauacacaccaguugcuaaggucuccauccuuuuaaguauuuguuacugaguguuuugccuguauuaucucauuuuucucacuuucaguugaaagaacuuuauugugcaguugauauuaguguuaccauuuuacagaugugaaaauuaaggcccagacaggcaauguuacacaaccaaaacagcuacuggauggaacccuuuggauuugcuacuacccaacuauuucugaccuaaaagaguggugauuccaugugguucaaauuaauagcaaguggcagaguaaagaucuaacaguguuugacugauguagagcagauauccucaaacauugcacagauguuucuuggauauuuguccauguuaguauuuaucauucuucacaacaaguaucuguuuacaugucugcuuucuauaccugacugugagcucauuaagggcaagaccuauccaucauuggcuucugaaacaccccaccaccacuaggcuaucccauagcccguucuuacacuuguucaacacaucucuguugaaugcaagaauaaaccauuuagaaauuaauucucaguccucuuggauaaucacuggcucccccagcaucuuaacugggcaccagcuaagccacugugcugccuaaauggacaaccacuucucaguucuggaauucuucaaacaccuaggguuaggagggucuucgcuuuggcaguuagaguuuucucaauucuuuuaugacacagguugcaccggacucacucaacuauggagaucagauguccucaggaaaaaaaaaaaaaaaaaaauacacacuuaaggcuguuuccuggcuccucucucuuccugacacauuccaaaaaggaauuuauggauguugggaaggacaaagggugaggaauuucuaggacauuuaagaacgcccauguaagcaacucuaugcuugacaggccaugcacaauaaaacucuuuggccuguaagcgagaagaaaaauuugguguaagcugccucauggguugccaaaaugauguggaaacaaauucaucugcauuucuaaacaauaggaauucuccucguccucccaaaccuagaauauuucauguaugugcuuaagucaacaagauaaauauauuccaugagcuacuaaaaaugaaaucauaaguaacuaauucugaaauaugauucuagccaguuggaaguuucaucuuuaucuaaaaaugaaguuguuuauucuccagcugugaccagggaaaaaaucagauuguugauuucuucgucuagcaaugaucuuuguccugcagugaggugcccaaaaauaacuguuagccuauucccugcugcuuccaaaagguuagcuaccaaacagcucuacuaguaaaagagaaaaaaagaaggauuugacagcaagccaagaggcagcuuaauguguaaaauuaugagcuaaaaagccauuacgacuggcaugacacuggccuugguuucccaaccugguaaauaaauuuuuaucucacaguaaugcucugaauaaaagucuauaaugccaaaaucugaagaaaugauucaacacugauaacauuuaacaccaaggcaauugaaauaagauuaaagcuuaacauuuaacccuucuuccaccccacacuccccacaaaagcuuucaggaccauuguuuuuaucuucuuauuuuuuguagcgggcuggggccauaaauguaccagguauuuggagaaugggggacuaaauauuaaagccuauauucuacccagccuucucaacagaugacuaacugugagcaguuaggcaccuagccuuacagaggugccauauugcuuacugaguuaaguaccagcucuucauauugaucuuuuauauccuucccaauauggcuucugccaauaccauguagucucuaccuuucugcuuuccuaugcauuauuuuauacccuaguagaacaagaccucuccauauucccugcaugcuacaccaccuuggcauguaucuggcacccacaaggagaugccacuauuauuacagcuaucuucuuaauucuccucaccacccaugcauuccaacuucuuugccuuuucucaugguguuucuuuuuucuagggugcuguaggcuucaauuugaacccaccuacuggaguuguauccaaccauuuuucagaaucuugcccaucuuucaaguacaucucaaauaccacuuuuuugagaugucuuucuugggaccuucaauggauaugaguuggccaaucucuuuuguuacuuguuauaaucaugaauguaucucccugauucccccaucccuucuggauacaagguuuucuuucugaucuauucucuauuggaucaguguuguuauuaccgcugcugcuaucauuagcuaccacauauuaagcacaccuuaaugugugccaggcacugugccaguagcuuaacauaugucuucucauuucaucccacucuccugcaacacuaugagauagacauauguaucuccagggagaggaggcggggaaauugagguucagaggagaaagggaauggccauagggagcagcugcuaaagugauagaacuggauucgaacacagguuuauuuuacaccaaagaccagacucuuucccccacacgcaacugcuucauuaauggaaauguuuagauggcugaaggauauggacugagugcccucaaaacucuggagcacagcagugcaggacagcagagaaacgggagucaugaguugucuuugacaagcuccuccagcuucuaaggagaggcugaagcagacagaaagagacauuagacuuggccagagugguuccuggagcaacuugguuuuaguuuaacguggggagaagauucuuacgagacucuaaggugugcagagggaggaagaaaaaaauauuucuuaacccaaggacaaggcugggggaaaagaugcugaucugacacaggguaguuaucucuucagaucugcaaaggacaauagcauugaggauugcuucucacuuguaccuggauauguucaaacauguaagguauggaaacuacaaugcacauacaugcuugcuauaguuaagugaguuaguugcuaaaaagaagccauuuuuucucccuaauccccgggcucuugugucugagguacucacccauuuucauuagucaagaaacuuaacaacauugaaacuuucuuauagacucuucuugaucgcuuugagucucaguuuccucauuuuguaccaugcgcuuaguaaaaacaagcaauccucuaaaccaguacugcucaauaaaacuucuuuggaugauagagauguucuucaucugcacugucucauauuguaaccacaagccccaugggcucuuaaguacuugaaaugugagugauacaacugagcaaugagauuuuuaauuguauuuaauuuucauuaauuuuaauaaucacaugcggaauaugggacagagcacuucgaauucaagaccaaugaauucgaaguguuuuaucucuuuuuaaauuuucuaucucacggggaaguuuuuauuguggauuuuauguucaccagauuaacuagcuuuugagacauugacagggauggagauacacagaaaaucucacaaaaacaauuucauaagucacagguauuuguuugacucuaaaaauuaauuuuaauaaagaaagcaaagucugacacaagugugucuuguuuugcguuagauacauaagcugaggcggagcaaaaagcagcacaacaugcuuagcuuggaaauagauuuguccuggauaugggaccccaaaaaucugcguuuugugccaaugcaaagacuaugucucuuccugauucccuucuuugcaaucauugacuuaccagauccuuaaauaucaccaucaaagauauacacacacuuacauauauaauaugauauguaauaauauauuaucuuucauuguauuauaauauguaauauuauguuacaucacauauuauaauauuauauguaauauaauuggagcaacuauuauauuauauauggagauauauauauacauauauauacauauauauauacauauauauacauauauauauacauauauauacauauauauauacauauauauacauauauauauacauauauacauauauauauacauauauauacauauauauacauauauauacauauauauacauauauauacauauauauacauauauauauacauauauauacauauauauauacauauauauacauauauauauacauauauauacauauauauauacauauauauauacacauaccacgacaugcauauuuucugggaucacugagagaggaaaaguucucacuuugcuguagaacucuugucuuugcuuaaaaacagacauaugccaaaguagggguuucaaagguuaggagaaagaaaauccuagaaaagaaaaacauucauuaaaguccauauuuuucauuacaaauguuuccuuuuauuaagcucuuacugcuaccaaagacuguuugccauuucuuucgcauacauuaucucaugcacuuuucacaaugauccuaugaggacucccuuaacacauuuauugaugacaguacucuggcuuauggucacagauaauaaccuugcacaaggaacaggaagugaucaaacagugauucaaaccuaagacaauuugccuauaaaacuugugcccuucaaugccauucuauuuacauucuggugcuuuggaaccugcuacauucucaaagaagaccuuucuauuggguaccaauuccaacuagaaaagucuuucuccuguugugcugaaauuugucuucucauaaccaacccucccucccugcaucauccccagcacauaaacgcacacacacacacacacacacacacacacacacacacacacacacacacacacagaggcacuuguucuguccuuaggggcuacaagaggcaagccagugccugcuuugccaggauuucuacaugguaacccugacccacucaaccuugguuuucucaacuacaaaauaaaccugcccaggucuguaguccuuccuccuacaagauauuuuccagaccuuuuauugcugaucaauuuucuauaaagauuagaaucuguguuuucuaaagagucucuguagaauaaguugcucauucugaaauuauaaaaguccuacuaucagaacaugauucuucaugucugaccuaaauaccuccaacugcaaucucaaguaaguuucccuggguucauccacaaaggagacuuaaaacagccaguugucugcaugagaauauuuuacauucuuaaaggucauuauuugcuuccuauuuuuucccucucucauauaaauauuucuaguucuaguaaauuuaccuccucacccaccagugauuucugcagcuccucuuugaucuagauccaaguugcugcugaguuuaggacuguauucaacuaggcggucaagcucaggcuuaaguaaaaggaggcuauugacauggacucuuguuagguuuuguuccccaggagcgcaacaaaauaggaacuacuguuuaaugagugccuacuacgagcuugacaccaugcuggguacuuuauguacaggucucuaauccuuaauuuucucuggaaagguuuugacuccuuuguuauauaugaggucaugguuuagagaggauaaguagcuugucaaaguugcagggcuagugagugacauuugaacccagguaugccuaauuccaaagccuaaccauuuucuacaacacugaaaauauaauggauuuuucccaaaguacaaaaacacccacugcccucagaccaccaugagccaauaggaaauacacaaugcucaagaauaacauacucuuucccccaacgaugcaacauuuggugguaccaguuuacgucucuuaaacacacagugagaaauccucacucuacucacacucuggucauuauuacccuaaacucuuugccuuggagucucaaucagcaacuauaauggcuuuuuagauggaaauuuaagucauuuagcaacacacagaaaaguguuggggagaaguccaaaaacauuucaaacuuggcccauggcccuuucuaaaaaaaaaaaaaaaaagcuaagaauugauggaaaagggguaggaaaguagaacuuugugaaggugaagagaguuagagcagccauucuaguagacuaugcagccaauaaauauuuguccaguaaacacauaagauggccaaauugguuugaaaggagagaacaugccaagucuccuuuuuuauaauaaucuucauucaguggccuuaccuacauuacagacccacacauuguuaguuaagaagcuaauuucaaugagaaagcaugcucaaaagaggguuggguauuuuuuguuucuuuguuuuuguuguuguuguuguuuuuguuuuguuuuguuuuugcagauauuacagggacaguugguaaagugucaauaagaauauaauuagaaugugguagguauguggauacgaccuucuuaguuaaauucacuagugcuuucucaguccuuaggccccugaucagucauauagaaugcuucccaguucaauuuuccuugccacaauuccucucuaaguuuugcaaaggcuuucugucaugaggaaggagauggucaguugggaucauguugaugcauucuaucauuaggauaaaaucuuuccagaaaaaaaguuagaaaccuucuuauaggcugaauaauccaagcaccaccacuaauugacauaaauaacuaacuuacagugugcgaguauaagaauaucaugggcauagggaaaugucaauuuguaaaugacaugcuaaaaaccaaauagcagccaggcacgguggcucaugccuguaauccuagcacuuugggaaguugaggcaaguggauugccugagcucaggaguucgggaccagccuggggaacauggugaaacuccaacucuacuaaaaaaaaaaaaaaaauacaaaaaaucagccaggcauggcagugugcaccugaaaucccagcuacuugggaggcugaggcaggaggaucacuugaaccugggaggcggaaguugcagagagucaagaucaugccauugcacuccagccuggacaacagagugagacucugucucaaaaauaaauaaauaaauaaaauagcucuucaauuaucauuugaauuuuacucgggugcaucuccuaauuaaagaaaaccaugaaugacuucauaucguguauagaucauucucacaugccuccauagcauuguuuuaguaaauauuauaacugccauuucuuccugucuuuauuuaguuucucaacugccucuaacaaguccccuuuucucugcuaccugauugcucauacaggugaauagcucuaagagagaugaauaagauaacuuggcaaagugagaauugcuucaugguagcauauucuccuccauauucuguucccaucuaauucuucucacuauuuaaggcucagcuuaaauuuuacccucccuuucccauaagcuaugccccaccuuucucuugaccauuccuuuuuauuuucaaaccccauaggcaguuauacacuauaccacaaaacaaauccuauacauucuuucuugcuuugcuccuuaaguacuggauggaugauuccauuuucuucuuaauucuauuguuaaguccccugaugguauguauacacuuggucuuauauuuauuucuaccacccucagaccucuguaaaaaugcuauaaguacuugcugauuggagaagacaucagaggcucuuagacauccuuucugagcugugagccucaguuuagacaacugguucaagaauauucugucaggcucuucuaaaaacuggacuuuugaagguuuuggaaauaaaucaaggagcagggaaacugaggugcagaggaguagacugaaugcuauacugacagucauauaacuaguaagaagcucggcugggauuaaaacuguuugccuccuagaguccuuuauuuuaaccucugccucucaugacagaagagaaccagcagaugguguggaaaucaguuuugaaaaucaauaagaggcaagaguuacugaacaucuaccgggaccagggccuuuauaacacuauaauaauucacucagaagacauaguaaauacugaaggaauuaaugaauacacaaauaacuucuacaucauucuuuuaacccugucauuagcaacuaugaucuucacuauacagaaagugaaauaaggcaaagaaaaauuacauaacguauccaagggaccagagcuacagccaagauacaaaccuaugucuauuuuauuucaauauuuuaccuuuuucucucuauuuuucugucuccuuaaauuuacagaaguugaauagugagugaaaucauuccuucaagugacaaaguucuuuuagagaccauuguauguuauuucaaggguauauaaugaaaaauuaucaggagagcuucaaauacagggauauaaaaucaaaauucacuuggaauuguagauauucaauauauucaauaguagauacucauaauuuuuuuguucaucuuugcuuguagaaaauaauucuuucaagaagaucagggacaacugauuugaagucuacucugugcuucuaaauccccaauucugcugaaagugagauacccuagagcccuagagccccagcagcacccagccaaacccaccuccaccaugggggccaugacucagcuguuggcaggugucuuucuugcuuuccuugcccucgcuaccgaaggugggguccucaagaaagucauccggcacaagcgacagaguggggugaacgccacccugccagaagagaaccagccagugguguuuaaccacguuuacaacaucaagcugccagugggaucccaguguucgguggaucuggagucagccaguggggagaaagaccuggcaccgccuucagagcccagcgaaagcuuucaggagcacacaguggauggggaaaaccagauugucuucacacaucgcaucaacaucccccgccgggccuguggcugugccgcagccccugauguuaaggagcugcugagcagacuggaggagcuggagaaccuggugucuucccugagggagcaauguacugcaggagcaggcugcugucuccagccugccacagguaugagcugguggcccgcccagucccacacugugcaaacauggagaaaugaagagcauagcagcauccaucacuugcuuccaaagugggcucacuagaaaacuagcuucccagaguguucauuacaaagagauuuuauguucaaauaaguguggagacugcagccaucucucuccugcuuggaggagucacggcgacaacugcuucucagaggaauuuucaggcuucugauaaguccugcuuugaaaaacccuauuuuaccuuaauuauaaguuucuaaaacguauuugaccaugaaaucuacccacuuucuaccccaaaaccuaugaguacgccaugaaauuucuaccccagagagcacucucugauagguacugcuguggccccaucaccucauuuuacaaauagagaaacugaggccuggaaagaggaugggauuccugaagguccuccaauaaggaguagaguuccucacauuucaguauucuuacaaaugcacagugcugccugugauagugcugaguuauaagaauuagaaaaaaguuccaauuuaauagcaauuacaaugauuacaaucauauaagcucccucuguguaacaggcacuguuguauuaucucauuuaauccucccaacagcccuuuaagguaaagauuagaugaggggaagauaaguccucuucuacagaucaaagaaaugaaucucaaggggauuaacccacuggcacaagauggcacaaagagcaauaagagauagggucuuuggcuaggcgcagugguucacgccuguaaucccagcacuuugggaggcuaaggcgggcggaucaccugaaguuaggaguucaagaccagccuggccaacauggugaaaccccaucucuacuaaaaauacaaaauuagcagggugugguggugcaugccuguaaucccagcuacucaggaggcugaggcaggagaaucacuugaaaccgaggggcagagguugcagugagcugagaucaugccauugcacuccagccugagugacaagagcaaaacaccauccgaaaaaaaaagagauagagagagagagagagagagagagauagggauuuugcaugugccugugugucuccagagcucauacucucccauggaugcccuguuuccacaugcauccuauuucaaggaauuuugcugcuuuggaauuaugucuuuaucuccaauaacuaaaguugauaaagcuacaugaguuucaacaacuucaaaucagagcugaaaaucuguuucugccacucagaaaaaaauuaccaaaauguucuucaacaauuauuucaagaguaaaccuaaccacccuaagugaaauagucuuacggcucugcaggacaggcucuagguuucuaaggcaauuuuuaaaaacauuuucuuuaggcauaaguuaguuuaucuuccacuucugucaacucccuggaaaaaugcagaugagaauacacaguaggaguaaugcuaaguagucaguuaaaaugauuguuuagagcagugcugucuaaugaaaauaugacucacacauguaaucuuaaauuuucuaguagucauguuaaagaaaggagaaagaaacaaguaaacauaauuuuagucaucucuuauuuaauucaacagagccaaaauauugguuuuucagccugaaaucaauaucaaaauuauuaauggauacuucucagucuauuauuuuauacuauuuggaaucugauguguauuuuacacuuacagaacaucucaauuuagacuagccacguuucaaugccuaauaaccacauguggccaagggccaccauacuagauaguacauacuuagacucucacuuuacaaaucagcuuuuuuuaaaaaauucuuucuuccugcugucaagaaugagauaaaauauauuaauacaagcuguuucuacguacagagacuacagagugaauauacucuagugcagagaauauagaacuggguuuuguuucuucuccuuaagcuccauggagaucagaccaaugacuucugcaaacugagcuaaggcaauauuuaggccucaaggggcucgaguaaugucaaccuugaccccacauucuuuaaguugaccuccacuuagccuucaggauagaaagaaauaaaagauaaaggcacuauacuuuucuggggacagagccaaacugaaagguguccuuauagaauuagaaagccauuagcuaccucauuuuaguugcggaaaauuagaauguuuugguuauauaaacccacauaccaacuugagccaaccuuccacaaaaaacuuuggaaaauaaaacagaaaaaaauaacaaggacacaagagugagcucuuaagggguuuacuuaacucggauauaccccagggaagugggcuauuggcccaacuucacguauaagaaaacuaagcuccagauagucuaaaucccuugccaaauguggcauagauauugaaucaaaaagucagaauuacauucaguucaacaacuauuucuugggcaucuuuuaugugccuggccuugaugaggcacuaaagaaauaauaacauaguggccagucgugguggcucacaccuguaaucccagcacuuugggaggccaaggcaggcagaucacgaggucaggauauugagaccauccuggcuaacauggugaaaccccaucucuacaaaaaaugcaaaaaaaauuagccgggcaugguggcgggcgccuggagucccagcuacucaggaggcugaggcaggagaauggcaugaacccaggaggcggagcuugcagugagccaagauggcgccgcugcacuccagccugggcgacagagcaagacucugucucaaaaaaaaaaaaaaaaaaaaagaaaagaaagaaauaguaacauagccccagccuaaugcauuucacaaggcagugacucauaaucaucauaggaauaguaagacuucuugaaaaugugacaaaaacuaugaauccgcuccccagggguggaaauacacacacacacacacacacacacacacacacacacaccccuaugcauaaucacacacuguuuuggcauacaagccuauaauuucagggaauucagguuaugaauuccuaccugguauaacaggaugugagucucaucugauuucacacacuacaacaaaugguucucaagccagauggagccugagggugcaaccguccuucagcugaauuugaaucugggugcccuggguagauacagaaaaauguggcugcuuaagccuggcugagaacuucuguuucuuuuguugcaggccgcuuggacaccaggcccuucuguagcggucggggcaacuucagcacugaaggauguggcugugucugcgaaccuggcuggaaaggccccaacugcucugagcccgaauguccaggcaacugucaccuucgaggccggugcauugaugggcagugcaucugugacgacggcuucacgggcgaggacugcagccagcuggcuugccccagcgacugcaaugaccagggcaagugcguaaauggagucugcaucuguuucgaaggcuacgccggggcugacugcagccgugaaaucugcccagugcccugcagugaggagcacggcacauguguagauggcuugugugugugccacgauggcuuugcaggcgaugacugcaacaagccucugugucucaacaauugcuacaaccguggacgaugcguggagaaugagugcgugugugaugaggguuucacgggcgaagacugcagugagcucaucugccccaaugacugcuucgaccggggccgcugcaucaauggcaccugcuacugcgaagaaggcuucacaggugaagacugcgggaaacccaccugcccacaugccugccacacccagggccggugugaggaggggcaguguguaugugaugagggcuuugccgguguggacugcagcgagaagagguguccugcugacugucacaaucguggccgcuguguagacgggcggugugagugugaugaugguuucacuggagcugacuguggggagcucaagugucccaauggcugcaguggccauggccgcugugucaaugggcagugugugugugaugagggcuauacuggggaggacugcagccagcuacggugccccaaugacugucacagucggggccgcugugucgagggcaaauguguaugugagcaaggcuucaagggcuaugacugcagugacaugagcugcccuaaugacugucaccagcacggccgcugugugaauggcauguguguuugugaugacggcuacacaggggaagacugccgggaucgccaaugccccagggacugcagcaacaggggccucuguguggacggacagugcgucugugaggacggcuucaccggcccugacugugcagaacucuccuguccaaaugacugccauggccagggucgcugugugaaugggcagugcgugugccaugaaggauuuaugggcaaagacugcaaggagcaaagaugucccagugacugucauggccagggccgcugcguggacggccagugcaucugccacgagggcuucacaggccuggacuguggccagcacuccugccccagugacugcaacaacuuaggacaaugcgucucgggccgcugcaucugcaacgagggcuacagcggagaagacugcucagagggugagugccagggcgcagaccagcauauaauggccaugauggaguggacuccuaguauggguuggaaaacuacguuuauauauauaaacauucaugcacacugauucuuuguacguauuaauauauccauuuaaacacacacccauaaugacuuuuuaagggggcccugucauuccguuguuacaaggugaccuauuuaagggcugaagggcucagagagguuauauaauugucccagggacacacagcugacacaucacagagcugguauucaagucugccuaacucaucuacauagaguuuaaaauaaaguuggagaggccagaacacaucuaguguucaagaugagguagauaaagggauacucucucuuuugcuaaauaucaacuuuauuuccuacucuccacugacaucaaaccaacaguaaacaaaaucucuguauuuggauggauguaaaaauucagcuaaauugaauacgcagugagauuacauaaaaacaacuguuucaaaugcauacuuggcuaaagacgaaaugccuauuaucuacaagauugaccugucuuuucauugucuuuuguaacugguuuuguuuuuuugauuguuuuguuuuuuuaauccuaaagacugcaagcuccuauccuuaaaagggcacuauuucuagcaguuaguaugggaccugguacauauuaagugcuuaguaaacccugguuaagugaaaacacaggagagaaaauuaaugcucauauuuaaugagugucuucuuuguacuccucucaucuacccauauuaucauugucauaauggagaauuuuuuccuuuacuaaaguuauugguaucuaaacauaaauaaauggcuuuguguucaauguggcgcaagcagggaagccugguuggaaagaacaccaggcuggcagggaggagauacaaguucuaaacuugaugaggugagcaagcuuggucaaggcguucugucuuacucaccucuauaauauaagaaaguuggaccagauaugcccaaaauacccucccagugcuagggacacguaacucaaaguucagagcagggagugaggcucagacugcacuuucccaugccaacagccugcaucugagcuaagacccaggaagcacagaaaguuggagaggccagaaacacccaagggcacacugcugaccugggacuccagccugaaggaaauggacuaaggaacagccaccacaggucuuaagauggaucacagcagggggucccugaugccaucugcauuuuagaggcaacagaagaucuucagaccucuguggcugacaguggaaaagacaggucaaacaaaccuagagagauuuuagaggacacacuguugacaccagauguccuuucuuauuccugccagugucuccucccaaagaccucguugugacagaagugacggaagagacggucaaccuggccugggacaaugagaugcgggucacagaguaccuugucguguacacgcccacccacgaggguggucuggaaaugcaguuccgugugccuggggaccagacguccaccaucauccaggagcuggagccugguguggaguacuuuauccguguauuugccauccuggagaacaagaagagcauuccugucagcgccaggguggccacgugugagugagcagaacucuuuugggcagccucaccugaugucagcccacccaguguauaacccucccucgccacggccccuacaauccuauaguuguucuuuacaguuauaccaaauaagagccuagaauuaaguccauagaaucacuuauuaaagaaaucccucauuuuccaucaaaucuuucuccuugcucuccuauauacuuccugccagagaaaaucauuacaaguaacauuuagcaaguguuuacuguguaucagacuuuguuguaagcagucuacauauuaguauaagaguccucauuuggccgggcaugguggcucaugcccguaauccuagcacuuugggaggccaaaguagguggaucaccuggggucacgaguucaagaccagccuggccagcauggcgaaacccugucucuacuaaaaauacaaaaauuagucgggccugguggugcaugccuguaaucccggcuacucaggaggcugaggcagagaauagcuugaaaccaggaggcagaguuuguagugagcugagaucaugccacuguacuccagccugggugacagauugagacucugucucaagaaaaaaaaaaaaaaaaaagaguccucauuauaugaguuaguauauguaugaaauaggagcuauuguuaaccccauuuuacagaugaggaaacugagacugcaugguuaagcaucuuaucccaagucaugcagcuaacaaggaguagaggcaaaacuuuaacccuggcaguccuggcagguuuauguucuaaaccacucuauuacuuuucaguggagaucacugacuauuuuucuuuaaguggaaacauucugguuuaugaguuuagcaucaguauaauuaccuucauaucuaaaaagcaagcucuggcuagaaauugacccuuuuuuccuuaauaauaacauuggcugccauuuauucaacuuguucugcaugccacgaaccaggcccagcagucuacacacuggaguggaguauaucacucacuccucaaugcauucccaagaaguagacauauuuaccuucuuuuuccaagugaagaaacucaggcuuagagcacugugugcaauugcucaaguucacauugauaguagagcuuagauucuaaccccaagucugucugauuccaaagccugcguucauuuuagauuuaaacauaugaaauugccaaaauuaaucauaccauuuuuccuaauauuaauuuuuauacagccucauagagaccucaucccagaagaagcuuuaaaaggacaccugcucugguugucagccccugacuguugcagacauccagucugguuuaguggaaucguggccgcguugcccaaucacacaccugcccuauccuuacguucuauuuauguuguuacuuacagacuuaccugcaccugaaggccugaaauucaaguccaucaaggagacaucuguggaaguggagugggauccucuagacauugcuuuugaaaccugggagaucaucuuccggaauaugguaaggaguacaaaagagcagauccauuugaucucaaggauuugaaagaugaccaaaggguucugaagacuucuguaucaacuaauuuuccuuaguuuuugguggaggacaaggcucucauuagcaucauuuguguuugcaucuauauuuuaagggauguugguuuuucccugauuuuaauaaguaaguguagcacuuacggcugacacccuagacaaauagaaguugucaccucaagguuccaauuguccaucaucaccuuagaaaucucuacucagaggcaaagaagagaagaaacagucucucccucaaaauaaagguacaucucagauuugagcaacccuucucuccaggcccaaaaguacaugugaagcagggaacuuguucucugaauuuaagcccaggcucugccaccaaccagcugugugacuauccaacaaucacccuacuccucugaugcuggccucagucuacccaaggagggauugagcuugugccuucagaauuccuuuggcucucacauucugucauuugacuugcaugacaaagggguaaaaguuuacgaaugggagaaacaaacuagagaaaugucuuuaucaucucuguauccucaguagcuuacauacugaucugaugcauaguaagugccuaaugaaucgaugaaagaauaacagaggaaugaaugaaugcagagugaaugaaucacauaaauuaagagacuggcaccuccccuaacucuuaccaagcugccucuaucucucagaauaaagaagaugagggagagaucaccaaaagccugaggaggccagagaccucuuaccggcaaacuggucuagcuccugggcaagaguaugagauaucucugcacauagugaaaaacaauacccggggcccuggccugaagagggugaccaccacacgugaguaucaccuuuaauacuuauagaaugauaaggcugauuguaccucauagcaccuccugguugagaaagugccuucucauauagcaucuacaucauuuaacuuuugcugcauuuuuaaaaauccagauacagugguuuaaaauaacaauucuuugcauguuggugauuuggguuugggcucagcugagcagcuuaucuguucuugacugcacuccucauguaucugugugcuuaagggguggauuggccuaggauggccucagccaggauggugucuuucuguuucgcagagccucucauucuccaggaugcugguccuguucacacagcuauugaacagguucaaaauuggcauuagaucacuucuaucaaagcacaucccacggccaguuuauauuuaaggaauagagaaacagauccaucucuugaugaaaggaguuucaaaaucuccuuucaaaggggugugacuaccugaagauaauuaagcccauugcuaacaaucuaauuagcaucaugucacuaguuuaauauuagcacccaguuguaggacagaggaagggaaaauauuaauguuaaggcuuaaagaagcuaaaucacuuuaacaucccauaguuaacaccaucaggggcauaacuuuaagccaggguaaguuuuauaacuuuaaccccauuuccacuaacauugacuaggcucugguuuauguagaauguugauuccaucucuucaaugggaaccuaaauaaaauuucauucaauacuaaugaugucagaaguucuugggaguagaauaggauuuagcaguacuagaucauuuggugagaaaaagaccugaauuuggaguugcuccaccaggaaacauuuuuuuuuuuuuuuucugucacccaggcuggagugcaguggaacgaucucaguucacugcaaucucugccucccagguucaagugauucuccugccuuagucucccaaguagcugggauuacaggcucccaccaccacaucuggcuaauuuuuuuguauuuuaguagagaugggguuucagcauguuggccaggcugguuuccaacuccugaccucaagugauccacccgccucggccuccuaaagugcuaggauuacaggcgugagccaccgugcacagcugcaauuuuuuaaaaagaaaaaaaugcauaauuuugcacuuccauauaggaaaaccucuuuauuuucuucaagauaacauaugcgccaacucuuuaaguaaucgacucuucuuggcaggggguuguuggaaaaauuaaaucaguugcuaaugacaagaaagaacaucuugcauuuaaauauuugcacauuuugccuagcucagagccaauucaaaggauuuucucuuucauaagcaaguguuuuccaucauccugacaccaccucucugugguagguagaaaagcagguaccaacaggaaaaaaaaaucauuagaucaccagaaagacaaagaaaagacaaagcaaaugcuuaguugcuauggaggaggugcacugaacuuuuuuuuucacugcucuuuuguuuaucuaaauuugggaauugucugcuuuauuucuucuuauuuuagaacaaacauuccaacauuugaaguugcauaaucauaaauuucaacauagggggacaaauauuuaccuguucauuuuguauuuuuaguagagacaggauuucaccauguuggccaggcugguuuugaacuccugaucucaagugauccacccgccucggccuccuaaggugcuggcauuacaggcaugagccgccacggccggccacaauuuaccacauauaccugaaaccuuuaaaccuuuaaccuuuuuuccagauguaaagggccuuaaacuucuaguucagaacacauuuggcuccuucugucuggcaucuauauaaaggugguauuauacuuacuuuugaggucaauauguuugagagguguugucauguaaagggggaaaaggaugggcuuuggauucaaucaguucugaguuugaauuccaucuuuaccauucaccaucaccuuggaaaaaucuauuucuuuaagcuccagauccaacagcugaaaaauggguuuauaguauucuccuuguggggucgucauaagacucaagacauaaauaacaaagcaccaucuuugcaccugauaaauacagagcauuguuaguuucugcuauucaagggucccaaaucuagggggauaucaguguccuugacggaaacccaacuucuuuaaugcaagggguacuaaggaagguaguagguacgguuugggugcuugcuagcaccuauaagaacacagagcaggcagcuucuguccauuuuugcgacaucauuuucauugugcauuuuacaucaucugugagcugggacugaugugucaacaccuagacuucaaaaacagacucugcaguuuucucacaaucugcuguaaauuauuguuccuuuucauucccuguauaaagcccacuuccugucacuuguuauuguuuacugaaccaaugcugaaaacacauuuaaaaaaaaaaaaaggagaagaagaagaaagaaagauucaaagauucacugaauacccagaauaugccugucucugcugggaauuuaaaagacucacucucucaaucaaugaauaacccuaccuaaauugacucaaacuguacagaaaucuguuaugaaacaaugagacacguaugauauuagaaugcucuucaaggacaguggcagccacagggagggaauauguguuuaccugacugaagccggguuaaaaaaaggcuucucauuaggagacaacauuuaagugggauuuugaaggaugcauaggagauuuuuagagggaaguaugaucuuagaaagaagaaaugagagaacagcauguacagagaccaggcggugcccaacagcauaaugugcuuccagagcucugagcaucuaucagaguacaacaccagaguagguggggcagaaaaagucaagaugagccugcaaaaacaggcaaggcuugaaauagcaaugacuuucuugcgugaauucuuucuaucaaaaauaaguuuccauacacugucaagacagucuauugccucacuuuucugcuugguaauucugauggaaaaguuuucaggaaacauccaggaaguuuugccuaauuaaaaauuuaaagagacuaaguucaucuuuucaaauaaaguauccccaaagcauguuuccucaacuuaugagaacaguaauaauaauaauaauaacaaaagaacaaccuuuuuuuuuuucaugugacauccaugggccagucucugugcuagaugcuuugcaagcuuuaucucucuuaagauuugaaaaaaacaaaaacaaaaaacacuagagguagcugcuguuaucccuacuuauagcuuaucaaaccaaaaacuaagguucagaaaggcaaaguaaagucaagcaguuaguauaaguauucacccacaggucuggagaguuacaaaguccucucucugcuaagccucaggcaauggcccuaaccucugaagccucucuguccucugcccaucauaggcuuggaugcccccagccagaucgaggugaaagaugucacagacaccacugccuugaucaccugguucaagccccuggcugagaucgauggcauugagcugaccuacggcaucaaagacgugccaggagaccguaccaccaucgaucucacagaggacgagaaccaguacuccaucgggaaccugaagccugacacugaguacgaggugucccucaucucccgcagaggugacaugucaagcaacccagccaaagagaccuucacaacagguaaaaggccucccccuguuaacagauauaguaaaggaaagauugaaagauuuccaucccacuccauguugggguaucuuccaggcucauuuuacaguacgaaaaaugaaagggguauuucuacuccuguaaauuuuaaaauauuguagcaauuuauuaauuaauuuuucaaaaaaaauuccaaauaaccuuccaaagcacuuuugggggugggggacauauguagaagaugcuggucugauauucucagacaaaaguucugguuaaaauaaaguucaaauaaauauuuuuaaaguaaaauaugguauauggaaaacauauaugacaaaugagccuccuaacacuuuagccuacggcauuauuuuaaaaguucaaaagugucaauuuuucauucaguaaauauuuuucagagcucaguaaguacuuugugaguuauuagaaauaugaugaggaggccgggcgugguggcucacgccuguaaucccagcacuuggcaggcugaugcaggcagaucaugaggucaagagauggagaccauccuggccaacauggcaaaacccugucucuacuaaaaguacaaaaauuggggucaggcgcaguggcucacgccuguaaucccagcacuuugggaggccaaggcgggcgaaucacgaggucaggagauugagaccauucuggcuaacacagugaaaccccgucucuacuaaaaauacaaaaaaaauuagccaggcgugguggcgggugccuguagucccagcuacaggcugaggcaggagaauggcaugaacccaggagguggagcuugcagugagccgagaucgcaccacugcauuccaaccugggugaagagcgagacuccgucucaaaaaaauaaauaaauaacugggcgugguggugugcuccugcaaucccagguacucgggaggcugaggcaggagaaucacuugaaccugggaagcagggguugcagugagccgagaucgcaccaacacacuccagccuggugacagagcgagacucuugucucaaaaaaauaaaauaaagaaugaaauaugaugagaaaaugcaaaagaccaguuuuuacacucaugagcuuauuuuuaagucuuugcauuguuucuuuaaccacaaagucugagaaaaacacaaaugacuaaagugucgcacucauccauaauagggaaaggugccaaaucuguagcacuuguuuagauuugcacauccacuauggggacagaugagugugcugagaauuuuguaauuucucuccaguuccaggcacguuucauaugucagcuugagcugucaaagacuccugcucucuugugacugauauguucaauacaaauguuccuucucucaaacaggccucgaugcucccaggaaucuucgacguguuucccagacagauaacagcaucacccuggaauggaggaauggcaaggcagcuauugacaguuacagaauuaaguaugcccccaucucuggaggggaccacgcugagguugauguuccaaagagccaacaagccacaaccaaaaccacacucacaggugagcucugcaucucugcaagccugagccagccagcccuagagggcccuuaaaggaugggcaccugcucccacauguccccauuugcaacccucagaaauaaguccaauuuccugaaauacugcuuauuggauugcagugaguucuuuuguaaaacauuccgaaaauuuguuguagccuccagagaccaacucaaagccauuuuuaucauccucugaaagucucucugauuucaggaugaaucucaacuugcacauucucuccuuaggucugaggccgggaacugaauaugggauuggaguuucugcugugaaggaagacaaggagagcaauccagcgaccaucaacgcagccacagguggggcacaccuggaauucccaucccacugagcuggugcugggcagaugagacagagucaauguggccaaaaccuauuuaaagagaaaaaguagaagccuggaggaaaaagggcccuguaguaccaucuagccccaauguugaaauucaaaaggaacauaaguacgguccaucuguaugaugccaacaucauccccuguauggaaaaggggacuggggauuuuguguuuguuguuguuguuguuguugagauggaguaucgcucugccaccaggcuggaguguaguggcaugaucucagcucacugcaaccuccgccuccaggguucaagagauucuccugccucagccucccgaguagcugggacuacaggugcauaccaccacgcccagcuaauuuuuguauuuuuaguagaaaugggguuucaccauguuggccaggauggucucaaucucuugaccucaugauccgcccaccucggccucccaaagugcugggauuacaggugugagucacuauguccagccgggauuuuuuaaagaaaaauuggaaccaggcuuuguaagaaauucaugaacauguguaaguugguaaucaguugcaucuuuuaaauaaaccauuaucuaguccaaacacaacugugggguuuucucugagaaaacaccuaacuuuuauaccccugucaagcagauuauaaguaacaggauuguaguuuaaguccaggcccugcacuuaccuguuguauccuguagccgcagcuuguaggugaggaugcugaggggcuaccugauuugaggucauugauucuuuccucaagauuuuuuuuuccauuuuucugggaaguuugcacugcaaaaagaaaacuccuccucugccucucccccagcccccagcuuaccuccccacaggcacuaugaggaagaaggaggcuaguguguaaagaggagauggaucaucauugagcuuccacauuaugcgggaugcaaggccggacauuuacaugccaauucuuuuuuuuuaaucuuuugauuuugagauaauuguagauucacaugcaauugugagaaagcauacagacagauccccugugcccaucacccagguucccccaaggguagcgucuugcauaaauguagacuaauauaacaacugagaaauugacauuggcguaaucuguccacucuauuuauauuucaccaguuuugcauacacucauucguauguguguguauauacuuaguucuaugcaauuuuaucacacauguagauuugugaaugcaccacuagagucaagauacagaacagucuuacuacaagaaucccacaugcuacccuuugcagccacagccaccucccucccuuugccccucugccuaacccugggcauucauuuaucuguucuucaucucuaugauuuugccauuucaaggaaugcugcauaaaugggauccuacacauauuaguccauuugaguuacuguaacaagaauaagaauaccuuagaccaaguaacuuauaaacagaagaaauuuauuucucacaguucugaaggcugcgaaguccaagaucaagaugccagcagauuuggugucugaugaaggccugcuuucuggcugacagcaggccaucuuuuuacuguguccucacaggacagaaggggcaaggucucuuuuauaagggcaccacucccauucaugaggccucccaaaggucccuagauccaaaugucuucacauuggggauuagguuucaacauaagaacuuuagagaggcacagacauucagugcauagcaauacagcauguaacauuuugaaacuggcuuuuuuuccuucagcauaauucucucgagauucaucuaaauugcuucuuuuaucaauaguugguuccuuuuaacugcuuuaaaucugagcagcauuuuauggaauggauauuccaugacauuauuuucaaucuucucagacuccgauggggucaugugggugauguauaauuagaccuauuuuacaaaaguaaaaagagagacccagagaugugacucuccuguggucccucagcuccucuguggcagaccuaggauuccagcccagaugcaguugacuuucagccccagaagcagcccugucuugcagccugaagagcauucaucucucuguucuccucccagaguuggacacgcccaaggaccuucagguuucugaaacugcagagaccagccugacccugcucuggaagacaccguuggccaaauuugaccgcuaccgccucaauuacagucuccccacaggccagugggugggagugcagcuuccaagaaacaccacuuccuauguccugagaggccuggaaccaggacaggaguacaauguccuccugacagccgagaaaggcagacacaagagcaagcccgcacgugugaaggcauccacuggugagucugcccugagcuuccuccaaacucuagguugauucugagguuagcagaucuccucagccaggguguccucacaugagaaagccaaaugcaaaagcaagccacuuucuccaucucugaagccccugaacaccacuuugaaagggcugcuuacucgucuuuucuaccuccugucaacugauacagcaaauuucccccacugggaaauagggguuuuaaaauauuucuuccuaggagaacuuuaaacaucaggguuuguguuugcauuuaccuaugauuuuuguuuucuuuucuuaacugugcaucacagcaucuuuucaauuguuucuuguuuauuuccuucuuuuagccuaauaauuaauuuacuuuucauuuuacuucauuuaaagaugaccaagauguugguaauaauauuuuuuuuguuguuguuauuuucuacaaacuguuuuuauuccaggucuuuugcuuucugccaagguuaccccugaagaguggcacacggcccuuugagacuuccauggugcccucucauuuucucuuuucucuuagucauuaagacauuaaccuaguuugucuaugacgacagcuuaauccugacauuguggcccaugcaacuuguguccauucuggcccaugcaaccuguucacugaaccugaggccaugguuacucgguggcuaaacugaagagacaaccagguuuuuaaaauauuucuuccuuuaugaaaaauaagccuauucaauuuuggccaccaaauauucgaaauguauagguggaaaauguuacuuuuccaggguuuggcaaguaauagucuuuacuuccaauuuaauuaguaagcauguauugaguaccuacugcauacauuguaccguacugauauuugaggaaaaguaguucccaaagucagcauuguuauguggacucauuugugccugcucauagugcuugcggaagacuagauacucagaaugcuagacagaacucgagaaaaagagugauccaaggaaaucaggagagcuggcaaagguguuauggcaagggauguuauuccaguugaagcuugauaugcaagaaaaggguuagaaguguggacauauuuggaaauggcuugaagagucuuucucacaauaucuucagucucaaaucacagucacuuacuuaagauagaaguugguuuucuuucuuauaaaaugaaucuggagcugggagguacagggauaacuuaguaguuucaaauugucaggcacccaggcugcuucuuucuuuuccaccauuuuuaguccuuggcuuccauucucaaagucaucucagugucacaacauggcugcuguaauacagccauuccaucuguguucuaggcagcauaagggaggaagaaccaaaacucccaaagaggagcaccuucugggugagucuuucuggaaaccccaccaaucacuucuccccauaguucauuggccacuccuagcuguaagggaggcagggaaagguagucuucugucugaacauguuacuuccacauaaaauugaggucauuuguaagagagaaauuuggcagacaaugagcagucccugccagagucugaaaugaguuuacguggucaauucuguugacucugcauugacugcuucccacccaacuauaagauguuuauaaaggaugcucugaaagaauaguuuaauuaaaaaauaagguggggggcggggauagaaccaagaagaaauaaaucuauaguagagauuuaaauuucagcuuuauaaacaugagcuuguuauaaagugucaaggggcaacaaaugaaucagaaaugcccaaaagaugaaaucccucucuuuucuuucucuuucucucucuuucuucccucuucccucacuccugcucuucuuccuccuccuccuuccucugccccucucccuuagcuuucccuugaguuugauaaaugcuguaucuaagagagauuccuauugccccucaaucauuccaccuucuggugauggccacauugccuccuuccuccagugagaaaaccucacaccugcgcagucacugaagaaguuuuaucucccuaagauccugagguguggggcuucuccacuagagaaaggagguaauguggcuauaaccaggagauuuacuagcuagaauuauucuguuucugaaugagagccccauauuggcauuccaaagccucagcaguugcauuuccccaccacgccuccuuaaugccauuucaaagauaucauguuucguauuuaaagacauucuucagugugggaaaaaugugcaaaguucuuuuuauugguucuucuccacuguccacagacuauuucccccaucccuuucuccacaggaaaaaauauauauguuucauuuaaggugaagcagacgcuucuuucccuccuugaauucuaacuuuuaaagccuucugcauucacucagucaauaaaauacuaucaccaugcucugugcuaaguucugggguuacuagagcaaagaagacggguauuuaauuccaaggaacucacuguguagcgaacaaacagacacugagauaacauucugcucacuacgaucgaggguacagagggugcagccagugcucaggagacacuggaucuaacuucagagaaucaggaaaggcuuacaaugggaagacgcuuuuggacagagacauaagaggcaaacauagauguguuaaauggaauagcuaaagaaguagaagcccaggcaccugaccuugguaagcauagaggaagaaagaaaacaggaaaagcgagagcucuugggugaaggagccauguggcuauaaguccugaaauguugcagaguuuuagguucaaccaucagaagcaagaaccuuccagcucuguaucacuggauucuuaauagcagaagccugccaggcgccacucaaugucuguggggcuuacagagaaaaaugaagaaucaguggcccugaagaauuuuuccuggggaauuccaggguuuuacugauggauugggccauaauguaagucuuuuucuugauguggcaccauacuaaaaauaugcauaaccuggccaccuaucacaccucucgcccaaagacccagccauggguuacagggcccuacagaaucuggcacggccagcccauccucugaccucaguccugccacucauucccuugcucacuucaccauggccucuugggccuucacacuguuccuuaagcuuucugagccugcucccacccucgggcuuuggagugugcugcucccacucccuggauaccacucuuuucccagcacuucacagagcgugcucccucauuucacucagcagcucagauaugacccagaacagagggcuucucugacuaccagccuaaaaaggcacccccauccugaucuaccccuucaagcugcucuagguuuccuugugaaacuuaucugccuugauauuaugcaaguauugguuuacuauaauaucuauggccugccuccccaucagugagcagaauauaaggacugauuccaucauccacugcugaaucccagugcccugaaggcagacaaguaugugguaugagcuucaugaguguuuagggacccuggcuacuucagagucagcauuuccauagaaucuucugauucuucccuuccaccucugcauuaacaccccaauucuuuccuuaaggcauaagggaaaucauucccuuggaaagucuucaauuccgcuuaaucuggauagaaaaggaaggaaggaaggaaagaaggaaggaagggaggaaggaagggagggagggagggaggaagggaggaaggaaggaaggaaggaaggaagggagggagggagggagggagggagggagggagggagggaggaagggaggaaggaaggaaggaaggaagggagggagggagggagggagggagggagggagggaggaagggagggagggagggagggagggaggaagggagggagggagggagggagagagggagggagggagggaggaagggaaggaaagaagggaggagggaagaacgaaagguaccgugucuguuggcauuuaaaaaaauuaguguguaccaggcaucauucccucuccuccucucccauucccucccuucucuuucccucuccuccacucuauucuccuccccucuccuuccucucuucuccccucuucucucuccucuccucucucucccuuuucucucugcuuuuguacucuuauaaacccaacuaaacccugcuuaaggucaaagccaugaauuugcugcaugccauaagagacaggaggcaggggugauaggcagaaacauaaagccagcaaagcauauuuucauagcaacauaagccuugacagugacaacccaguagcucucaggaauuuuggaagaagaaagguggaauuuuguuuuuagccacagcuaccaguaauacagaacauucugcucuuauuugcuauuuugauuuucucacagaccaaacugaaauuuauucaaauauuuauucauccagcaaauauuuauuucauaccuacugugggucaggcgaugccgguguauagaagagaaagaaacagcuucucuucucaagaaauggugcacguugcuauaagagagagaaccaaaacccaaauuauaacacuguagcuuaucuguuuuagagggauuugugggaggcugcaggagcauacagacagguacccaucacagaccuaagcaaagggaaugaaaagcacuggagaaggcuuuuuggaagaagugauguuugguugaguucugaaaaagaaaaggggcugggcaaguggagaaagaguaaugacauuuccagcaaagggaauagcaucugaaaagcugaaaagcaugagaaacuuuaccuuagugaacugcaagcuauacaguccugcuauaugauagagugggaaaacaguaggguaggaggcuagagacaucaucaggggcaucugcaaaggggcuugguucuuggcaguuacaaagaaaucaccgaauguuuuaaggcagccaaggcuucucauuucaauugucuuaucucugagagaugagaguaaagcgacugaagauacccuuugggguugucaggcuuggaugugaccaugccccugcugugggagaaucacucuuucuccccuaaguggacgcugaagugaguuccucaucaagccagcacuugguaaucacuaucuagaagaugguaacaaucuacagauuuuuaaguuggcacugucagaaauuccuccagaccagcugcucaacccaccaggagcacagcaauggguuucaaaauucugauuucccaggcccacugacauuguucaaggguagauuccagugcacagcuguaagaagaagacaacagccuuuugauaaagaaaugccaagaaauucaguguggaaucuauaauggaaacacuuggcuucuagggcaguaaguccacaguaugucauuugcaguugaaauguggagccagcauuuaugugaagccucuugguccucaucucaacuauuguccacuguauuuuuuauucauaauauucccccuucuuucauaauucugacccccucucucuuuaauuuagcuacugauuuuauuuguggaaguuguaccuuuuacucacuuggcuagcauuuauuuaauaaagggaucuggauggggcacacguagcauccacuacugacauggccacaguacugccucucugaguuauaaaccaaugcucuuucuugauuugccuaccaaaaaaaaaaaauaguagagaaauagccaaaaguguuagcagaaguaccaacaccaucacuauuacuauuuacugaacaacaugacauuauguaaaaaaaaaaucacucuaucaacuauaugaacagaugaaacaggauguggggacaauuagaugaaaguaucaguggcauacuaaauauccgauucaaagagauaagaugauucucauuaggaagagacauuuuccaacgugcaucuuuucucuccauccaucuuuugccacagcuuaaugggcaauccacaaucucauucccccaccccccguaagguaacuuucccaauaucucuuucaagggggcauuuaaaauuuauuuuauagaaaaaaauguuuuauguaacaauuagacauaaggauuaaaagauagacacccguagaaaaaagacaguaacuuaauucacacgaagggguacguugucaaugacagauuaguuccugacagguggacagcagagaaacaaaaacaggaaagugggauaagaaggagagcuaagaagacauaggguugauuuaauuuucacuuagcucuguuuuuguccuauaucucuuucuguaucaggacugcugaaauauuugagaaggacaugcucuugaguuuaguugugcuuaaaucccaaugucaaggguauaaucacuauauccagggaacuguuucuggccucacaaggcccagcaggauuaaagguaguugacaccuccuuucuuuuccuaaaucuagauacaucacuugcaguuugggguccucccuuucucauaaagaccauguuuaggugguuaagaacugcuuuggagccucugguguaagcuuuaggauaugagucgggguuaaagaggagucuguauucaagaucaaguauugcaaacauuuucuguaaagggccagaugguaaauauuuuagacuuuauaggccagagaguuuccauuacaauuauucaacugcacauuuuguaacacaaaagcagccaucaacaauauauaagugaacaagcauggcuaugcuccaauaaaacuuuaucuguggcaccagaauuggaauuuuauaugacuugcaugcaccaugaaauaauauucuucuuuggauuuauuucccgaccauguaaaaaaguaagaaaaacuguuguuagcuugcugacuaccaaaauaagcagcuggccagaugugggccucggguaacaguuugcggaccucuguucucgaucaaacaaaauuugaaggaguguaugcucugacaauaugaaacaagcaggaagaauguuccccagaacuuagaaaugucugaguuaaaucaauuccagaaaagaaauguuuucuccucugaaaggauauccucaaucaaauuccaagcuaagauuuucaacuuaguagccugcucuaauggacacauaaggcucauuugaaauuagcagcaaugugaaguauaaauagaaaaaaacaguuuguucuuuuaaaugauuuaaagucaguuucuacucucuaguuuacaggauccauuuccagagaaauacuuuccuuccuaaacuaugcaaaguccacuuaagcucagcccugggcaaauuaucucccuuaagucagguugagaccagugaguuuuuacggaauuucgugcauucgcgagaugaaugaacagggugcauucaguuuuacuugagcuucauaagaucugcuucucccaggaccucuuucuuuuuucuauuaaggaacaguuuuucaaagccuuaucaccuuccuuagcucagccuuaauaauacugugucaaugugucucugaucuuuacuaauaugaucuauguaaaugauuugaacgcuagaaacugaugaaaucccaauauaaacuauacaacagaccucccauaggauauugaggcagcacaaaaaagaagaggcuuuuuuuuuuuuuuuuuuuuuuugagauggagucucguucugucacccaggcuagagugcaaugacucaaucuuggcucacugcaaccucaaccuccagggcucaagcgauucuccuaacucagccucccaaguagcugggauuacaggcucacgccaccacacccagcuaauuucuguauuuuuuguagacacgggguuucgccauguuguccaggcuggucuugaacugcugaccucauaugaucugcccaccuuggccucucaaaaaagaaggguaucuaagaagagccaauugucucaaaauacagaaggucggacagcucaaaccaagacccccagaauaacugagggccaccccauuaugaugcaagacauguuccaaaaugaaaacugaagcucagagcaucgcuaacauagacauauaguuuucuaaaucugcaggacacugaucaauaggaaaauaccauuuccaagagaaaaacccaaauaugcaugaaggcaaaagaaauuuuuuguuuguuuguuuugagacagagucucacucuaucccccagacuggagugcaauggcgccaucucagcucacugcaaccuccaccuucuguguucaagcgauucuccugccucagccuccugaguagcugggauuacaggugcccaccaacacgccuggcuaauuuuuguauuuuuaguagagacaggguuucaccauguuggccaggcuggucucgaaccccugaccucaaaugauccacccaccuuggccucccaaagcgcugggauuacaggcucgagccaccaugcccggccacaaaagaaauaugacauuguuguccugcugguguuuuaauagggacagcaccaguaggggaugcagugaacaaagccuggcacuuggacugcaauggccuauagauguggcauuggguuugccauucccagguucucagaagcaaaacuuucugaggaauaguuuaacugaccccaucucugucauuauucagaacaagccccugagcuggaaaaccucaccgugacugagguuggcugggauggccucagacucaacuggaccgcagcugaccaggccuaugagcacuuuaucauucaggugcaggaggccaacaagguggaggcagcucggaaccucaccgugccuggcagccuucgggcuguggacauaccgggccucaaggcugcuacgccuuauacagucuccaucuauggggugauccagggcuauagaacaccagugcucucugcugaggccuccacagguaucucuuuccuuucuauuuauagcuucuguuuuucccagcaggaaacugcccaugaauaaucagacacgacuagcuuuggaauggacuuguucugccacuacuuaugucuauggggucuaauugugacacgaggccaucacgcuacagaaccccaaggcaacuuuuaauacuucacuccacaugaaugacacccuugggaguuguacagagcucaaccugcaggacuaaacacacagcucccaugcagagggccuuuagcuccauaaacagccucccuccuguuaaaggacguuaaggcacuauauaugaaagggaaagaaaaucacaaaauucucucaucuacugaggguuaaggcaauucuuuaagauuuaaaaaacaaacaaaaacaaauauuuuccugcacuuuccucucuuugcuccauuucuaaaauuuaaagaguugcaugaugcauguuuaucuaaagaaagucacauuuuuucaguaauauuauuauucagcuuauucuuguguuaaagauucccuggaucuuguugugugauuugaucacuaaacuaguucuuuguccuucuccaggggaaacucccaauuugggagaggucgugguggccgaggugggcugggaugcccucaaacucaacuggacugcuccagaaggggccuaugaguacuuuuucauucaggugcaggaggcugacacaguagaggcagcccagaaccucaccgucccaggaggacugagguccacagaccugccugggcucaaagcagccacucauuauaccaucaccauccgcggggucacucaggacuucagcacaaccccucucucuguugaagucuugacagguauucuagacgaauucacuaauucacuuccuccccuuugucucugcucgggaggaaucaaagcacuuucuugcuuuaaacugggaucagcuccuaccacauuggggaaauaccagugaaucaucucugcuucuuccuaaaugucacaucccuuauuuggcuaaguccuaguuguagcccaguuccauggaaaauuccaccuacuccuccuuuaaaaaagugagagguggcuuuucuuucaaaguaaguuucagucacaauaucuaaaaaguuggaaagcccaaccuguaaaugaagaaaaaauagcucugagcucaugagcucauuuuaagaacaccaaaggacuccccauagcccuauuuguaugucaagaauagaaauugugaacaauuccuaaaacuacuuuucauucccaaaagcugaauagaaaaacccuggcuuuagugccaacaguuugagugugcucaacaccugcuguaaaucaugcaucuauaaucaacacuaaccagacaacucaucccaaccuuagccaaaaugccaucucaccugaaucccagcgugcaauugccuuuuuaaguaacucagcaacucuguguccuuaugcagaggagguuccagauaugggaaaccucacagugaccgagguuagcugggaugcucucagacugaacuggaccacgccagauggaaccuaugaccaguuuacuauucagguccaggaggcugaccagguggaagaggcucacaaucucacgguuccuggcagccugcguuccauggaaaucccaggccucagggcuggcacuccuuacacagucacccugcacggcgaggucaggggccacagcacucgaccccuugcuguagaggucgucacagguauaugacccuccucccagacuggagacaugauaggagccagcaugucauugaaauagagaaaauucacccguguggcagaauccuaccccaauguuguugacagacagcgugaaucucuaacucaggaaggucuguguuggaauuccaccucacuagcuaaauauucuugggacuauauguguauguauauauauagauacacauauauacacacacacaaauauauacuuauauauauaguguguguguguauauauauauauguguguguguauauauagauauauacuuuuuuuuuuuuuuuugagucagggucucauucuuuugcccaggcuagaaugcaauggugugaccauggcucacugcagccucgaacuccuagacucaagugauucuccugccucagccucuacaguagcuggaaccacaggugugagccaccacacucagcuaaguuuuuuguauuuuuuguagagauggaguuucaccauuuugcccagccuggucucaaacucccgggcucaagccaucuucucaccuuggccucccaaagugcugggauuacaggcaugagccagcgugcccuaccucuauucuuggguauauuucuuuacaucccugagccuccuuuuuguaucuuuaaaucagcaaugaacccuacuucaggaaacugucgugagcaauaaauaaguuaaugaaugucagugcuuaguaaagcgcccaucacguaguaaauacugaauagcaaauagcuaaauuuaucauacagcaacagagucaugauuuuuaaaauagcacaaacguuagggcuguggcacaaaaauaagaucagaacuuucuagaaaaaccuuauuacuagccucagagccaccaacuaacacccaccugauaggcagaucucuacauaauaaccuuuagaaaugaugcaguuagcuucugcugaaacuaucuaggacucucuccucaacagauacaaaaagcagggacauuuccaagaaaggacagccaccuuugacuucaaugcuuuucauucaauuugggaaggaaaaacaauuccucucaauuuuccaccaaaaaugagcugcuccaucuguuauaaaaaacugugcuguacaugagauuucuagaaauagcuucaaaaagggcuaugggaaaaagggccaacuuuuuggugauaggguuucugugcugagcccuaagcccaugccccacucuacauaugcugccuuuugauaaugcaauccaaaucacucaauucaaaacaauuguuuuccuugcucuuauauaacagauaaacuuggugguugcuagaaacuacauaaaauuccaaaaauaagggggccagguuuuauuccuguguugccuggaauaucuucagaucaaacaagagcaaaaagggccuuugagacagguguggucugugugcaagaugcucauaucuuccucuguaguccgcaaacuuuuguuuuuagcaguacaacuccuuuugcaaaugaaaucuuccaaggaacccuacuauuugacagauaagugaacagcuguucuuggugugccuggaaguaagagggggauaccuccacccauguucucaacacaguucuucuagaaaagccccagaucuauguggaacacaguuugaaaauaaccccucuuaaaagcaagagguugcucagagguugcucagacucucacagggcauugaauccuuggauacccaagagcaaguaucuauaucuuucaacuauuuuugguugaaaucccugcagauauucuccucccuaacuucuaacccauggccacuucagccuucaaaacaguggcugagagacugcauuuaacccucagaagcaucccacaaaacaauggguuuuuccauauccuaaauccaaacuuucuaaaucaccaauaacaacuacguuaaauuuccuuucuacauuguagaagcaguaauaguggguucuguucugcaccauuuacugagaaaaaucuccuuucuuuuaauuaaaaguaggcacacucauuucacacaaacagcuuugcucugugauacagccauucuuccuuuagacauaaaguacgagcagaaaaagguggaagaagaaacaagcugagaacccaguacacaacuuuugaucccugaaagcugauagaagaccaaagaaaaaacaucauacuuguucacaccugagacagcauacacuuuaucaacccaggcagguagccaguggcuagugaugagauaaucuuucuaauuauaaauaaugaaauaaagcagggauuucucccugacaugaguaagaaauuccaagggaaaacacuugaacaaugauuucuuuauuaagcugacacuuauugggcacucgccauguaucagguaugauacuaagaaguugauaaauauuaccauuuaaucaucacgcaaucccaugaaacaguaccaucaacuccauuuaaagguaaagagaggguggcucagagagaagcugagugacaugcccaagauuaugcagcuagcaaaugcuaguauugggauucuaaucaaggacuacuugccuccaaauucugcacuuguaaccauugcuguaucucuuacccuaacccacaauccuacuuuuccaugugaauuucaccugcuagcaaugcaugcucccgguggguugugcauuggugcagaugucuuugccaucucaaggauaaaccauguagauauuucccuuucuggccauuuucaacuccugaagacaacuguggccagggaaccacaguucaaauugcaaaugcucagagaccaagaauuaaaaaaaaaaauuaucuuuccccuuucucucuuuccuagaguugggcugugggauguuugguuuccucauuuuugguuuauagaacugacaaauacuuuucuguccuucuucagaggaucucccacagcugggagauuuagccgugucugagguuggcugggauggccucagacucaacuggaccgcagcugacaaugccuaugagcacuuugucauucaggugcaggaggucaacaaaguggaggcagcccagaaccucacguugccuggcagccucagggcuguggacaucccgggccucgaggcugccacgccuuauagagucuccaucuauggggugauccggggcuauagaacaccaguacucucugcugaggccuccacagguacuuccucucccugucaaugcuuucuccccaagguucuuugcuuccuuuucaagagaucaugcgcggagucagcaucucgccauaacugaauccuuuucaugugccuuucaguggccggcugugcaugcucagagaccucccugugggcuaugacuuuguccucaugccuuugccauguggauggugaaugaugcagguguugcccuuucugaucuccagccccccagccuuucauacuuuaccuggcugauucuacaucuuuuuugaaugaugaauuuuuguuucaggaaucagccugaugguuuuaauucacuucuccagugcuuggagauaacuaaaagcuucccucccuauauaugaguucugguggaacacagauuauuuacuucugagagucuuuugcuaguuggaaauggugcuuuucuaucucuaaaucccucaaggauauggguagugugguucuugcauguaagaaauguuucuuuaaaaugcacccaguauaauaagagaacugaauuacccuccuccgggcaguucucucagauacugagucauuguuagaacaucaaauuagcaaauagcuagaccagaaggaaaaaaaaagaaauuacacaauuaugacuggagacuguaccaaagagaaagccauucauuagcacaaguacacacagcagcuuuuggaacaaggaauguccugggcuaugaaugucaaagaacugauacccuuuuugcucuuuuaaucaagaguuucucucuggaguguuggccuuuggauggcaaacucccagccccagacccaggagggugcauuauaguuuacucgucacucuaccccuguuacaagacuucaguguuucccgggggccugccaaagucagcagccuuccucugacacaguuuuccguugcucaucuuuauuaugugccuccauggguuugaagcucgguagagacuaucgcuucauuuugcauaugacugcuccccuuuuuaaauaauuauugcaacuaaacuuuaaugcauaccuguacaucccaguugaaucuagcaagagcauagcucugcauuuuaaccucagucauuucacuaauuuucacugagauaaagaaacauaaagcacaggcaaccacugccaggacggugacccugaaaugccuagaauuugcagccgaggcuacucugaaggcacccggaccuccuuuuucugagacccauaaaccaucccuucccagaaggcaaaguaaucacccaccacuucugaucuuuucugcagaucuuguggcuuggguguccucaguauuuuuauguguguguguuuuucuucuuaacaauagcaacauucuugccacugaugaauuggccuaugggcaggaaguuccauaaucccaucugaucuguaucucaacaaaucuauuagaaggaucucagagaccaggagccuucuuucuugcuaaagagacaguacuagcuuuucaaacccugcuccuaccugcccucugcauguuuuauucuuaugguuggggaaagcacuggcaggaccaucuucaagacaaaauguuauuucuucgcugaaagggauggccuaaacugccuugccuuggcuuagcccucuugguuggcaaugcaauacuagccuuuuuggcccacauagcagcaguuaagagaggacaagcuauuuuaacagaauaugagaauggcuggcugguccuucucuaaaguaugaaaaaaauaccaagaauuacacugagaaauugguaauuaccauuaagucacaaaaucagaagccucaaguuaccaccuugggaagguaauggcaucagaauuauuuagcccucauuugaauagaugggagcuccuucaaaguaaagaaugucuguggaaggcauccaaguaaucuugguuuccuuaaugcaauucaagagacuggaaguugccaggacucauaucuuuugaccaguggccagcaacccugagguagggcucccagaggcaagugugguuaagaugcaacaguuccugauaagaucauucagcacaucuucuuggccagggccugauuauauguggcaacugcauguagagaaaucuaauugccauaccuuccuuuuucuaauuucuuuuaacaaaacugcuuuuucucucccuuuggcacuaauugguaacauugcuuccuuccaucauagcccugaauuaucagaucucucuacccagcaaugguucuauuaacaaccucaaucuuaaaacacagccaaauaauuaacucaaauuuauuuuuuucuucuccccuaccccuuccuuuuacagccaaagaaccugaaauuggaaacuuaaauguuucugacauaacucccgagagcuucaaucucuccuggauggcuaccgaugggaucuucgagaccuuuaccauugaaauuauugauuccaauagguugcuggagacuguggaauauaauaucucuggugcugaacgaacugcccauaucucagggcuacccccuaguacugauuuuauugucuaccucucuggacuugcucccagcauccggaccaaaaccaucagugccacagccacgacagguacaugugcauucucccauuucuaacgcacucucuccacagucuucuuugcagggugaagccucuccuucuccucucccauugauguacaagccacagggcacuaacucuuccauggugcuaggcuggggugcuguuuaacauaacucuuuuccaacagcagcccaaauaaugcauugccauaaagacaugugccugauuuaucacugaccaggauguuuacagcauaaaauguaguucagucuaauuugccauauggaaucuagagaaaagaauucuaaccucucauaacuaaaaagcuauauaacuagaccuguucuugacuuugaaagaugucugccucagucaaagaggucuuguaaauuuuauuuuguauuaucuuagugucuuugucuuccuagucucuuggaccucgcaauacccaaauaucccagugauuuaauaaucauguugaugguguuggguauuuuuuuccaacugggaaaguaaagggaaacagcaaagauuacuuaucagaugagugcaggaggcagccaugccauucagaccaccccaguuccaacaccaccucuagaagaucagaacaugcugucuugcccucagaauagugaaugauaaauggcaaaaauaaaaguagaauaguuguguucaaacaagggacuuaguuuaaaaaacaaaagaauaaacugcucucacuuuaaauuuguggugucugugagaugugcacuaagucagaugcucuuugccaugcaguaaaagacaacccuaugugaauuuagaaaggggagccccccuuucuaaugcuacauucaaaguagcauucuuagcacaauuuagacagugccuucucuggagagguaaaugaagaaaucacaaacuagaaaaaaagaaacaauaucuacagaacaaacacaggagaaaugaagaaaucacaaacuagaaaaaaaaauauugucuacagaacaaacacaggauaauuuuuccuuauaguuuacaaaaaggggacucauggucugggaaauccaagaaaaggguugacaucguagcaucaaaauugccugucauuuaggucacccaugguugagagagggucuguccucauucuacaugaggcuacaaauugucgucagggugauccauggauaaggcagagagagccaacauuauccaguugcuaucucagccagguucaaguauaaaaaaacuuagaggagaaaauuaggcaaacauauauguuuguuucucauggcucaaaccgauuuucaacaagggacaaauuauuuuaccauuaacaaaggguaaagucuaaaacuuuauggauuuagucuuauguguuuugauuuugacucuacaaugguguuuuaaauugacacacuuucuuuuuucuuuuuuuucuugcuuuaguagccaaaccucuucuuagccaccucacugucucaaacaugaccuggggcaguguguccaucucgugggaagcucaggagucugccuuugauagcuuucuuauagaaguuaguaauuccgaucacccccaugagaccauggugcugucugugccuggggugucucgcagcucugucaucaccaaccucaaagcuucuucuaauuacacugcccaccuucaugggcugauuggcgggcagcgugcucagacccugaugguccaagcaaccacagguauuuccuauuauggcuucuucacucuucauugaauuuccucugaauagcuuuccaaaaaucacccgcuacccacuuuucacccuccuaguugcucccaauccuucucaaauuugauagagccauccaaaucaaagcuuuaaagcuuuaaaauaacucucaccccaaauuaaagaauuucagugucaaaccucuuuuuccuaaauauccauucacaucuggaguuguucuguuuguuuguauaaaguuaaccugacuugcuuugguugaauuucuaaaucaucuuuucaucugaucuugaauaaucuuuuucaaucccacccauuaucaucugccuguggucguucuaaucaaaguuugccuaugucauguucaaagagguaugugcaugccauuucuggugacuuggucagaaagaucuacacucuuuuucucucuagcaggauuuuaaaaaauaaaggugcccugagcaugcugagaauagacucugaaucacaacccaagaauugcaugagaggacccaguagucuuaucuuguucucgugauuuuugucugaagacuacucuuuuuugacauguacuuugucaagcacauuuugucacccacugauagcugucacaaagucucaggcucuucuuucaagccaucaucuuguccaaaucuuggugcauguggugaauauucagagcauuaaauuuugaaaauguuucuuuuuccuggaagcagcuagcauguccaugagucauuucagaagguuuaaaguggugggagaaaaaugccccucauuuugcauggaacauugaccauacccuaacuaccacuaucuuucucuguuuuuucuugcaucucauuucucagcuugguugcacccuuugagaggcagcuggagguaaagcugaccucaagaaccugagucuuauucugcauggugaaucuguuggcauugauagucugucugguagcaugagaagaaucccagcaugcauccuuaauuugggagauuguuucuacagcaaaauauagggaaauaacagaguuccacuuggaacauuuuaaucuuuugugugguugagggaauuugucaaagcuauagcugcaaaugauugcauuguuaccuucugaaacuaauugauaaggaggauaucccaugucaaugcuaauggcuauauucugcuucugaaccaaauccuuuuuguucuuagagauuuuaugacaucgaauuaugcuguauaauugugccauuaaaguuuauccaaaugagccccuucuuuccuccaaacuuuggagcugaagcaaaauaacucccaaguccuuggaagaaauauugugccucuucccaacccuaaauccugaucuuaauaucugaauccuccaguacuguugccucucucuaaaauacagucugggccgcacuuacuuuaaaauuaguuuuauuugauaaaugagcauuuaggaggccagccccauaaacaucuagccauauagaccccuuaacauuaaaugaguugcucucaaaacugaaugucuagacuuuaacagaaaagagauacuuaaccucagggaaaccaucuaucuguccaaauuauccaauaauugaguuuccuaagcagaaaauucaaugccuaacuucaaguuuuucuuucaccuuugcauucacugggaauuuugaauggaagccaucuucaccuuuacgguauuaaaugguaaaauauagauuuuccuacaaugcauauuaaguacuguaaaaauuucucuuguauggguauuagccuuuaauuugugcaaacaguagauacuaaaaaagaauacuaaaugaggaaacuccaaagaagcauuuucuaaaacauguucaauggaacaccagcuccuugagauguucaaaggauauuccucagauaggguauacauugaucaauaaguuuaugaaauuugggccaaacaaaauuaaacagguuuacugacagaaccagccugucagagccuuuaaaaugcaaacccaccuugugaaucucuaugguaagacauaauauucgguguuuaccaugcauacuuaaucauaaagcugucuuuucuuggaacaucuuacagggcuuguguccccaguacaaacuuuagaaaauguagccuuaauacccuucacguuacuccaaucuaccacucuaauggcuugucuacucuucuucauacaugacuagcaaauggugguguuuaugcuuuaaaagaacacagaucuaaaaaauaaaauaaaaauaaagaacacaaauauacaccugcagagaaagcaauauauuuucuaucaucauauucaaugcagguguagacacagccuaacauacugucucuucuguauguauuuggagauauugaugcuuucauguucuauggcuacauucuggaaaaauccacugcuuccucuaauaaugucucucucuuucucucugcccauauuccuucuuuagaaccaaagccacaguugggcacgcuaaucuuuagcaauauuacuccaaaaagcuucaacaugucauggaccacucaagcugggcuuuuugcaaagauuguuaucaaugugagugacgcucacucacugcaugagucccagcaauucacagucucaggagaugcaaagcaagcucacaucacaggcuugguggagaacacuggcuaugacgucaguguggcaggaaccaccuuggcuggggaucccaccagaccccucacugccuuugucauuacagguacucaaucagagguucucacuugucuaacacagagagaaaaggagauaagucaucuuaaaggaaaauucaacaaaaauacaaucuucacugcaaauguguacucucuuauuuuuaauugacaaauaguaauuguauauauuuauggagaauaguguguuguuuugauauacauauacauuguggauugauugaaucaaccuaauuaacauaucaaucaccucaccuuauuuauuuauuuauuuauuuauuuauuuauuuauugugcugugagaacauuuaaaaucuacucuuuuaggaauuuugaaguauucaauauguuauuauuaacuauggccagucaccaugcugugcaguagaucacuaaaacuuauuccuucugucuaacugaacuuuguacuccuugaccaacaucuccccuuucuucaucuccccaaccccagucaccgguaaccaccagucuucucugugcuucuauguguucagcuuucuuagauuacacaaaugagaucacgcaguauuugucuuucugugccucgauuauuucacucuguacaaugucuucuggguucauccguguuguugaaaaugacagaauuuuccucuuuuuuaaggcuauaaaguauuccauuauauauauauguguauauauauauauauguauauauacacacauauggaauguauauauuuauauauaaauaugaucuaucuauacaccacauuuucuuuauccauucauccauugacagacacagguuacaauacauuacucaugauagccaagauaauauauguaaacuucuaaguaaagagaaagcagauacuauuauaaaggagaggacuuucacagcugcucuuaggaaguggagagaacguucucaagaguuguauaaagcuuuuaggguuuuuugugcccaguuuuauuggcuguuuuaucccuaguuuagagauucugccuaaaaagugacuccuaaguuaguaaaggccuaagaucgaaauccuguucauaaaucaugcuagguaacgcaguucauauaugugacaaaaguauaaccaucuuuuucuuuaaaaaauaauuauucuuaaaacugacaacacagaugcagcuagaugcagcuaauuugaaauuccugucuccuuuuuuucuuuugauuaaaaaaaaaaugcauuuaccaguacugucagaaaaaaaaaaaaaagaaaaaaaagaaaaaagaaaaaucaccuagaaaagagacgcugaaccuucuccacuaauccuccuuaucccucaggauugccaucacugauugggguuggcuuuggguauggaaagaacguagaacuuggagucggaagaccugguuguauaucucagcuuaggcaccuagcagauguaugaccuaggauaagucauuaacuucucugguuuuuuuagaugugaucgggguuggaagauugaugaagguucaaccucagauggcagauaaauuucaaguuuaauuaagcccuacccauucacucaacuugacuucuugaacauuugccaauguucaauuuggcaaaugcugccaaaugguggcagcaaaaacuucaauggcaaaggcugcacauggugucaguuuacuaaauucuagcccaaaaagccucagaaaauauuuagaagucucuuccuuuucauuagugauaauuuucagaagacggacuuugccaucugauuuucacauuaaaccaggucucucccagggucuaaauugccaucacuaagacaugucaauuaguacaauuaaauauuuaauuauaggcagcaugguguccuggaagagugaggauuuugagaucaagcuuuugugguuucuaaaccucucccacagcuuuuuagcuacauaauuuuagcaaguucuuaacuuguuugaacccuaauuuccuuaugcauggagagaggauaccacaggcacuucugggagccuugucucauagauuaaauagaguuggugaaauuuaacugccuagcauccaguaggaauuuuauacaugcuagguucuuucugcugucucccaacauuauuaggaaaguggcuuucuuaaaaauaaccaauaaggcuagauagaacaauagaccuaugcaaucaugaacucccucucguuuuuaagagaacuuuggauguguuuuaauguaagauuaaaaaaugaguauuuuuuccuauccaguuaccuaaugugaauuaaaucauucagaugagucuucaaaugcagaacaugguaauuucuuaagggacugagacaaggaggaacgagaugagauucucacuccucaggaggggagaaauggccacagaucccaucaggccauugcuuguagcggcuugcaggaccucccacauaacagaagaaaaggaagcugagagacccagucuugggaauccuagauccaguuacagcauugucucagcuaauccaugaugugaaaagauugcguuuuaaaagaagcauauuaaaaaagaaaaaaacaaaacaggagggacucuuaaauaacaagcccuugauugccuaauuagccugaaugcccucacuuucauuggaauucacugcuuugaugguguggaggugcaaagaggccagcuaucaaagagagaugccacuuaucuaaacaaaauccaggaacagaauucgagacccuugucucucagaugaagauuguuugcccaguauaagagauuucauccucgcuuuugauagaauuaugauucuugggaaaucuuuacguggaaaaaacugccucagaauaaacaccaaguguuucaaaauaacuacaggaaguccaagccacagcaaaauuuaaaucucuauuuacaaaaugaagguauucauucccuuauucauucagucaccaaacacuucuuuuuaaaacauuuuucuuuaugucucauggauuagacccuaggcauuagugaauuaaugcaagagcauuuaucucuuuguaaguuuccauuuagcuguaauggaaaagaagugucuaaacuagaugcagcuaauuugaaauuccugucuccuuuuuuucuucugauuaaaaaaaaaaaugcauuuaccaguacugucagaaaaaaaaaaagaaaaaagaaaaaacaccuagaaaagagacgcugaaccuucuccacuaauccuccuuaucccucaggauugccaucacugauugggguuggcuuuggguauggaaagaacauagaacuuggagucggaagaccugauuguaucucagcuuaggcaccuagcagauguaugaccuaggauaagucauuaaccucucugguuuuuuuagaugugaucgggguuggaaggcagguagcaauaucuaccuuacuguaucauuuugaagacuaacuaggauaacaaugugaagccuugucaguuggcaaguaucaauggaaacuuagccaacauaagcucacuccuuuuggauaucccaaugugugaaaaggcccuuuagcaccugagaaaucagaaugccugggacauacauguuuggugaacgaaugaaggagagauggugacagaauuuacuaagacccagauguguucuuguuuucuaacuuuauccaggaaaauaaacagcaaaagauuuagcaaaucuuaucauuucuuaguggguuauaaccaugagcuauuaauuuugacacaaaaaaaacuuaccuccucccuuuauuucagcuugugaggauaucucacuaauugacuucauuaauuugauucaaacugugcacuagaagugggauagaaacacaugaaguauaccggaaagaaauuauacucgaaaaaaaaaaaaagagcugaaggcagugggaaguagacaacgggauccaaacucaacaaaaugcaaccuauuuguauaaagaacuacauggccuuuggagucaaaccugacuaaaaucuucgcucuaucucuucuuacaagcuuguaacuuuagcuaagucaaucaacuucuuugaaacucaguuugcucacgugugaaauuagaauaauaccuaccucaugggcuauuaagagaauugcacaagauaacacuaucuggcacccaauaaguucuuacugaauuuucauuuucuaagcauauaacacaaauugaaugauggacuuggguaucuauugguguucuuggaaacgugugcuauccugacagagucagugcugcuaaccugaguuauuuucacuccucccuucuuucagaggcccugccccuucuggaaaaccuaaccauuuccgacauuaaucccuacggguucacaguuuccuggauggcaucggagaaugccuuugacagcuuucuaguaacggugguggauucugggaagcugcuggacccccaggaauucacacuuucaggaacccagaggaagcuggagcuuagaggccucauaacuggcauuggcuaugagguuauggucucuggcuucacccaagggcaucaaaccaagcccuugagggcugagauuguuacagguauuucaaaucaagugagccauuuguuccucuuccugguccccuucuguguaaucugucuaccggaucgccaugacuuuaacaucuuuguucacauucccuacuuaauccauaaauguagucuacuguuucaccuucuccccacacucccucuugucauauguacuuaaugaacacuccccacucccaccccagaaaugagaaggucgaaauauuucugcuuuguauucaaaauccuuuagaccuugucuuguccauagcucuugugugcuuaccucauaucaucgucccuugugaucaaccuggcugguccccagcuacauuucagccuucucaaaagaaauauaccaaugaguauauuuccaaaacguauuuaaaacuuuugccaucucaaaaucucaaccaugaucuuaacaaacuuacccagugggcucgucauuggaaaaccaaaugugaacuuauuuuaucgguaaucacuaauaucagagagacucugcaacacggacuaaauccauaauuuucucaagacuaaugauuccuacagaaauuaacaacggaauagucaaacaucuguguuucccaaagucuuucuagagauuacuagcuccacagaauguucaaagguccuacucggugaggaaauuccacguucaaauaaguuuggaaagacugaguuaaacaaaguuaaagaggaucuuuaacugcacggcuuuucagaacacccuaacgugcaucaucuccaagaaguacuuauccaggcaguauuuuccaaacuuauuugacaaaggauacuuuuuaaggaagaggaucaaacaggaauaguucacugugagcacacuuugggaaacucagcucuaaaucuacauugacauugaguuuugucuaguuaaggcaaugcaagaugaaacccuggguccacaguauguagcacaaaagguuccaaccucaguucuaccaucugaacauuuaucuaauaguuaauaaaauaacaagaaagaaugcaaaaaaaaaaaaaaaaagucaaggguaggagccuucuuuagugaaacagcacuaagaacaaagcaaaaagaccauaacauuuuaaaagccauuuugggcaggcucaaggagaauguaaucagcaguaucaucaugagcagcucuacagaucauuaaugcugguuuauuugucuuuucaaaaagaaaagaaaaaggucuugcaggggaugggcacucagccacuggaagacagagagcaaauguaaacaauuuacuggcuuugaacuuauuuaauaauaugugggacgggccaaugcugaguccagauguggauuuacugaauugcuuuuagacaaaacucacauaugcaaacauaugcuugacuuguauugaaugugucuacuccaucuuuccccucuccugacucuacuggacuuguuaauguugaaugauuuuauuuuugguaucucaggacacuucuaucucugaaagccggggcaucacuacauauugauaccccuacuggagagaagauugcacggacugguaaaugauguugucuuuccuccuucucccaccauuuucucucccucuagaagccgaaccggaaguugacaaccuucugguuucagaugccaccccagacgguuuccgucuguccuggacagcugaugaaggggucuucgacaauuuuguucucaaaaucagagauaccaaaaagcagucugagccacuggaaauaacccuacuugcccccgaacguaccagggacauaacaggucucagagaggcuacugaauacgaaauugaacucuauggaauaagcaaaggaaggcgaucccagacagucagugcuauagcaacaacagguacuguaaauaaacaggagagaacagagaaaagucaugacucaggggucuucuucucacagggcugaguaaucacaggagcuuuggaugcaggcaggcuggcgcucugauccugacucuuucaauuacagacuguguuaccuuggacaauuuggcuaaguccuuaugcaaaaaaaguaugaugccauuuacuuaauaggguugugaggauuaaaugagauaauucauauaaagcccauagcggaaggccuggcagguagcaagggcccagcaaaugagagcuauucacguugccauuaaugcaucaucaucguuacaauuaucaucuuuuuuuuuuuacguuccaaagauucuuccuucuaucuauuaucucaucauaucucaucucaucauaucauaucucaucauuuuauccagagauacacuuccuuguucuuuggccaaauguucgagcuauaccaaguagggagauaauggagaagcagcacgucuaucuauacacauuaauauuuauaaaaugcuacaugugaauaaucaguacggugaucagcaaggauaaaggagagagcuggcaagauuaacaugcuacuguuuaugaagcucucuaacuuugauacucauaacaacucugaaaggcaccuagaguguccuuggaguuuaauuaccuuuuuccauaggagcuguuucaaggagaaaaaaaaaaaagaugguuaauaauaugacucuuaggcccagagugauggcucacaccuguaaucccagcauuucaggaggcugagacaggaggaucacuugaguccaggaguuugagaccagccuaggcaacauaguaagacccuaccugugcaaaaaaaaaaaaaaaaaaaaaucaaaaacuuagccagguguggugccucaugcccguaguaccagcuacucugcaggcugaggcaggaagaucucuugagcccaggagguuaaggcuguggugagcuguguucgugccacugcauucccaccuggacgacagagcaagacucugucucaaauaaugauaauaauaacaguaguaauaauaugacucuuuguaauaauaauaauacuaagaugaacaugacuuuuuaaagagaaaaggaaaaaccuccaacaagucaaguaaauuauuucaugaaacugagggagaugcagagacauagcauucgcuggagauggcugcuucaaagggaaccaggggacagaaccacaaaaucaccaggagagauaaaagggaccugagagaugauguagcucaaccucuucuguuugugcaugaagacucugaggaccagaauggugaaaugauuuuucuaugaucauagagcuagauuuggaguaaagcccaaugaccagcuuauucuaauacuauuuaaaaugagcagucuggaugagagaaaaccaaugcauauagcuacuugccaucucugacaggcauaggcaugacauuugccaaaaccucuccuuuuugucuaaagauagauauuuuauauuguuaaguuuucaggaccuaauaaguggcaagaaaucacccauguaaaaauaauaaucaguauuuguaggcuuggagaaaaugcuagaauccaggcagcaaccuaguaagagggaaaaacccuguuucuuauuaacagggacacccuauccugggaugcaggucucagucuccuccucccuguggcugcccauaaaacgacuccagaucagaggcagagccuugauuuugaucuugguuuauaaacaguguucuucgaaguuuacuucuucugaucauugauuuguuuugcugaucuuuuuuuucuagaagcccugcaguucuaaagcaaaaaagagaaugaauaaucaugaauugaauuuuuuuuaagaacaacaaaaaaaaaaggcaaggcagacccugcucuuuuggaaagcccucucuuugauuuucuucucuagagccuaguagcuuauagccaaagagaggugcccaugcgcgugcgugcuugugugugugugugugugugugugugugugugucuacaugccugugcuccaggaccaggagaagacaggaaagggggcucuugagcacagaagaugccuaauuucuaucuucaccucaucaaguuuauaaauuuccccuuuuguuuuuuuuuuuuaauccuuucuccucuccucucuuccucccucauaccauuguaaacucuucucuguaauguccuaucccucuuccuccugagaaggcccugcuguagcuccuccucucacucacaagguaccucuccauagcacaagcugccagcccugggugcccagggcaguagaaagggcagugggagacaguguugccuggugguuaagccaacaaccaugggacaguguccuuggaguuucaucauggcucuaccucaauuccuucaucuggaaaauagaauuuaacucaaaggucagccacgagguuuacauaagaucaugaaugucaaguauuuagcagaauuucuuuacccacaguaaccauauuagcuauuaauguguuuggccauaagauacaccuacuaaaauguaccuacaccaaugagguuuucagucaaagcaauagugcgaguacaccagguuggcagagggaaguccucagugccugaguuuauacaccucacuguuuuuuguuuguuuguuuguuuguuuuuucccaguuagacucaucucgaucuuuccuaggggacaccuuaaagucuaguauggcccauggaggaaagagggacauuggaaagaaaauaaagagagggcaaucauauuuacugaauucucacugcaugccagaugcugugcugggaguuucacauuuguuaucucugcuaauccucaaaacaucccuguggguggguaccacuuuucccucuggacagauggagaaacugagguucacagaagugaagggaccugcccaaggucacccagccucucagugguauuuggacaaugaagcucuuucaggcuccagagacccaugugguuucugaaacuuuccaugggcagggcaaaaacccaggcagccacagagucuggggguggcuaccaggccacagaagaaagcuguaggaggagaugucuuagaugagagaaaaaugcagaaagaggaagaaaaaaaaacccuugcugaauuucuguggguuucagcauguaauaaucccuguggguuggagaggggaaaagaugaggaagugaguucccuagagccugaaaauuguuuccugaauucucuggguaggcaugguuagcugaagagggcaaaaaucgcagccaaaaaauacacagagaaaagccaaaggaaacuggguuuugaggggagguauuuugggaggcagaaacucccccugggcauggcuuuucucacagguagacccagcguccacuggguguuugcuuuggugaugagccugagguuguucucuuggcuuuggaccuccuuccaguucuaggaauggguuugcccaggucaguguuugugugaacguuauuuccaggauuccaggcugugcuuggcucugcugccuacuccugggacccagaaagaucacaucacaagaauguucauggaagccuugguuugguucucuguaaaauggcuauaaucacaucuuuuugggggcuucuacaggaggauuaagccuuauaaauugcaaagaacuguacaguugucaagucuuaguauuauuuaauaaaaggaacuagaaagcaaagauuuaagaaaauguuaaaaaucaaaaaugaacgggggucacauuccaaucugggaaaccauucucccacgauuccuuggaagucagcuaugguccuaucacuccccuugaauuagaccaaaugacuuuucuacaacccugggcccuguaccugaaaugaaacaauugguccuagcaagucacaacuuaaccacagaucaccacauucuccauccuaaaggcuuggcucagacacaaauucuaggcacugaguuuuccuaaauaaggaauucaggaagaaccauugaugaacaagacaguuaacuguuucugggcuucucuugugcuuucuucuugacagccaugggcuccccaaaggaagucauuuucucagacaucacugaaaauucggcuacugucagcuggagggcacccacagcccaaguggagagcuuccggauuaccuaugugcccauuacaggagguaggagacucggaaaggggagagagaggaggaguguuguggguuuggauggauucaugaaaaagacccugauaauuuucauccucuaacaucaugaucaaagaaaaugaauucuuuauuugugagaccaucuggagagaagagaacucauuuguaaagugcuaugagguucuuagaagaaacuuucuugugaagggucacuugaacaagaccuuuuuuaaccuugaaauuauaaaauucuaugagaaauagaucucuaguauuguuugcacacaauggcaaaagauucuaaauauauuggcauuucucucccugcgcacacucaucugaaaagcuagucuuggauauaugugaaguuuuaccuuuggguaccaaaucugucugucucagcaaaugauggcaagcugugccuuagaaaauuugugaguucuaacucaaagcgcaugggcuauaauagagaccacaaggaggaagcccagucaaaucugccuaaagacacucuggcagguaguaagcuaccuguugcugaaaguguauaaagagaggaugguuaauaaccucuucacaggaaugcuguuuugucucuauaggaagucugaccagcugaugugcaaguucuucacuagcccccaaauucuaagaaauacaauuucuguguuuauuaauaaacacugcagcacaaacuugacuauaaucaacuuucuuuucuuaaguagaauuuccucuaguaagggagucuauaauccuaagccaagacaaugggugcaauagaucugacauacauuacauaguaagcuucccauauuguuuguggggaaaaauaauaagauaaaauuugcacaacgugccagcucucuacugaacggaaacuugccauuuuuaguacguugugacuucauguuuucccccgccccuccuggcuuuguuuuuggcaucugcaccaauagaaaaagcauacaaaaaguaagccuucuucccuuaugccagaggguaggagcaaaugagaagucaagaaagugguguuugaugaagauauaguuucauuucuaaaucagauacacucuuuuugggggcaacagugaauaagugucagugagguucauuauuccucaucuugcuuuuacuguguuccagguacacccuccaugguaacuguggacggaaccaagacucagaccaggcuggugaaacucauaccuggcguggaguaccuugucagcaucaucgccaugaagggcuuugaggaaagugaaccugucucagggucauucaccacaggugaguuggugggguuguguguguguguguguguuacuauuuuucagaggucacuugugcauccuaugccauuucucaccuucagccuuguagcucaugacucagcagcuggaaaaaaagggggguuuuauuuaugagauccuaguggaaagugaacuggauuuagagugccagaggccucucuucuggcccaucccagccucuggugagcugggugaccuuaaccuuguugggccuccauuuccuggacuauugugaaagaaaaaguccaaguuugggagucauacuuaccugaauuuaaauccaaauucuaccaacuacaugagcuaucaguccauuuuacuaggguccacuuuccuucucuguaaaacagacacaauucugcuucccucacaggguaugguaaggaucacaugaagcuguguuuguaaagcauccugaaauacaauuguucauguuagcccaccaucaccuucaccuccccgccuauugccuggaacccuugugagugucccucaaagcagguguuucacaugagcaugugauggugacagcuacaaaacagcuccucucuauuugguggcucuugcauuccaggcacuguuacuaaacccuucacauuuaauccccacagcuauuaucauccccauuuuacagaggagacaacugagacaaaugaaauaccuuggccaagcccacauaauuaguaaaugcuggaaccaaauuugaacauaggucggucugacuccaaacucucuauccuucuaaaauaaagaguuccuuuccuaguguaaccugauuuguacaguacacuguaaagaggggaaaauaaugaauugcauugaaggagaaugaaguggaaaauuucucuucagacagccaugucucaaaacaauuuauccuuugauaugugagcaauuauccaguccaacucauuaagggauacaaagaauagaccucauaggaaauuuuaaaaauauccucauagccugaaagaguugacaacacacaauuaaaauaucccaucugaacccagagucccguccacccugccucacaggcccuuauuuccccaaagaaaucuuucaucaguggauucuccacggcaacagauggcaaaagcugaacguaguuccucccaaugccccauugucaucaccaguuaaaggagauucuguccaugcacagugaagcaggaaggaacucagaguggacaaugugggcuccccaguugcccugccacauccuggcucucagaccagucauuucaucccucaaggcucaggugccucucugugaaaugagcugaggauagcuucccuccacccucgccagggcugcuggcaugggcacaauugaguaguaagugcaaaagcaagaggaaauggucagauucaugcuggcuucugagaaagugauguuggguaguaggagaggucaguuaaaagaggccagggauaaauauccuuugaauauccauccuuucucagaacaagucauuugaaaaccauacuuaagacuucaaauaccuuuaauagagaucuuaauaacaacugcaaguauugagagcuuucccuaguacaucuuacacaucacacauugcuuagcuagucuuuauuaacuaaacagucacccuuuggcagcugaagaaagugaaguuuggagaagggaaaugaauuuucccagggcacagaggcaccaggcagagaagccaugguagaacccgggaccaccggccuccagagccuggcuuuauguucucugcaagccaucuaaggagaaauaccacucaaagcucagaaaaggcucggggccaggugcggugacucacgccuguaaucccagcacuuugggaggccaaggaagguggaucaccugaggucagguguucaagaccagccuagccaacauggugaaaaaacccaucucuacugaaaauacaaaaguuagcugggcuugguggugcacaccugcaaucccagcuacuugggaggcugaggcaggaucauugcuugaacccgggaggcagagguugcagugagccgagaucgugccacugcacuccagcaugggcgacagagugacagucugucucaaaaaaaagaaaagaaaaaagcaaagaaaagaaaagagaaaagaaaagaaaaggcucgggcagucuuaacuaugcaaguccccucuguguaaguucuuucucuggggaaaguaauauaaacaauaauaauucuugucauguguucagccuuguucaguuuacacagcuccuuuccacccauaauauaauggaaaaaucaaaauaacacugaagaugaaaccagccagaauuacuaucccuauuuuacacaugaggauauagaggcccaaaguaacugagccagcaagggagggagucauuacucaaagccaggucaggcuggcuccaggcuuaggucucugaaccauuccaugcagcugacacuguccuaacaucaggacuccauaagcaguguggacagcagagcagcuagagucugaugucccacccaaugacuucccuccuguccaccaucuuucuuugcagcucuggauggcccaucuggccuggugacagccaacaucacugacucagaagccuuggccagguggcagccagccauugccacuguggacaguuaugucaucuccuacacaggcgagaaagguaagguuuuguccaagucucuccucacucuaaggagugucuuuccugcuguaaacucuucccauucgcucuucucccugccacauuugguacaggaugauaaaaaugcauggguagguugaaaaggccaguaauguucauguggcucccaacugaaaccucaagggagucugguaggucauuuaaaauaaaaauaaaaauacaucuccagccucuacauguuuuccuggcccauuccuccucuccuguuaguaucucugccuaccagugugagacaccccguuuaggaaacaguugucaucuuuuacaaagaagaaaaccagaaucuaaaaucuuaaccagaccgcuucaggccauacugagcagucucaacuuuucagagaccacaaaagaagcuaguuuuagcagauuuaauuaaaaagucugaaauuuuaagccagguacaguggcuuacaucuguaauccagcacuuugggaggccagggcagguggaucacuugagaccaggaguuugagaccagccuggccaacauggugaaaccucgucucuucuaaaaauacaaaaauuagcugggcauaguggugcaugccuguagucccagcuacucggcaggcugaggcaggagagcugcuugaaccugggaggcggaggcugcagugagccgagaucgcaccacugcacuccagccugggugagagagggaggcucugucucaaaaaaauaaaaauaaaaaauaaauaaauaaauaaaacagaaauguuuucuuguuuggcaaccaucagugcuaauguacccaguugacagauuaaacacuuguuuagagcaccagcaaacuacagcugccagaaaguaaaaucaaauauaaguaagagacuggagaaagagagagugcuuuucaaugaaccccuccauuuuguaaugagcuacucuagaaauaauuguguaauuucaauuuccagguauagguaaguuucauauuuuaugguuugguauuguuuugcucucagugacaauaugagcaggcaccagcgucugugccuggagccucugaaaauuuucauucaguuaugguaaccaacuaagagaggucuuuuugaggacagagcacagguagggguggggaacugauggggaggagggauguuggguuuauucuuuuuacucuuuaauucuuaaauagucccugugagcaaacucuucugagucaggaaagaugguguugcaccuaaaaugaaucagguauaguucaugggaaccauggagauuguagauucagggcaaacaaggggcuugguucagaagaggggguggugcucacaaaugaugagguaaguugaccaacuuguccccgcuugccugguacugucucaguuuuagcaccagaaguuccacaccuaggaaaucccgcagucccuggcaaaccaggaugguuggucaccugugaauaggaaauaaacacaugcccccaagcaaugugaucaguauugcuuuccaccacuggacaugacccagcaggccugagagauaguggccaggcucuggugcagcuacugcuguccaguuuuugugaccccucagccuaaugacuugaugacacuuaguaaauuauaaaagggcaugugaaaaagugacaaagagaggagagcaugcaucaggacaaauuaagcaugggcagcaggcuuggggauguccccuccgaccguccucuaccucggucucaguggcaaagcgauuccagccaguaccaugugggaaaaaaaucuccugacccccaguuccccuuccuucugauuuggggccuggaaaaauuaagucuccauaugagaaauccuuuacguaugaggugagugcucaagagagagaaagagagcgugagucauuucagaaaucagaccugcuuuuccgcagggucacugaaaguuucgauguucgaaggagguguguaugugguuugccaagcccacucauggcucagacagugagaggugacugccuugguauguguauuucauguuuagugccagaaauuacacgcacgguguccgggaacacaguggaguaugcucugaccgaccucgagccugccacggaauacacacugagaaucuuugcagagaaagggccccagaagagcucaaccaucacugccaaguucacaacagguacaaagacacugagagcuggaagcucucccuucuggggugcccacccacagccugcaucuuaaacaggaaccgcuagccaguucuucuuucuuaagucagggccuugcaaugugauuacaucagcaucacuuaaauucaccagugcccacucagucaaggccugaagaaacacacuauuuccuuuugaacugaaaugaccuuggucuccccacggggaaggaaaagauuuuaagaggagggcuuuguaaguggaaaaacaguucccacuggcccuaaaccuaguauuuaaugauccacguuccaggcaggaaaauauuuuugaagaggcauauuuuuuaggcaauuuuuccuagauguuuguuagguuucuauacauugagagcuuuuuacaaacuauagcaagcagggaaacagaggaaccauccucucugucagggugaguauugauauuagcauucauccauccucuuacuuagaaacaaggggcuugauaaugauguucacagcuguauacuucucucuaaauccaaccaaggccaguuagaaacauccagcccuuaggaugagauaaaccauagagaauuugucuuuggagaucaucuggcucaaccaccuuauuuauacagaggaaguucuugccaaaggucacguaguucagugguagggaaaggacuugaacccagucuucuugauacccagcccgaauuucugcccuacauuugcugaucuuauccgauauuaaucauccugucuucuccagaccucgauucuccaagagacuugacugcuacugagguucagucggaaacugcccuccuuaccuggcgacccccccgggcaucagucaccgguuaccugcuggucuaugaaucaguggauggcacagucaagguauuuuaaguauauaacaacuccucaaugcuaguugaagcauuugcaugaucuucaaaguauggaagaauuaccugaugcuguuuuucuaccccagugcaucuggggagcugaaaaaaaaaauuaguagagacuggauggcaugccagaccuucugaaucauacucuccagccucuuucauuuuaaccagacuccaguucugauaggcagccaagaucaagaaccacugcuuacaagacuugaggacauuuuaggagcuggaaucuugauccuuuaauauuuuguugaacaaaggccaaaagguuucucugcauguuugccauauguauuaucucacagaugguaucuuuauauuauauauuguaauauguuucaccguguucuuaugauaucaacuguuaauaccauuuuuauccaguguuuauauuauuuauauucgcuacccaagaauuuucuuucuuuuaccuuuuaauuugaaauaacuuuagaucuucaaacaagcgaaggagauuuccuaaacuuuaccuuccaaacuuguuauugaauuuuucauuuugguuaucucacuuuauauuuccaagaucuuuugcuuguucuccacacauugaucuuuuucuggcauuuuguuugugcuuccuauaucaucaucucuuuaucucuaagaauauguugcugguauuuuauucuauauccugcacaguguuuguuacaaguuucuuuguuuugcugcuguuguugaguuugguuugguuuggguuucugucuuucauguuggagacauccacccaaugucuguugaucauggucugucuuuuuguauuugaacuaggaaugaaagagcuaauagggaguuagcucaggcagggcuugucaacuuuguggcucccugcagaaugauugggcaaguacccacaguuuucuugggggacccccaaauaacagugccauaaaaccuggccucucacuguguacaaacuuucaucuuauuauguuuccaguguagcaccucggccuccuugaaggcugagccugguggauuugaauccggacuuccucucuggcucaaccuuuccagagaguaaaccucagccuaccaucugaaugggaaagggcagucauuuagacuguuggagggaaugaggagaucuuagagucuguuucuuacaaaaaagcuucuaaacaaaccaaaccuuuguucaaccacacuccacauuggccuuuaaagacaucucugcuuuuguacacauuccuuuacugaacuugcuggacucugugacuugcaccaagcagccucugacuagcucugcccaugcuccuuaguuaaccucagccuucuucauucauuccccuccauggucucucuaccacucacuuucuaucuaccaaguuucuggcacaccuguugcugucuccucucccauuccccucaucuucauggauuuauaccuuacauucucuugcucucuuuuuaguggguuuuagaagcaaguagagaugaguggcuguauccaaucugucauauuuaaccagaacuggacacauugcuaauaacuaucaugccccuuccuggaauugauauaacaaugaacuaucucacugugugagcugaagcaaauccuuuaucuucucugggugucaguguucccaucuguaaaaugaaugccuuggacuuauccaucuuuaaggucuucuccuugucaggcauucuaggauucuguguuuaccugaaucaugagucucauuuugaucuagaguacccuaauugccuagaaaauggcuuugcacagaagccuagagaacugacagguaauuguauuccuaaguaauucaaugaacccagcuuuaucccugacaguugaucuuucccccagggacuagaacuggggggcugcaaaaaggccucuggguauuaaaugagcacucaucccaguuuacuuuucugcauguccauucaccagcuuuacaugucuuagaaaaaaaaucaaccugguauaggagaaaagaguccuggacaggguguugggaaacccgcaugcaagaucauccucugccuccaacaauuuauggaaugagagcaagucuuuuagcuucucugaaacucaauucucccauugaagaaaacaggauaagguaccuucccaguucccaggaugcaggagaaccuuccaggggcuucugcacugaugcaugacugcccaaacuaagcuggcuguuugcagguuguagagaagaucguugugcuugguuuacuaggaguguagguugaauuccaaucccagacacuaaggucauuugcugaaaagaauuggaagcuagcaagaggguguggaaagaggauuuccugcaaacugaaaccaaugaccuccucuguacagcagcacagagaccagccacagacuacaaguguaguuagaguuggucaacaucugucugucauggauaucucuguucuagaagagagacaugugaggucagcuuaaguuuuaauccuaccaugccuauggggcuauuauaaucaucuccuaacucaagagauccccaaacugacugcacauucaaaucacuugggaaguuucuuaaauauagccaggcccaacuucuggcucugaugauuccaucagucugagaugaggcccaggcaucauauuguuuuaaagcuucugagagugauaaagagcuauauuuagggaccacugaccuaacugaccucaaagucccuuacccugugugauucaucuugcuaccagauuaagcuucuuaaagcacagcuugguuuaugucauuggcauguccaaacaucuuucaaggcuccccauuucuugugaugauaaacuucaaguuccaaagcuuagcauuuauaccuuacagggcuccucacuccguuuaaugauaaacuuuaaguuucaaagcuugucauuuaaaggcccuucauaaucuaguaacauuuuccacuguucuaacaccugaagcuaaguaugguugaggucgcuuauugccuccuuauauuauuucauuuuauguuuuaaaucugcuuuauucaaaguuuacugauuuaaauauuaaucucauccaaaaaaaaacccccuucacagaaacauagaauaauauuugaccaaauaucugggccccauggcucagccaauuuaacacauaaaauuaaccauuacaaucccauucucccaauauaguuuggcagggccuugggcaggugguagccuuagcccuggagucuacagcagugcucucauccuuaccagaugcggucucucccuccuuauauuauuuuaacuugcucugcaccuucuggcccaaggaccuuugcuugugcuguacucuccccaucucugauaucucagcagugcacauggagccugguagagaguggguacucaaugaauucuuguccaguaaguaagugaauggauggguaaaugaacuuauaaauagaaugacuucuuaucuauacccugagaauuucugugaccaaaagccauuauacuuuuucuucugcucuuaggaagucauuguggguccagauaccaccuccuacagccuggcagaccugagcccauccacccacuacacagccaagauccaggcacucaaugggccccugaggagcaauaugauccagaccaucuucaccacaaguaaggaggcccagggugccauccagccuugagaucuaacuuugacugaaucaacccuugacuuccccuuugacuucuacuuuaaaauuuucaaacaaaccucugaaaagaaucgauucacugcuacuacuuggaagccugaggaaagcaaaugugggagauuaugagcaucccggugaaaggaaaggaggaagcccaucuggauucaguccccauuucuaucaccugcuaggugugccuuaagaaugcuacuuccauccuauaaucuuuagcuucuucgucuauacagggagauuaauaauaaauccucugucaccaggaccuugcaaguguucaugagguauugcauuugaacuccuagcccaguauguggcccauauaauugugugguccuuuuauugucagaguucaacaugagcugaaagucucuuucuuucuccuucaucaugccaguguuuacaaaaccuguccacauucaaaaucacaaaugaucuucccaccaagcugguauggugagcccuaugcccaaaguucuaguggggaagcagacacuuucagagacuaaaugaccuguucaagacuaucuugugaguuacagucagaguugggcucagauauuccaugcccagggagccucccccugcaccugucacaaaguaucuucugcagauagcaaaccugcaaguuguuccauugauaaguaagaguggcauccauuccugaggaccagaggagcuggccuuuggagagcccugccuuugaaaauucacgggacagucauucugcacacaucugcugaagaaagugcuuccccuuugccagaucuuaugccagaugcuaacuaugaauguauccuaaagaugcucuuauacuagggcugugaaauaaauaagaaaacagcucaugauacaaccucagaugaauguccucagaucagaaaaaagaacugcuaugaucaucagcucuaagacccaucuacuaggcauaguuccaagauugcccauuucuaugaguuuuuaauuguuugcaucacauuauugcaccuggaaauuccccaggcauucuaguccauagaguuaagcuaagaauuaagcuccagcucaguccuccugcacugagagcaucaccauuucuccuuauuccacaguuggacuccuguaccccuuccccaaggacugcucccaagcaaugcugaauggagacacgaccucuggccucuacaccauuuaucugaauggugauaaggcugaggcgcuggaagucuucugugacaugaccucugauggggguggauggauugugaguaccaccagggacugcagagcccucaggccuaggggaagagggagagggcaaagcaggggaggagaagagggugaucuccuccugaugcacucugacacccccaugugugaggccuugcaagauagugccugucacacagaggcacucaggaauucucucuuaaacaaaagaaugggaaacacgcuggcuacuuuuugaaacggggagauaaguuucuuguaguuuaucucauccaauccucaucaaacaacucugugauguauaaaugacaguugaucauugaacccauugcuuacauuaauuagcacugacuaagcauuuauuaucuaccaggcacugugcuaagaguuuaagaugaauuauuccgaccccauuaccauaggagcuggguaguguauuuuugaauuaauaaacucuauuuuuuuagaacaguuuuagguucauggcacaauuaagugaacagaaguuuucauauacaccccacacccacccacacaaccuccccauuaucaauauccugcaccagaauggugcauuuguuacaaucaaugaaccuacauugacacaucauuaucacccaaaacugggugguauuuuuaaucccuguuuuucaggugagaacaccaagacuuaaggaggggcaggugaccacccaaaguuacauagcaaauuagggauggacagaauggagccugaugcucucuccacagugccacacuccuuccucucacaacgaugcccucuuuccugcaauagcuuaaguacacccagauucaucgauauguuuauagguguuccugagacgcaaaaacggacgcgagaacuucuaccaaaacuggaaggcauaugcugcuggauuuggggaccgcagagaagaauucuggcuugguaaugcagcccugcauguuuauaucuaaaaugccugauucugcccuccuugucacuuuuccuaacccacagggaccuaugggagagaaagagaugaggaagaagaacuacuucugguggcagacacagaaugucaaauucuuaaugaaaaagacuaucauuuaaaugcucugaaucaucaaaauguaaaccaaaaaguaucugagacagaucucaaucaauuuagagguuuacuuagccaacguuaaggacacgcccagaaaaaaagaacacaaagccacaggaacagccugugguccaugccuuuuuuuuuuuuuuuuuuuuccagagauaauauuaagaguuuuaguguuuaaagggggaaagccacaggaacaaccugugguccaugacuuucuuuuuuuuuuuuuuuuuuuuuuuuuuuuuuuuuuuuuucagagauaauguugagagcuuuaguauuuaaaggggaaaagugggcuggagggauauggucacauuacugaauccacauguugcaagauaaaaaaaagaaaaaagcagaaugacaaaaaagagaauggucaauuuuguauucaucucacacucaguaaaucggcacuuuacauaagauaaagugaagauagaauaacuaucuguggagauaucuggccuuuuaucuguagcaucugcuuagggacaaaaggagaggcaguuucucccaugacucggcuuucaguuuauuuuuuuuccuauuggcagaguuaaauuggggucccaagauuuuauuuuccuuucacaaaaaguaaaaucugauuaaggaagaaccaaaacucagcccuuauguguuaaccuagccuuaagucauucucuggaccagucauagaauccuccucacugauaucauugauaucuucccuccugugccccagguugugcuccaggugcuaagauggguuucuuagagccauaauauuuaacccccauagcaccccuacaaaguacucaauugccaccgggugggcaaggugucaggugucagaagugguugacuaguggguugguaagacgaauuuacuaacaacaguauagguuugaaaaaggaacguuuauuagaaagaaagaaugcugcaaaaggacuuacagccccugcaguggauuuuuccuuagggguauuuauggaccuuaaggcaggagcuuaaggauaauuuggacccuauuagccauguagaacaugauacaugauuacauuuguagacauuuuggugccuuaaugucagcaaggguugcaaaaugaguuuugauaugcauguauuccagagauguauagaaguuccaguuaccuauaaauuuuugggaaauaaaccuggaaccagaugcuugcuugagauauacggaagccuaauuaccuuuaaaucccucaguuaagggguuuuugucuccgaguccuacuugauggucaccaggugauuuuugcucuccucaccaccucgcauggauaaaaucacagccucaaaaagacugagugguuugcccauaggagucuaaccaaugaacaguugagcugaaauuuggaaucuccuaagucaacacuacaauccuaucacccauccauucauccaugcaauccacacuuuccaaccaccuaacugcagagaacauuguucuaugcaccacugccuaccccagaaaauguuuaucauauuauaauaaacauuuaucuauauuauucauugcccuucauuuguaaggcacuuuacaaaauuuuauuuguuuguuuguuuguuuguuuagacagaguuucacucugucgccgaggcuggaaugcaguggugugaucucagcucacugcaaccucugccuccuggguucaagcaauucgccugccucagccccccagguagcugagauuacaggcacccuccaccaugcccuccuaauuuuuguauauucaguagagacaggguuucaccauguuggccaggcuggucucgaacuccugaccucagaugauccgcccaccuuggccucccaaaguguggggauuaugggcgugagccaccgugccuggccuguaaggcacuuuagaguuuaaaaaguacuuucaccaccuuaucuccuuggaucuucacuaaugcacugggagguuggaaguggggcaaaaaugucaacccgauuuuaccugagccuaguauuacuccagcaagcacaagacugagcuucaagcacaggccugugugauauggcccuuuuuuuuuuuuuuuugcuuucugagauggagucuugcucugucacccaggcuggaaugcaguggcacaaucucagcucucugcaacuucugccucucggguucaagcgauucuccugccucagccucccaaguagcugggacuacaggcacccaccaccacacccagcuaauuuuuguauuuuuaguagagacaggguuucgccauguuggccaggcugauaacgaacuccugaccucaagugauucccaccacccccacccccacccccucccaccccaucucugccucccaaagugcugagauuacaggcaugagccacugggcccaguuggcccugucuuaaguguacccaguugccgcuuuuacagagugaaauagaaaugagggccucagucaccugugcuucuuagcaacccuugccugucauccacagggcuggacaaccugaacaaaaucacagcccaggggcaguacgagcuccggguggaccugcgggaccauggggagacagccuuugcugucuaugacaaguucagcgugggagaugccaagacucgcuacaagcugaagguggagggguacagugggacagcagguacaguaguggcugcacguagagccuacaaagccauggagaccuucuugacauuuacaguuuauuucucuaacuuucauuccuuccucauuaauccagcaauuuauuaaaucaacaaauauuuaaguaccuacugagugccaauccagaaaaacuacaauucaaaaguguuggguagauauuuggguccugaaacauugaguauguugggaaucagggcaaucaggauugauuucuaaugaccaucuuucaaaaaaagugugucuuucuuacccaguuuuagauaucaguuguagacugauuaaaaaaaaaauuccccaaaggccuuaauauucauccaauccagcacuucucaauuuacucuggguguauggacccacuggcgaucuugugaaucuccagaugcugacacagguugucugggauggggcugagauucugcaucuucuccaaguucccuggugaugccaauauagcugguguugcuggucuguggaccacagcuugaguagcaaaccauccacuccaucaccuagcugcuugaaucucuuccaagacaucccugccauguggucaucuagucucagccugcauccucauaaauagaaggucucaccucucaaguggccccugcauuccuugucuggcucauaaccuucauuccagucuugaagauuucuuggacuugaagugguuuugugugguuuccuggcuccacauaagaggagaaauaaauaaggaaacaacauguauuaaggcccuacuagguaccauccucuuuuguagauauuccaccugcauucaucuuauuuauuccucauaaaaccauuuuaugaagacguuguuuuuauacagaggaggaaagaaguucagaagagcucagugauuuguccaagguaaaacagcuuguagaagguggaugcaauccuggcugcagaaaacugcauccgacaauguucucagugacaaagaagggucaggacugagaguguggaccacccccaugcaacccaugcccacuuuggguggcuuucuguuauguuugugagagcagaagagauagaagcuuggcacguuuccagccucccugagcccugaaagaaaacauccauaaggugaaaagucuccagauaaaagguugccaaagccaggcugagccuaaggaggcacaaagcucuuuugagauggcaguuuagugauaauaaagagagacacccaggggcaaacauugcuuuaguucuugaaucccucaaagaauguuggcauuuuauuaccuggaaaugaauaccucuuugguugagauggcuucaggcaagaagaagaauguuacagggcaagcaaauucauuaagcagcaggaauguggccucuguuccucucucuuugugcuuccauugaggaaugagccauaauauuucccuuuacugagauaacguuuguaaggcugcauuuucuugugugauuuggcugcacccaggccuucugcaggagagcauccuguuucauuaauaucuacgugccguccucaugcucuggguagcaucaucaguuaaaaagguaucuggguuccuuugacaacuugcuccaaauuaugacgguagaaugccucagagucuugaaauguuugugcacagcacuugucuggauugggagugaggagacccacaaagcaaugguacugaaaugcuucaaaaauucaauauauuaaauuacaaauuagauuuccaaauaguaguacauguuaaugggcuucuugucuaagaaucacggaacauggucugaugaauacuuuaaaaaguaacuaugugauacagagacuauuuagggacaucuaaugucugaagggcuuaauuaugacuaauaaauauuuguaugugggagaaaagcaugccauuauuaaaugcauacuucucaccuuacucucugaggucuuuauagaaagggaaugcagaaaagucauaaaaauaacaaucauaguaaguauuuguaugccaugccaccuguuuagcauacaccuuuauugucacaauggcacuacucaguauauagaaucaaagugcugguuccauuguauagaugagaaaacugagguucaacaagaugcuugacuugugcaaggucacagcuaaaaagugaaaagaugggauucgaagcuagacucuccaaagccagccacagcccucuucccaccacauuaugcugcuucugucggaaauaaguacuggggugacacucaugucccauucaguuccgcauucaaugcugacucugggaucaauguucaaggccagucccacacccagaaccuuucaauugucaccucugguucugcccuuuacuguccaggagggaaauuucagcugagauuucucagguccauauuuucugucucucccaggugacuccauggccuaccacaauggcagauccuucuccaccuuugacaaggacacagauucagccaucaccaacugugcucuguccuacaaaggggcuuucugguacaggaacugucaccgugucaaccugauggggagauauggggacaauaaccacagucaggugaguggaccgugagggcccagagcaggccaagcuugggaagcuggagggggcuaauggaaguacaauuuaacucccuauccuagcagagacuaggaggcaggaaccuuacuuguaugacaacauguuuuucccaaggcagugagcaaucucaaggacacugcaggccagguaaaauagaaacagcacagguuaacccuugacagucccaaggacaaacacuggucaaauggauuccaaaaacagaacgcuuuacucagacaaaaucucugucugaaccccaaaaguaaagcagauaaaaguggaggccauuuaggugaagcaggguugaugacacagaaccccuggccuggggcaucuuuggaaucccaagaacaccuuaaaaugaaguccacagacuuuaaaucuccuccuuuugugaagaaaccaaggcccagaaaaagcugacuuuccugaggucacagagugaaguuggcagcagagccagcucuccccacuuccagccccuggcauuuucccugcaccacacacaccucuagcacuucuacaaucacagaaacagauuuuuuucgaucccuuuuagaaauaggcgaacggaucaaauucaguaaucucccuuacucugagccuugccuacacuggcacauuccugaaaaguguaaagcugugugggacuagccacuuaaucauaaccaaaccccugcccaggucccuccacagaaguuagucaccaucccugggaggagggcuggaucuucccuuggggccacaccacgcugaucccuggaccacaaggaugcuuaugaggucugcucacuggaaucccaaggacuuuauaaaaaugcaaagggccaaauuccacuuuaugauaaccccagggauucugauucaaugaucucaggcaagacacagcaucucauuuuuuuuuuuuuuuugcauauuugcauuuuuguuguuguggggucaggggggaggcaguugauagacuccacaagcgauuccugacaugcagcagguguugggaccuguugcuuuucaauauuagucacuuugauacacauguuuaugcccuaauuaacugcuagcaaaugacaccugcgaccuuaaguguagaccuuaccuuacauaauuucuggcacuuuucaaagcacuguuaccuucuguaucucaaggguuuaucauuuuuacccugugcaggaauuaggaugugguuuuucaugccuguuuuacagaggaggcaagagucacaggacauuucuugacagcaguccuguguuguuuccaucuuauuguguuauuucaucaauauuuccauucugagcauuauuuuaucaucuuuauugccuugucucaaaaauacucguauaauacaaaguucuucugggaaaagaaaaaaaaaaccaacaagcuacauguuagaaagcaagccucucuuucauccuuccauucaauuauggaagaagaaagagaugacauggaaaggagccacaggaggggagccccagcuccagcucugcuccuccugcuguguggccucugcaaagucacucucccucucuggcuuuagugcccaccacaguacaagaaggcguggcuuccaacccugaacuaucagaggaaagaaccagggcaaaggcaggcagcaugugcaccaagcuguuggacuaccauacucacuguaacugaguaauuacaagcggauuugcccaugaaaugaaugagccauucuuaaaccucacaucccuguaagacucagaaacugcccaugucagugaaugccaaacaauuagaagcaaauaaagugucucuauuuuuuucccaucucacuagccauuaacuuccccacaguggggcaaggggccaugugggguuucauggauugacucuaccaucugcagacuucgcugaagagucaaaguugaaaccuggaagccaagacacagauacaguuuuuucuuguagaaagcuuuggccaaaauuucaaggauauuucccccuacuugagacuagggaaguaauauuuaccaagcaccuacgacgugcccagcucugugauagcuccuuuacaaacucauuuaaucuucaucucaucuuucaaggcuaacauuaucagaucuuaagaaagaaaaaaaaauaguaaaaccgaggcucagaagauauugagaacuuaagacuauuuaucucucaaguaagaacacugauauuuaacccuauaugucaaauuguaaaacuguguuuuguugagcuguucguucugcuauuccauaccaaaccccuaucaaaauacuccauaggaaucucgugaauuacagacacacacacacacaccauguauguagcuauucaauucuagaacuucuaauaaugaccugaacuccuucagaaccuauuccuaaggacggcagauuucaucagccaccauuuugccucaagaggaaagaccaaagcuccaugcaaacucaggcgacucuugacucaggugaaaaacugggucagauucagccaguuccuuugaaaguuuccacaacccagaccaacagagagauaggcaagaggcagcugugauauaccaaauggucaaauugaaacagaacucauuuaguuugaaugacuaaauagcaaugaucagugaacaccucgccuaacaguaaccaaccuggaggccuucucucucucucucucucucucuuuuuuuuuuuuaacagggcguuaacugguuccacuggaagggccacgaacacucaauccaguuugcugagaugaagcugagaccaagcaacuucagaaaucuugaaggcaggcgcaaacgggcauaaauuccagggaccacugggugagagaggaauaaggcccagagcgaggaaaggauuuuaccaaagcaucaauacaaccagcccaaccaucgguccacaccugggcauuuggugagagucaaagcugaccauggaucccuggggccaacggcaacagcaugggccucaccuccucugugauuucuuucuuugcaccaaagacaucagucuccaacauguuucuguuuuguuguuugauucagcaaaaaucucccagugacaacaucgcaauaguuuuuuacuucucuuagguggcucugggaaugggagagggguaggauguacagggguaguuuguuuuagaaccagccguauuuuacaugaagcuguauaauuaauugucauuauuuuuguuagcaaagauuaaaugugucauuggaagccaucccuuuuuuuacauuucauacaacagaaaccagaaaagcaauacuguuuccauuuuaaggauaugauuaauauuauuaauauaauaaugaugaugaugaugaugaaaacuaaggauuuuucaagagaucuuucuuuccaaaacauuucuggacaguaccugauuguauuuuuuuuuuaaauaaaagcacaaguacuuuugaguu

SEQ ID NO: 13993 - RNA, 177548 nt, Homo sapiens
ugaaaaucagacucuugucacuaucagagaagucuaacuuucuccuguggggaugaguaaaagagaagucuagaaagaaccaaugcuuucucuuuuuuuuuuuuuuuuuuuuuucugagaaggaguuucacucuuguuuuccaagcuggaaugcaauggcacaaucucagcucacugcaaccuccaccuccuggguucaagcgguucuucugccucagccucccaaguagcugguauuacaggcaggcaccaccaugccuggcugauuuuuuuuggauuuuaguagagacaggguuucaccauguugcccagucuggucucgaacuccugagcucaggcaaucugcccaucucagccucccaaagugcugggauuacaggcgugagccaccacacccagcuagaaccaauacuuucuuucuaaaacuucuuagaugaugcgggguccuauuuuauggacuauggucaaugcaaauggaagaaaaagagaguggauguuuuuucauacucuaauauacuaaaccagauugacuuugaauaugacuccaugauccuauaaacuguaaacacucagcucucagguuggucauaugagcaauagacagacaucgcaggggaggaauaucccaggcucacgcauggaguuuucuuugguaccagcucccucauggaucacaguccuuggaacacaaucacaauggccaauauccagaaaauauuuucauuucauggcccucaaagcccagccaaggccaggagccaaguaagagcagggaaggagacucagccucaguuucugauguauugcaaccaugccagcugucuuuggagcagacucuauucucagaugucuccacugggauccaugguuguuucaggaucuuggacgcugacuuccagcaucuuucucuguggguaucauauggaaggaagggagacugacucaugguagagcccauuuagacaaccagggaagaagcggcacaugauccgauuuuccugaccaggaagacugucagguacauccccuuuacauguaacaugcugaaacaugugccuguugccauggaaaccccauaaugcaaagugaguaaacgcagccugaauagauccaguccagaaugcuugcugaguccugcugcuuucagucucuuucaucacccgagucggaguacagcuggagccagaauuagugauggguaaagagcucaaaaggccccuggucuccuuccagugcaucucugauuuaaguaaagccuauuggguuuggaagacucaaguggccaagcugucccgugagagucccggcuccccuuucucucauccuaggccacaaaccagcaucucacucuauguugcggggagugauguggaagcuaaucaaagcagcuuuuaaaaggcuuucaugguuugcaaaaaaaaaaaaagaaaaaaaauaggggguguuuuggguggagaccagaacacaauuuugcuuccagccuguuuccccuuuuuucuuaaauacacacagauugagauagacucuacagcaacaaguuuggaacaagcgaaaaccuuuaaacaaagcuauuaaacauuauuuuccugcuccagugaaaagcagcagcuaugggccaaacacaaauccagaacacccaaaguucuguucugaagacuauacauuaauuagagaaaauaaaacauuuucucaccaugcguuccuuuccacagauguaucuaaucauguuauauguagacuguaauagcuagucagagcccaccuaaauagcugaacuauguuuuuagucucguagaauaagauaaauaaauauagcaguggcagaggccauuugacaggaaauaucuugggagauuucauggaccacauaggaugguccaauccauggggacggcuaauguggcagaucaacacaacucagagaaaagugaguuuagacaccuuuauguguuucaaaacuauaauagcuucuuacaccuccuuuuuuaaacguaauugcauuccucacacaacacuuacuacuguguuccauaugaacagcagcaagaacaaaacaucagugaggagauaauguuaucagaaugccacccaucauuuucuuccuucugagaugucuucuaaauucuaaaucuauacaacaaaugggagaaagaaaauauucuucauuuuuugcauuuagaaucugggagcaggggcaggccuugcugaguucuggaggucuguuuguuuaaggaggcuuuccaacucaaugagccaggaauaaaauggggaaacaugccuuuuuauauauccagcccuaagguugauuuuuaaugguuucauguauuuucucugaauaauauuuaugcuauuaaauaaacucaaagccaauguguagauguacaauuuuccauagcauacugccuugaacagcaccaugauugaaaaugagagaggaagcaggcacuucaucacuuucauuuccuagaugaaggcaccaagauucagagauggaauuacauuugugaaaaccaaccagcuauaucagccaccuaccacgggugcccgagcacaagacaacaaguuguuugucucuuuguuuaaccuauauaguuaaacauuagaaauguggaugaaauaauaaaauguccacuuaugauauuuaucaaauuaccacauauuaaaagucauaaaauuagaaauauuaauugcauuuucaauuaaugcaauauaauugcauuuucuuccaacucuuaguuuucaugaaucuauuuuauacaaacuucugauaucagauuccagccauuauaagucaucuaacagcuuugcagagcuccaguacuuuggaugcaucugauuuguuugaggucuaguucuuuguuaaucggcaagccacaaauaccaauuugccuaacaacugaacauugugugugcuuaauucauuuuguagacauauauauucuugaauucugcaacgcagucuaucaggaauaauuacaaaauuuaauaaauauuuuugccuccucccuuaacauuuggucagguggccucuuuuuuuuuuuuuuuuuuuuuuuuuugagacagagucuuacccuguugcccaggcuagagugcaauggcgcaaucucggcucacugcaaccuccgccucucagguucaaaugauucuuuacaggugcccaccaccacgcccggcuaauuuuuugugucuuuaguagagaugggguuucaccauguuggccaggcuggccucaaacuccugaccucaugauccacucgccucggcauccuaaagugcugggauuacaggccugagccacugcacccagccagguggccucuuuauauauccagaccuugcacugauuuuuaauggguucauauauuuuuucugaauaauauuuguggcauuaaaaauaaagcaauugagagauuaaguuuaaaucugcaggacuuauaaugccuugauuauaagauacuccccuguuugcugaaauagaaugcuuguaaacagaaagcucuccccuuacagucaaguauucccagcacuguggcagagcuggaaaggaaauggaauccuucaucuucuaguugagagugagcaccacugcucaacaccacuguuggauggcaaguuuugggagggcagggcagugucuuauucagcuuaucuaaguccuagcaccauuucugacacagaacagguucucaauaacuguuaaguaaaugaaugagauaauugaauacuuagccaaagcaucucauauuacuuuaacacacuuuguacccuugacugagaaaaggaagagagacucuuuaaauuccaaauguagccaaguugucccuuaaacugaagaggcacauuauuuuguuuccugugacaauccuaagugguuuuauuugggcagacucauauugcaacaucucagagcucaggcucaucaucucaacucacuaaauagcagaagcaaucagcccagagucaaucuaacacuuaguggucauacugaaugguccagggaggcugaugccaaaaauguggcuuuaggauucuugaucucacggaugggagaccccccaugagaacaaaugcuuguccuggugcauugucaauuacaacccugcuuuccaggcuucaaagccgccgagaauucaaucauguccccacacugaagcuggggcugacuaugugcgaaccugccacuguggcauacucuuggcuuuguucaacuauauaaugaccgaggguuggguggggagaguguuaacacauacaggaaguaauauaagaagggacguggggaaacaguuucugggaacaaaguuccugaccacugaaguuguuugaacuuaagaaucagaaacacuacuuugggaucauguuauugggaugcaacggggaggcacagaaggguagggagcaggcccuacucuggucaguugugaaauaggcuaacuacacaagcaguguuuucuccucucacuauaaggauguggcccaacuuccaagggugccccaccauugaggucuucacugccaggaacugaaaucucaugggacacaaaacccaccuacacauccucucaacuucuccuuucuguguugaguccguauuaguccguuucacgcuucugauaaagauauaaccgagacugugcaauuuacaaaagaaagaguuuuaauggacucacaguuccacguggcuggggaggccucacaaucauggaaggaggugaaaagcaagucucacauggcagcagacaagagaagggaaguuaugcagguaaacuccccuuuauaaaaccaucagauuucauaagacuuauucacuaacacaggaacagcaugggaaagaccggcccccaugaaucaauuacuucucaccagaucccucccauaacacaugggaauugugggaucuacaauucaagaagagauuuggguggggacacagucaaaccauaucagauucucucuccuuguccagggccuggaaacuagaagacaucaaacauauuccaguuucuguuuuccauaguauaauuagccaauuuauaccugguucaaagcauuuucacagacauuuuacuaagagaccuucaccaucaucuuuuaugguacauaggcuggggaaggauuagaauguucauuuuuaaaguggaaaaauuaauuucucaaugcucucucaaaauucccaggauaacauuaucuuguuaggacaaacuauuggacacuucacaguauggccugugccuuucucuguagcaucucucccuuugccuucaccauccaggcugcauuaaagcuaguaugagugacuuguaguucccagaaacuaucaucccauuucacgccaugccuugacucaugccuucucuucucccuggaaugucucucugccauccucuguuugauagauacaucaugacaacugcuaaguauauuucaagauucagaccagauauugucuccuggagggaaguggacacuuucccccaccucaacacccacacugguuaaaggcccucguguucaccuguaucauacaaaccaucuauuuucaguguuuaccuguucacauaucgacuuuuccccaacugauugugaauuuguggaaauccaguaauauuuuguugcaagugacaauaaacucaaaucaacuugauuuugauuuaaaaaaacacagaggaaaagauauauuggcucaauaacucaaugcagcacuuaaggcauaaaugcacucagggccucaaacaauaucgccaguguucacgcucucauagcauccaagcucuacuuucuucuugguguguuuuacucucaagaagcuaccucucuuggcuaccugugguggcucaugccuguaaucccagcauuuugggaggccaaggcaggcagaucaccuaaggucgggaacucaagaccagccuggccaacauggcaaaaccccaucucuacuaaaaauacaaaaauuagcugggcauggcggcacgugccuguaaucccagcuacuuggaagacugaggcaggagaaucacuuuaacccaggaggcagagauugcagugagccaagacugugucacugcacuacugcagccuuggugacagaaugagacuccaucucaaaaaaaaaaaaaaaaaaaaaaaagcagcagcagcagcuuucucucuacacagcagcuucuggaauagaauaaaauaagcaagugugaaaugggcacaaauaaguuugucaagguugccaagggcuagaucaagccgagccuauggucccguuaaggcuucaggauuuuguaaaugcaucaaaaugccuugagagguuaagcacacaaaaaaauggguguaugcaaaaacaccugcucuuguguucauugcauaugaugaaugagagaagcaagaguggaaggagagucagcagcugugaggcagauauaauaaccuaaggcucaggauugguggccugaacuaaggugguggccauaaagauggagaaaaagggacagagucaaggugcauuuuggcaaugaaaauuggauaauuuuaucauggauuggaugggaaacaugguuguggaaaggaugauuuuguauuuaggacuugaccagcugcuaacaccaacuucugaaaaaaaauaaauaaaacaucuuggugggaaggggauagaaaagagaggaggggcgaguuuggaggguggagucgacaguacuauuuggcuuauuaauaaaucggugcaaaacuacuaauuguucaggagacauccaacuggacuucagcuugauuugugcacagacuugccaucccaaacugccccagaucugaaauaaggugucuaguagcuaaccacggaaaaaagagaugugggaaaccuuugaggcauacaaacacuguagcugacaagcaggucaccuuuuaagucuugaauugaagauuugguuggagauuugcacuuaaagauaacuagaucugaguuccaauggcaacuccgcugcucucuagcugugcaaucuuggcuaauuuaccuccccucucugaaacucagcuuccucaacuauaaagggggaucauucuauaccccucacuuucaggacuuuugugaagaucuguguauugaaauguguuauaaaccguagaguaauaaauaccuauaaauugaaauucugaucaguuuaauauauacacagacaucaaaacuaaaggauuuuucaaauaaaaaugagccacgugagggauauuggguacaucauuucuucaggcucuagacuuuugaaauaaucccaagaacaaucucagcucucuggugucaaugaaacacuuggcuuacuuuguuuuuuaaacucccccaucaccccuugcucacagcuuguccccuguggcugaugcuaaagugcacuucucucccuuuauguccuaguuucucaggguaaaucuauuccauuuggcugaagaaauaggccagaugauaucugacaugacuuuccucuccuccucccagccaccagggagcuaagagaugaguuaaaguauuuugccaauaaacggcugaggacuaaacagccaccugugaauugaacauugcagcuuuucuuuuuuuuuuuuuuuuaauagcaaagccugggaaugcccaggaaggggaugagaucaucugucucgucugugagcaacauguucugcaggucuucuccuuccacauuacaucauucuggaaacagaaagugucuggacauuccuuaugcaaucugcaggggugugaagugagagagacacuggcuugcuggagaguggugauucccuaauucugcucacagauggauaugcacacucguuaauucugccaacaguuauagaaugccuacuauaugcuguaauuuuuggugccaaaacaaucuugcauguuuauuuacuuauucauucauuuagcaaaugcuugaguguuuccuauguagcagguacuauuauagguguuggggacacagaagugaacaaagcagauaaaguccccaccuugugagacugucacuugauuguaggagaugaacaauuaauaaggcagcauguaaauauaugauacaauaucagauagaugcuccaauguaaaaaucaaccagaaugaggagguagacgguaauaggaugacaauuuuggauaagauaauuaaggaaguucccugugagaagaugacauuuggaaaaaggccagaauaaauuugaggaguuaaccuaaaaacaucucggcaaggaagggaucucuagauagagagccaguaugugcaaagguccugagacuagaaaguaugcuaguagagaggcuuucuagaagcaucccuaacacuaaugccuauuccaacagugauucuuccuaucauacagguaagaaaacugugccuccaagaaauuguuaauuuaccuucucuguaaacaaguccugauagauuccauagauucagccuucauucuacucuguguuuauuuaauucucacauguguuuucuguuugguguucucguuauagaaggaaaauuaacccaagaguuaugugauugagguuaauagcaaagaaaaggaagaugaaagaauucucacuuccucucugguuugcaugagaacauuacaugugcucccuuugaauaaaaaaaaucuaggguagucuaucuguguccuucgucauguuuaaugccccagccgguugagaguuguuagauuguggugccaauaaugucauaaaaccaccauucucucuguggaccaaauugacaggcuggguucuaauaugugcauugacauuccacacagaguuuucuccaaacagacuugucucagccuuuugucucggcccucugugaucaugaauagaucuuauuauucaaacaguccuucaaagccacuuucaaaaugugcuuuuacagaccgacauuggggaaguguucaaacucauccauuucacggauggucaggacccaauuucaugaagguuaauguauuggggcuccaacagauucuuuugaaaaaaguagaaaauggcaacagaaagcaaaggagaauuaaaaaugaaggaauggggaaaguauuaacauuaauuaugugccugguacauuuaguccucaucauaaacuuauaaaguaaauaucuuuaucccuguuuagacauaagcaccacaaaauguauggagauucagaaaccagcaaaagaucaaguaacugaguggcucagcugggauucaaacccaaguguagcuucuuuacacuaaucuaucugccagcugcuauaguuuccucucugaaaaauaaaaaaaagagauacucagcaaguuccugauuucuggagccuagagcucuauuaauuuuuucagucauuaaaaguccaaaagacuaaaauuuuuaaucaguacucccaaguaucuugcuauuucuaauuuaaucacagaauacuaucccuuuaaagaaauucuuccaaaaagcucugguuccaagcuccugccuccccuuugagguuacuuaaugaggaucauauaauagauauaaauagcauuggguaaucuucaaggcuccuugcugagugaccacugaugcagucugagguuuggaugacacuaucacaagaauuauuggaaccaacugguacugugcucccuaucauagugguuucuuuacagaggaaauagaacuauuccuacuaaaaggaguucaccaguuacuuugauuaaucccauaacuugcuauguugucauuuguuuacaugucugacuuccuauuuggagugccggcucuuucagaacagggaacauaacuuaaucaccucuauguccccacagcaugccacaauguuggcacccaagugcauuuuagugaauagauaucaguuaucuggugcugcagaacaaaccagcccaaaaccuaguggcugaagccacaaccauuuauuuagcucacaauucggugggucagcaacuuaaagcaggcuuagcuagguggcucuuucgguuucugcuggguucccucaugaacaugagguuagcuguguucaaucaggcagcucugcuucuguguguggcugugugcaugugucucucuucaccuccuguauucuggccugauuuuguucccauagcaugauggaugcaagagcaggggagagaaacagaagcauguaaagccucucauaaucuacaaucaaaaguggcacauugucacuucugccaccuucuuuuggacaaaacaagauacaaggagagcccagauuaaaaucauggugaaauagacuaccucuugauaaaaucugcaaugucacauugcaauggguaugggaagaguaaaauaaauaaauaaauaaauaaauaaauaaaaccagagcuacuuuuuucagucaaucuaccagaaaacauuuuugaaugaaugaacgaacuguguggcauaaugaauuacaauguaugauauauuuucucacuaagauuaaugccuucagaaacagcuaacuuucuaaccuggaagaaagagauaaagguuaccagccaucuuagagcaugagauggcucguauucuauacccagcaaaggccagaauaugggacuucaaagguugguguucuaaauuagaacacugaacuucaugguuuuguuuuaguucgguguuucucuuccaggagagagagucuccugaccucccaacuuagcuguccucacugauuuaucucuccuuuacucugagaggcaguguaugguguucugguaaaagaacacaaguuuugaaaucagacagacugguuuucaaauucugcugcaugaugagaacaucaaggagccuugugcaauauaacucagaguccuggaaauguuugucuauaaaauggggauuaauaauaacaacucugcaugucaguuguuauuauuaaaugagaugcuacauauauaauacuuagcacagugccugacauaacauaggugacaaauaucugucaccuucacacugcuuuucacauagccucuguauugcuggaggauaucuuucuauaaaucugcacuaugaagaugcuucuuaaacguugguauagauagcuguucuugggaauccucaaaacuaaugccaaacaucaggcaucauuuauacuugaaaaguugggaaaguuaagaaaugugacuacacagcaauuuaagugaauauuuuauauugaagucaaucuaaaugugaauuuauagcugucaguuaucaauuaauaugugucaaauaaauuuucauugugaaggaguucacuuuaugcuguaguguagcuacaucuucauaguugcagaaacauuagaucaaaaaaauugagaaucaaacauagaguaacaucuaucuagagcccagugugucacuuagaauuucuucagauguugauuucucuauuucuaugccugcaauuaaagaaaauauuucucuuuuuuaacuuccauuccuggcccuucauuucuaaaaagaacacuggcugacaucaaguucaccuuuguucuaaucaauauuccauuuccaucugaaccuccuccacaucccuacccccauccaauacacacuuuuuccucucuuccaacaucccagaagauuccagcaugauuuauuuagccuucagauaagccuugacagaaggagaaucugccacaauccaugaugacucucucugccaagcagaccucuagcuuucugacagagcuguguauuuauugcaggucaccuuuguauguuauuaacauucaguccaaacucccagacaucggugcaaaucuaucucaauaacagugaucaccacugacacggcaugcaucaaauccuguccuuucaacauagugagaucaccagugaauaaaagaauuggaaugagugauagaguuucaaguucacucacauagguaccugcccagagcaaagaggaacuuugcagucagauaguuaggcagcauggugcugugauaacaagcucugagucagacccaaggccauacugauucacacucuagcucuuucacugauuaucuuguguggccuugaauaaucauuuuauuucucugugccucaguuuccucacuugugcaaggcagaugauaaugcuaucuaccuuacaggguuguuguggggauuaaaugaguuaaccauguaaaauauauuucaaaagugcuggcauguacaaaguuuuccuuuuuguuaguauuugcaguucccauuaauucagugcucugugaucauggaaauguuaacaaaccuuuugcaucucaguuuacaaauuuauaaaaggagauaauaauacuugccucaagaaguuauuguauucaagguauauaaaaugcacaguauaacacuuagaggauaagagcuguuauucauaguagcaauaauugucaucaccaugaagucaauaaucaggauaacaauugccugaggcaaaugaggaauuguuaaaauaucaaaucguauuugaaaauuaacucuuaggaaucuguuauauagagagacaaacuugagaagugagggcuuuggaguuauaccgacuggauuugaauuacuagaucuaucaucuagcagcaggaagacaaugaaacaauaacuuuuguuuguuugcuuguuucucuuuccucauuggaaagacuggaaaaauaccaccuacuuuguaagccuguuguaaguuuaagugggaugcuauguaauguacuuggccauaguuagaguuuaauaaauaguagcuauucuaaagcaaaggucuaaggcagaaaaaugacccauaauuuuuauuaauaugaagugaauugaacaaaacaaucagauuuauccuuguaagcuuggcucccacuaacuuaaugaagauggaagagaaaagaggaauaaggguuacagggacuaaguacucagaguguguaaggaguuuugcugagguuagcuauaaggaauuugugguuugaaucaaaggacuucaguuuuaugagguuugagggccuuuuucaaaaggaaaaccagauguaucauuggaaagcucaugcaaagagggcuaucuucugcaaaugcugcuuugagucuaauucuguuagacuggguagggauucaguagggagagacccugggguguuuuuuaaaacccauuuguuccuaucuuguggaccuucagugauguucucaaaugggucacgaggcugguauuuuauaagcaauaugauccacagccaugaggagaggaaugauucuaauauaguccagaaaacaguagggcuuuccaccucaaaacuuuacuuuaaaucuuugaaaagaacuagguuuucuaccccaggaguccagcaucuccugacccaggguucuccuagcacagucaacaggaaugaaugccuucccuaagccccucguggucacuugauccucuggcucuugguuuacuuuucccucuuccuuaaacuguucauuuucaaguaacauggggaaagucacaucagucuuauugaguaucccuaaaaaguggaggcaggagaauggacuugacgauagaagaauuuauucuuggucacuaagugugcucagcuggcuaugucuaccuccauaccuccauaccuccucuggaaguaaagaaguacccuggaaguaaagaagacucaugagguaauaaaaaacaguaaguaaaauugcuuugccaccuagacugcaaagacgaugaauucccuaguguguuuaucaaaauuaacugacaggucuuaugaaaagacugacuuauuuaauauauaaggaaaaaacaucacaagauucaacaauauaaaugcauauaauaggcuggguuccuguuauaagauauggcaccuugcauuuuccauacacuaauuaucuaacuaaguuauuauaaguuagacauuaucuuuauuucacauaugaggaaauaaaaguccagggacucaagugauacacucaagucuagguuugaaucucucagucuguguuuuugucauuuccccgacauuugcauauaugugguuugcuuagcacugaugguuugagaaauaauuuuagcuggugcauggaaaaauacauuuccauuuuaaugaguauguaugaauaguaugugcauccaaauauccaggcauaucagaguugugguuuugugaaacuaauuguuuaggaugaagcuacuuuuacuggagucuauuuaaagaaaaauauucagaaauugaaacauuaaaaagacagguuuggaaaaaguuguuaagaaugagugaaaugugggaaacucuguucugggccagacugcucucuguguuuuauaacgaauggcugcaggcuacaggaagcaagauuucucagaaagccuuagucaaugugucggucaccuccccugguauuugccagcuccugcugacaccaccauccccuagcugaaagucccugcagcuagaaaucuagaaagaagcccuucuccuaaucucauuagccaagucuuggugauuuuaguucuucagcagccauuccuccccaguguccugauugccccuaaugcuuacauucacauuccccacaacauucucacaacagcauucucacauucucacaacagcaucuuaacuggccuuccuaacucuaaucucacaagcuauccuggaaaauccccagacagccauguuacuuucugugguaggcugaaauguccuccaucaaagcccaaauucuaauccccagaacuugcaaauuuguuacuuuacauggcaaaagggacuuugccaauguaauuaaauuaaggaucuugagauggggagauaguccuggacuaucugggacaaaaguucuugugagagagacacaguagagucaggcagacacgaagauguggcaacggaagcagaauucggaauaugcuuggccaccagccagggaauauggagaaccucuagaagcugagaaagguacggcuuccccaaaaccagaggaaugcaaucugccuaccauguuacacaucugaucuccagaacugugagucuguguuguuucagaccacuaaguuucauguugugcggcagcaauagaaaaugaaugcacucuccuguccaaagccccucuuuuuucuugcccaaaauccagcuucuuaaucauuaagucacucuucacaauggagccucccaacuuuccagccuuauuucuugaccuccaaccccaaaauuaauaucaauagcuaauauuuauuuuguacuuaacuauaugccaaacacuaaaccaaaauguguauauauauauaaaacauauauauuacauauauuuguuaacucauuaaauucugacaauaacauacaagauaggaauuauuauuguccuccuucuuacagaugaggaaacuugaaaaagguacacaacuuacuuaagguccagaauuaauaguaguaagggaaagauguaaauucauaccaguuugauuucagcaucucuguuauuaaacaguauguuauaucucaaccuuggaguuuucagacaacaucccuacucuuucguauuccuagaaacacuguagagaagaaugaagccaugauauagaaucaagagaaacugaguaaaauagaggaguagggacucugaagaagaggggcuuuaggaauauuagaagcaaagugagauggcucaaagcugaugaggacugggugagccaacauuagacauaugcuggauuauuuccuuuauagggcccuggacauacuuguugggccaggagaaaaauauuaaaggggagguauggagguagacauagccagcugagcacgcuuagugcccaagaauaaauuuuucuaucaucaaguccauucuucugccuccauuuuuuagggauacucaguaagacuggugugacuuuccccauguuacuugaaaaugaacagcuuaaggaagagggaaaaguaaaccaagagccagaggaugccauaugguguggugaugaucaggacuaacucacaaaccagacaaccugggauuaguaccagagcugaguuuuucauucccauuuuucuugguucuaaaacucauguucuuauccuaauuccaugaauauuuaacagacaaaacauguuaacucagcuaaccagaaugaaauggauagaaacuuccucuuaccuaucuuagcucuauagaaaaucagaauaaaaaaucugaucuggcuauuugaggacacaagaaugaugagcagaguuuuaagucugugaaggauacaguccaaaccagguucauaucgugguucacucugcauaucuaaacaaguuuacccaaccuuggguaugacucauuugcugaaggagacauauaucuaccucugacucaauagaaaagaaguaacucuaagacaguaauuuccuuaauugggcaaagccuaggucauuugaaagggaaagcauuccccagccucaugguuaucaccagccucagucucauaucuucagugucuucccuauaucuuuguccaucuuccacagaguuauuaaagugaucucuuuaauaugaaaauacuuacugauaacuugccucaauauccauccuucaguucuagcagaaaaccacaaagccugauuuuuuauaugggcucuugaccauccagagcaaagacuguauuucccaaccuuuaaugcagcugaguguagacauguaacuaaguucugauguauaagauaaaagcagaagugucuugugcaagcuucugaggaccuuccuuaaaagaacacugguaccucuguguaacucucuucuuauuuaccauuguuuccaccuuguugcccugauuauagguuuagaaugugagucugaaggucacauacggggaugguugaaaaaauauugaauuccuaaacagccaucauauuaauccucgacuauguaacgccagacuuuuagaugaaaaacaaacuccuacuguuuuuaggccaguauuaauuuagaguuucacauuacuaacaaucaaauccaauccuaaacaauacguccaucaugcguuuuuuguuuaaaaccaauccaugguuuccaauugcccucagagaacaauucuaacucccuuaguaaaaccuauaagguccuuguaaccuguauauuuaauaucaucuuuuuagcuucccugcuuauauuuuaacaaauuaacaauaccuaaugaccuguauuucccuaaguauuccacaauuccauaauuuguucuguuuucacuucucuaaacagacugucaacuucugcuuugaauuccauccucaccuauuugauagaaaagugucaccucuucugacaaaccaucucuuacccuuuagacaaacugaugcacuccuuuuacucuauuccaauuauaccugaucaaucauccauuuaacaauugcuucaacauaaaugagggguuuguuuguauuuccaacuccaccacuacacuguuuucuuaauagaauaaugucaugcucaacuuugaaaccacauauacugccagacacauaauaaaugcucaauaaauucuuuuaagugaauaaauaauauuaaucaugcagccaucuuauauugucaaucagaugccucaguauaacuucguugauucuuuaaacuaugucuuuggaacuugucuugaugugaauucaggcugugccaucuaaaagcuguguccuuaggcaacccucuuuccauuucugaguaucagcuucuucuucuuuaaaauagaagaccuacuucaugguacguuagggcuauuaaugcaauuaaguacauagaacaucuaggcuaaccuaauauuaacccacaaucaauggcaucaucauuuuuauccuuuaggaaaguucacauggcuuagaaaagucaauccaaaacugccaggauuuaaaacauaagagaugcaaggacuccacaugaagaagcucaagggaaagccagugucauaggcagccuuacauaauggaaugaguacuggccugggcauucugaucugugauuaaacccugagggaaucacuagagugcuaugagaucaugaggaagucacuucuacccccaaaccuuagugcccccauguguacaggguugaaaguguccagaugauauugaaccaguaucuauccuaacucugagcugcacuuccuuuggccccgcuucaccacuuucaucucauuaaaccacacaaauuuugcccuuagauggacugcucugaccaaacuccccacagccucuacucacccacuguccuaugggaagcagggugaguucauugcaccuucagauuuuagccugaugaugcauguuuguguagaguuggugauugguuucauauggccaaaggauccggcagcuggggacaucuguuuacacuuagcacacagacaaauuuuccacagucaggagucagugugcuccugaccugacuguggaaagcagggcucagucccucugggcuguguaagugggagcuuuagacuugugcccuggacucacaugucaggaagaauaaccuagauaugaaacauuugaaguaagaagcagaucucuggugucucuauggauacagauaaauugccuauggaaauggggcacaguuggacaggaagcaacauauuacacugaugaggaugauuaaggaagauccuaaaggaugcuuuguucccagaaggaaguccaugcugcaggaacauugacccacauagaaaaggaugacugucucagaaauagcuucagaguauggcuuaugcuaauaauggaaagaaacuacucauucugcauaauacugcccuauagacccauauuuuugcuucacuccaguagacaacaugcauaggugaaggagcacuggucuugaaauuauuggacccaggucccacugccaagucuuucauucacccuguguguccuuggacaauuccugcugcuucucugagcaacagcuaccuugucccaaaaagaaugucacaugggaucauauuagauucuccaugcaaauguuuugucuaaaaugaaauagucuccagaugucaggagcuguuguuacuauccaaggaauaucucaagaucauaaagauaaagugaauguauuuaauuuuucuaaccagaauagaaauuauuuugcagauccucuaagagauggcuguccauuuucuacaucagcaucucaucuucagggguagguggccacagccuuacagaaaaguuaguucuguucucccugguggucguaaauuccugucaaaguucuccucuuucccucaugggagagcugccagucugcuuucucuucucuggagccaggagaacaaaugugcuuccucuuucacaggaaguaccugcugauauguggaaacugcaauaggagagaaaaggcauagacuuugucugccuuuaguccuaggaucacauccugcuuuucuacucugcaucugugugacccugagauuguugaguaaacacaguuaaccucaguguucccaacuguaaagggggauaauaaaacagacacaguguggggaugguaaggauuuagugaaaugaggcauaaagagccugcgaccaugccuagcuaagagcagaucuucaguagaugauaacuacuaagacauugcucuauugucuuuacugacuuacuuuugugguuauuacugacauuccuuauauuuaacaacaugguucgguaaauguucaaaugggcccaaacacagcuugguuuggaucauuagcaaaccaauaccuugaacauuuacuaagcuucuucucugucucaggcacuacaccaggcaccgcuggggauucaaaacagaaguguucccuucaugaaugagaaacagugucaugcaauggccauguuuccaaaguaauugauauauaauaaaaauuuucacauagcuuggaaauauaauggagaccuuuucaugauugaagaguuuuuuuuccuuuucuuucaaaauuaucugcaagguuucauguugaggucauucauuggaccuacaaaagguccaugaaagggaugcuuacaccuuaaggaccaacauacaaagaauuaaguggcuucucacacuccagaucauuuacucuuggccucacucuugugccauaauuauugcaaaaaauugccauagaauucuacucaccccauaggagcccaauggaacuuccaucaucuuagugagacaccuucaauuuaaauuacauacaugguuccucagagcuacuagcaucaaauccaaguucauuauagugucccccaggccucucauaacucuaucccaaauacucugagucucucacucuuggccauucuuuccuuuucuauaccuaccccacugccugaccaaacauguagucuggacuccagucgugccaauuuacugcaauucccugagugaaucuugcucuuccaccccuuugugccucugcccaggcuuguacaauucccucuuccuggaaaaccucuuucuuccuucugugccugcacaaccuccacacauucuucucuaggaugaacauaaucaucagcguuucugagaaacuguuaccaggugcucuaauccaauuugggaucauuacccccaaucccaaaacaucuaacccuugccaccauccuacacuuacccuacuuuaaaaaacauaauucucuauuuccucaucuguggcugugcugugagcuuuuugggaacagagggcaugccugauucaucuuugugacauucacagagcuccauaaaagccucuuggaugcauggacagaagccuggauagacagaugcaugaguagguuccagacccauaagccaaggacacgacaucucucuucuuggaauaauaauugcauaagacccaauaaaucaccuaguacucuuugaaauaucuuggcccuagucaucaggaagcccaaaaugguuggaguuagccugugaauugcccaauucacuuuauacucauuaaaacagaaacaaucaaugauaccuuuuaauuuuuauucaugucuagacauuccaaaaacucaacaugacaagggguucuuuuccacuuaccuuaugcuacaauagcuaauccuagccauauucaaaauucugcucuauguuaauucuuuucaagcaacuaaaauucuguuagggaaaaaagaaaaaagaaggaauauaaugcacagagagaggaauauggcuuaaucuucagucuuuuaugggaauauaaugcaguuucucagacccaaagguaacuaaacuccaacauucagucuucccaugacuuuuuauuggcuguugcugaacucaucaauuuuuccucaaucuuuugugggggucagaucuuaaccaugccuaaauacuuuucuguugaaaaugucauaauuauuucuccagguauaacugauuuuugguguguagacaccaaagacucaugucucaaacacacacaaacuucugucugguuggguucucuauuuuuaugaacaccgccuccauggcucucuaaaccccacaaaacuuuauuaaccugaagccuccaaauccucuuuguuuauacaacuuaggcugaccuuuucuugcucuuucuggucugggaaaggauuugaucaacacacacacacacaccccacacacacaccucaagauagucauggcauguuucacgcuacccaauaaagacaaucauguuuuccuguauuuagaaaaugcuaauuacaaagcuaucuuagcugcagacacagagcgcaugucugccuccacacuugauuccugccuccacucaaagauauucucuguuuaaagcaucuuauccacaaaagcacccuuuuacucuacaucccuuuucccuauuuuaguuugcuuuacaucccuuuucccuauuuuaguuugcuuuauugcacuuauuaaaaauccaugagaguaggaacucuggcaauuguguuuauugucacaucuccucagccuacaauuccuggcacauaguagcugauagauaauagagagauagaaagauagacagaugauagauagauagauagauagauagauagauagauagauagauagauaauacacagauguagaaacugagauacaggaaauacacauaagacagagagauacacuuagagauagagauaaauucuuauccggcuuagcugugcuucaguucuuuucuguuuguuuuguuuuguuuugagauagaguucugcucuugucacccaggcuggaguguaguggcgcgaucucggcucacugcaaccucuaccuccuggguucaagcaauucuccugccucagccucccaaguaacugggauuacagacaccugccaccacucccgguuagcaguguggccuuggaaacgagacuuaaugccuuucaaugucucuguuuucucaucucaauuccccacagcaacccacauggcuuuacauaaccuagccccugcuaaccucaucaaccucccuccugucccucuccccaccaucaccagucacuuugcccaccucggagcuugcccuggaacaaucuucacaucuucacaucucuuuguaccuggaaacccaucaucuagaaagagagcccuucccuucauauccugaccaaagaucuccacuccccugagauuggucuuucgcaucacuuuguuuuaauuucuuauacuauaauagcuauaucuguugaauaucuguugaauuaacaaauguauaugaagaugauaauaauuaauuagaguugcuaaaaagauuaaacaaaaucuuuucagaauuaggggagcuacaaagguagcauccauuaaaaauaaauuucucugcaguguggcuauaauaugguaaaugauguacuuaaaaaugcuaacuguuauaaauauauuauuuguguuguuaucauuuguccauuaaugucucugguuauauuuagcuacuuagcacaaauaauuauccauauuuaaaauggaaaauauuacauuaaaauuggaagucucaagauuuuacuauuuuggauaagggaguuugauugcuguugauaaaagccauuucucuugaugcagacuauauaguuuaugaguugaguaauauccuucuuuuagaauuugaccugaauuaaaugacuuaacccuuuacucugaucuauaauaaaauaaguaauaaaauaagguugcaucagccaaaaugucauagucugaacuaauucgucuauuucaaauuggcggaaaaauauuacaaggaauaaauagacucacccccacaccuucccuuuaaaccuuccacuuauuaagcaucauaccagacaacaaagaagaauaucaaaaguggaagcccucuauuagaaugaugccccugggucuaugucucugauguggauucugcacagcuucuccuccccggcugcugguguaugagcccugccucuguucugggugacuguccacugucucacugucucagcccagcugcuuugcuuugcugacucacugagucugacaccccguagagccgauccaugugcugauccuagaaaguaaugaggagccugcacagcugacaggaaaggcccgugccuuugggugccagaaaaagaggaagggcuagagaggaggucugaaugucccucuaacugcaccauuuagcauuugacagcaucuucccuucuacuaggagaccagcuuucagaauuuuauaagcaagcuguaaaaauguauucaagugugaaaccugaaacgaguccuuuaucaccagaucucuaccucccuggaauguaauugguuuccaaauuuaagggagauggagugggggaauggaagggaggugauccauuuagccauuuaaaacuaguaaaagaagagaaagaaguaaaaacuggugauuugugcuuucuuucguugcaggugaaacaugauuucauuuauacaguugaauaaucucaucugcaggugacucacuagcgucccuggagccaugcuuggucuccucuugugccucagucucucuucugguaaaaugagacaaucugauccuuccaggguuccagucuuguguuccaggaccuuuaaaauauccuaagaaaagacaauuacuagcucuaguggccuguguuuaaauaggacaaagaacuugacugagaaacagaaguauuuuugcaucuggaaauagcuaccaaauuauuucuccaaaaugcuuugacauguuugguuuccauguaaucugaauguuuugucacccaauauacauaaaaauacuacuccacuugaguagagaaccacaaagcuccaugcauuccuguacaucaaaauauacuuuucuuucuuuaguccuggacaaauucaagaugcacaaagauucagaaauauuuuuuaguagaaauucaaaaacauccuacagccauguagggagaugggguucagggaguugacugagaagugggagagacuagcaucucugugggggcuggagcauugucaaggcuacauuugauaucacaugggcauuagagagagagagagagugaguguguguguguguguguguguguguguguucgugugcacauuugugugucugcuuuccuuucugaagcugcaaauuuaaacucucagcuguggcagccucugggaugcagggaagacugcuucuguaaucucauuugccauggcagcugcuuggcgagcuugacauugcuaucuucucagcuucucagauuccuuaaagauucuccucugauaaccgugcaucaggcccccaaaccaccccagacccugccaugccagccuuccuucaagcucugauauacuauaccugcuugggaguccccacaugugcagcuagaguccucacaugugaagaguccauggacuggauucugugcaggccacacagagugauggaggacccagaggacccagguucuaaccccagcccuacuaauuacuagaugaauuaucuuauuaucuuaucuaauuucacuucuccaggcuucaacuuccuaaucuauacauuuaaggaugauaauccucaggcagaccuagucucuuuguugcuacuaaagcccagugaacagagcaggguuuuggaaacugugcaucuuuaaauaaccacaaggcguuauauuaguagcaauacuucaaaaaaacuggggugagcuauuuuacaggacuuuauuauaggcaaucuuacuugacacagagauuaugugcuaucuuagaauguuuuggaaugugaagaaacacauaaacuuuagcuaauuuucccaaaagggggaaaagaaaacaccaacauuuuuuggaagacuguaagacaguuuggggguguagagagagggggcauuuuaacaucaaauuucacugugagaaaguuauucccugcucaauugcguaucagucacuuuguuuaauucaaggauaaagucccaguuuuguuccaaagacaugagaugccuuaggcucagagucuucugcaggcaacauuaucuaaauggaauuuagauuggagaagauugggauagccauuaugaaaaacaguauggauauuucuaaagggauuaaaaauagaacuaccauaugacccagcaaugcaaucuuucuccugggcauauacccaaaggaaaugaaaucaacaccucauaaagauauccgcacuuccauguucauugcagcauuauucacaauagccaagauauggaaacaaccuaaguguccauugaugaaugaauggauacaaaaaugugguauauguauacaagggaauauuauucagcccaauaaagaacaagaucuuaccauuuaccacaacaugaaugugucuggaggacauuaagcuuagugaaauaagccagacauagacagaaaaauaaagaaaauuauugcaugaucucauuuauauguggaaucuuuuaaaaacaaucaaauauacagaguuagagaacaaaacagugguuacuggggcaaaggaggagauagaaaaggaagaaguaggaaaauguaggucaaaggagagaaaguaacaaauauguaggauaaauaacuuuagagauuuaacguacaacgugggccuauagguaauaaaauuguacuauauugggaauucaugcuaaaugaguagauuuuagcugcucuugacacaaaaacaaaaacaaaaaaaagauaacuguguaagaugauggauguguuaauuuaccuuacuguaguaaccuuuuugcuaucuauauguauuccauaacaccauguuguauaccuuaaauacaugcaauaaaauuuauuuuaaaacauaaaaauaaaaaaugagucacaggaaaaggaaauuaaauucugaguuauuuuuauuuuguggcuagugaugcuuauuuuuuauuuacaacauaaaacuuuuccucuuaaaauaaaucuauuuaaauugaaagaauaaaccauuuaaaugcauugacaugcauuaauguguaacauuaucaaugguaggccaauauagcaauaaucaugauuuuguauuaguuaucuauugcugcauaauaaaauaaugcaaaacuugguugccuaagcagugauaaauguuuuuaucucucaguuuuuguagguuaggaauuggggaugauucuggcucaaagucccucaugagguugcagucaaaaugugagcugcaacagcagucaucugaaggcuugacuggggcuggaggaucugcuuccaaggugguucauucaccugugaguuggugcuggcuguuccuuaccauguggaccucuccacaguguugcuuaaguguccucaugacauagcagcuaguguacuuccagagcaagugaucugagagaucaaggugaaaauggcaauaucuguuaugacacauccugagaagucacacacucacuucugcaaucucuaauuaguugcauaaaucacuccuauuccauaugggagggaacuucacaaggaagcaaaaacaaggaauaagaaucaucucagagacuggcuaccacacuguaauacaccaaucauugaaguuugagaaauacugauuuaaucuaaaauuauaaacccaccaagagaacaccggagaaaggaggggauguaaccaaguccaggcuagguuuuuagcacacccaagguaagaauucagagcucccuauccacugcacaguauuauuccugccauaucacaaaaaugcugacaccaccuuuggccuuucaaaauuuuaagagaaauccagcccuuucucaggguaagacuuugccuccccagcuuccaacaggaaguugaugcugcugcagcaauuucuaggcuuucagacucuccaccugggacuggguccagugaaguuagucaauuuugaaggcagaugauuaaucuggugucagaggucaucuauucccaagguugcaaacagauuguccacaggcagugaugagcccacagauaugucuccuuugcccuaagcaggacauuuuuaguuuuuuucuuaaugaguugcuaauuauaugugaaauuagaauauuucacauaaaaauccagaucugggguucccuugaaauaaucagaugugcugacaaugccugaucugcuuuuuuuguacaguaaccauccucuggaguuacauauuagcuacacacgauuuguucuccauggucccugaaacuucucugcuuucuuaaauucccuuauucuuugcaagccguugaacugacuacuuugacuuaauucaacucucucauuuacaaguaaaaggaacugaggcuuugacaguuaguaggcuuacauuucuugaaugacuuacccaaggccgcguggcugguaaacagcagggcaaagaccaaggaggguuucuuuccuaccuaagccaacacucuuccccaaacacuucccugcuuauuuuacaaauaggcuccaaaauaaccagaggauauucuggauagcucugcuaaugugacucucuuucccucacugcacuuuuagccucaagagccaucucacaucaaauagcagaaaggggauaucaggaaagaggaaccuguguagcucaacuccaauuuacuaccucaaggaaagagaaaacuuaaaaguuuacaaaaauuuguccauucuaaaggaaggagagcaaguaaagaauaguagauugagaaaauacaaguacaaaaccgaucaaauccuggaagaagauuguuaacaauccccaaacaucauagauuucagcgcauucaacuaccaggaaucuuugucuuaaaucucccaauuugucauuuauuauuacuaaaaauaauuuauuuuaaaucuuucaaggaaguucuugcuuccucauuuccugaccuuuaugaagucaccaucuuggcacacacaugaaaggaaaguguuuuaacuaaauugcauguuaaaaugguagaggaaaaugaaugaaagauuuuggcacagugaaagcacccucugagggauguucuugaaagccaggcuuagcagcugcuccggugaucaauaaguagauuccccagcacuagcucacuguagccaaggucucaggccuguguccaaauguaaggaaccacagcugcuucagaauggggaggagugacuuugcuucuccagggccccugaguucagaucagcucuugcacugcuagucugcaaggaucaacaaauucaguacguagaggugcauguaauaaccacaugggaccacaagccaccccagaccuggagagucugugugaugcuugaagggguagugaagggaagucuuuguugcagaacacugaacauucugacucacuuccacuggacccucucaguuccacaacagaaucccaucaccucucccuccauuacuccaaaaagcucagaauuuuccugauggaauucauagcugagccugaaggacuccuuaguuaacuggugguacagauagaacaguuuguucccccaugucacaugcaagucaggacuaugucuggacagcaaggaagaacuaagaugaaggaguaaauugccucuucauuaauuuauuuauucuguaauauuuacugggugucuaugauaugcuaggugcagugauuaagaauugaaugagcaagacauguucucuauucacaaaaagcuucagucuaugaggaaagagugauuaaaaagugguuacaaggaaaugggacaaguguuaucacaugggaagugggaguggaggaaggaaaguccguggagugaagaaaagggaaggaagugacauuaaauggagaugagaaagaucaggaagacuaaguacaaacaagacagagaagugagaguuuaucagauggagaaagagcccaugugaaggccuugugguugaaggaagugcaaugcauucgggaaacugaaagcagcuucauauaaauaggagcaaaggcccugugauuaaaggucuucaaaggucugguaaugcauuuacacuuguucgaaguucaauugggauagaaugaaauguuauaaacagggaaaugaugugcagauauuuggaguuuagggaauaccauuagguuugccagguaggaaacaaaggaagaaauccaggcaaguggcauugcuccaaacucacaaugauaacggauaacaguuccaaagagaacauucaaaugcauagcuggcuucaaauaugcaacaucucuguggaugagaaauagaauaaguaaaagguaaaaugggcugaagcuacaggcuucugggcuccuaguccacacaggaagaggcauccagguuuucuacuucuaugggaagaacagagaaaaaguucagccaacaugaagcugaagcuguagacugcagucaggcucccugcugaggauuaagagggagauugagauccccuguuaauaagcgagacuggaaaucccccguuaauaagaggcugucuagggcuacagccaccugacaaaaaaggcaguauaugcaaacccagccuugcagucaaaagucaagcugaaccaagcuauaugcucccuugaguaaugguaucaaaacagccucauuauguccauggagaaggaaucucaaacaguugacauaaaacacaacuguggauagcagauccaggggccauuggacgaaaacaucacauaugcucuaaagaaagagaaaauguauuagcacaaaacaacauuccuucaauauaagauaauucuacaaaacaaaauuacgaaauaugugauagagcuauccugaaaaugaaagcccaacauccaaacagcaaaaccaaaacccaauaaacauaaaaaauagaucacaaucauaaaaaucaagauaaaaacaauaaucaacuauaaucaacuaauaaucaacaauaaaucaacuacaaacaaaaacaaauuucuaaucuaauaaaagauuuuuaguagguagggcugcaauuuucagagaucauaaaaaacaggaaauugugaaccaaaaugaguaaaauaauugccugugcuuuugaggucuuacucaaaaaauucuaugcccagacaaaugucccgaguauuucuccaguguuuucuucuagucauuuuauaguuucaggucuuacauuuaagucuuucauucuuuuugaguugauuuuuauauggugagagaguuucaauaauucuaguuucauucgucugcauauggauauucaguuuuccuaucacccuuuauugaagagguuguccuuucccccaguguauguuuguggcuccuuugucaaaaaugaauugccuguaaaugcauggguuuauuccagggaucucuauauuuuguuccauugguaucuguuuuuaugccaguaccaugcuguuuugauuacuauaguuuugcaguauauuuugaagucagguacagugaugccuccagcuuuguucuugucauucaggauuguauugacuauccagggucuucuggcuccaaaugagauuuaagauuguuuuuucuauuucugucauugauauuuugauagaggcugcauugaaucuguuuaucauuuaaaagugugaacauuuuaacaauauuaauucuucuuauucauaaacaugaaauacuuuuccauuuucuuuguguccucuucaauuuauuuuguaaauguuuuauaguuuucauuguagaaaucuucacuucuuuagcuauauuuuuuccuacguauuuuauuuuuauacuuagguauaaaauugcuuccuugauuuuuuuuuuuuuuuucagauuguuugcuguugguauauagaaaugcuacugcuacugauuuuuguauguugauuuucuauccugcaacuuuacuaaauuugcuuuugaguuacaacaguucuuugguggagucuuaaguuuuucugaauauuagauaaugucaucugcaaacaagggcaauuugccuuuuuuccuuuucaaauuggauagcuuuuauuuauuucucuuaucuaauugcuccagaugggacuucuaguacuauguugcauaaaagugauaaaaauaaucauccuuuucuuguucuagaucuuaugagaaaagccuucaauuuuucuuuuuaauuuaguauuguauuagcuguggguuugaaaagaaaaaauuaacaaaugcgauuguagcaagugaaagcuucugcacagcaaagaaaacaaucaacaaaguaaagagacaaccuauggaaugggagaaaauauuugcaaacuaucucucugauggauuaauagccagaauauagaaacucaaauaauugaauagcaaaaacaaacccuuuauaauccaauuauaaauaagcaaaagaucuguaguuauuucucaaaagaaaacauacaaauggccaaccucuauaugaaaaaaugcucaacaucacuaaucaucagggaaaugcaaaucaaaaccacaaugagaucaucuuaccucaguuaaaauggcuacuaucaaaaagacagaaaauaacagaugcuggcaaggauguagagaaauaggaaugcucaaacgccgaugguggaaauguaaauuaggguaaaaaaaaacaguuuagagguuccucaaaaacuuaaaaauagaacuaccacauaauccaacaauuccacugcuggguauauaugaaaagaaagaaaaucaguauaucaaagagacaucuguacucccauguucauugaagcacuauccauaauagccaagaaaugaaaauaaccuaaguguccaucaguggaugaauggauaaagaaaaugugguauauaugcacaauggaauauuauuuagccauaaaaagaauaaaauccugccauuugcagcaacauggauggaacuggaggacuuuauguuaagugaaauaaguaauccaggcacagaaagacaaauaucacauguucucacucacaugugagagcuaaaaaaaaugaucucauuaaaguagugaguagaauggcggucaccugauugaaaaugaacauugggcuggguacaguggcucacaccuguaauccuaguauuuugggaggccgaggcagguggagcaccugagcucaggaguucaagaccagccugagcaacauggcaaaacucugucucuacuaaaaauagggaaaauuagcugggugugguggcacacaccuguaaucccagauacuugggagucugagauacaagaaucgcuugaauccaggaggcgcagguugcagugaacugagauagcuuuccacugcacucuagccugggcaacagagcaagacucugaaugaacaaaacaaaaaaaaaagaaaaagaaaaugaacauuaauuagugaucagaaaaaagaaaacuaaacccacacuuagacauugucuuuguccauuuugugcugcuauaacagaacacccacagccugaguaauuuauaacgaauauaaacuuauuggcccaugguucuggaaguuuggaaguccaagauugaaaagucagcaccuagcaagagccuucuugcuguauuauuccacgauaaagguggaagggcaagacagaacaagagaucgaacuuguagccucaagcucuuuagcaaucagcauuaauccauucaugagaguggugccuucacgaccuaaacaccugccaucagccccaccucccaguaugauugcauuggggauuaaguuuccaacacaugcacuuugaaggacacaaaacauaaaacauauuuuagacacauagcagaguucagaaauucugaagaauaaaaaaguagugacugagauguagaauacaauaaugagcacauaaaaugauaaaaauugguagauaaaucacucaaccgaaaagacaaaaagacuacuuuucuaaaauucuaaccagcagaaacaugauuauggagauaaggagcacucaaggccaggugcaguggcucacgccuguaaucccagcacuuugggagguugaggcuggcagaucacaaggucaaguguucgauaccagccuggccaacauggugaaacccccgucuccacuaaaaauacaaaaaaaaaaaaaaauuagccagucgugguggcaggugccugaagucccagcuacuugggaagcugaggcaaaagaacggcuugaacccgggaggcagagguugcagugagccgagaucaugccacugcacuccagccugggcaacagaacaagacuucaucucaaaaaaaaaaaaaaaaaaaaaaagaagcacucaaaaacugggcauuauuugagauaugacugcuguaucacaacugacaccuggccuagacuaucuuaaaaguccaacugguuguaagaugcaugucauuuucagaaagaguauagaaauauccacuaaccuaagacuuuauuaacaaauauaauagauaaguauguauguuaaaaucuaagacuguguccuaaaacaaaugaaacuacaauugaggucuuuuaaaucauuuuagggaacaaugggauaugaaaaaauuugacaaucucucuaaaaucuguaagauggagaacacacacacagcccccaaaguagaauuuccaaauacaucaauaaaacacaauaaguguaaugaaucaaacauaguuauugaaaguuaucgaugaggcugaguuuuuaaaaauucaguaaaaaaaauuccauaagcaaagauaaaauauuuaaaacgucaacugaguauuaucuuauauugaugaucgaauagucagucacacguuugauuuucaaaaugggcacuucuaacacguuagugcaugugcauguuuuucacugacuuuugacuucuuagucacugacaauuugauuacuuuaaacuaguuucuuguucccagguuauaacacugccuaagcauuccaauaauucucucacuugcauaaagaaaaugugauucaaauguaaugcuuccgcuuauucugaaauacauacggauacuuucuguuugaaaaagagcauuuacauaaucuauucuaaagccauaguaauuaagauaauuuuaaaaaugaaacauuggccaggcgcaguggcucacaccuauaaucccagcagugugggaggccaaggagguggauugcccgaggucuggaguucaagaccagccuggccaacauggcaaaaccccaucuuuacuuaaaaaaaaaaauuagccgggcguggugguaugcacuuguaaucccagccacucaggagguggaggcaggggaaucacuugaacccaggaagcagaagcugcagugagcugagaucgcaccauugcacuccagccugagugacaagagggaaacucugucucaaaauuuaaaaaaaaaauaaaaagaagcauuaagaaguacagugggggagguggggaugguuaaugugugcaaaaauaaaauagaagaauguauaagacauuuuuuaauaacacaauaggauaacuauagucaauaauaacuuaaccauauauuuuuaaauaacuuaaagaguauaauugguuuguuuguaauucaaaggauaaauccuugaggagacagauaccucauucuccaugcugugcuuauuucacauuucaugccuauaucaaaauguuucaagcaccccauaaauauauauaccuacuauuuacccacaaaaauuaaaaaauaaaaaauacauacagaaacagaaugaagggauaaagaaaaugugauauauauauauauauauauauauauauauaugcgcaauggaauauuauucagccauaaaaagaauaaaauccugccauuugcagcaacauggauggaacuggaggauauuauguuaaguaaaauaaguaagccaggcacagaaagacaaauauggcauguucucacucacauauggaagcuaaaaaaaauugaucucauggagguauuagguuggugcaaauguaauugcaguuuuugucauuacuuuuaauguuauaauuguuguaguuguuacuuuuaauguuaucuuuaagauauuuuugccuacuguauguuuuugccauuagaaguaauuacacuugcaccaaccuaauaguaaguagaauagugguuaccagauuggugguaaaauuaggugagaugauagugcagaaaaagaaagaaugccuuauuaauaaauggugcugugacaacuaaauauccacauggcaaaaguaaaauaaaauacagagaaaaaaaauagaucuugaccccauaagacaccauacacaaguaucaauuccaguuagauuaagauaaacauauuuuguaccugcaaaaugauaaaauuuguaggacaaaagacaacauauucaguaaccugcaguaggcaaaaacaucuuaaagaugacauuaaaaauaacagcuauaaaauaauaauaauaugauaaauuagacuauauuauguuuaagagcaucuguuuacuaaaaaaauuaaaaacugaaaacgagauuuaggaugaaaaauuuacaauacuuguaucugacagaagauauguaucaaaaaaauauguaaaagauuuauacacaucaagaagaaaugauaaacccauagaaaauauggaguccugguaagucagcaacaaugaaaaagggcucccagggugggggagaaucauuuuucugagagauggcuaaucacagacaacuccuuggcacaacauccucuucccaauuaucucguuccacacauagccccuuccacuauggcccuauaaaacuuccccgcagugccuacaucuuugcagacagccccuucucugcugugcugcccauugcaccuugcaauauaucuuuguauuuucuuuaauaaaucugccuuucuuuccccacaagugucuugguacauucuuuuaccauccaacacacuggccugagucagugacacccacaauagaaaaaugaagaaaagacuaaaaauuucuucaaaacacugagucacaaaugaucaauagcacaggaaagaaugcucaaccucaucagucauuagguaacuuccaauaucaaauaccaaugcaauaucacugcauaccuacugaaguacagaauaaaacugaagacagaaaauacaaaguguugacaaagacacagaacaaccagaacuuucaauaaauuguaucaauuuaaccacuuuggaauacuuuuugcacauaucuacuaaaauuaaacauacauaugcauaucccaugacccagcaauuccacuuauagauguauacaaccccccaaaaacgcauacacauauucauccaaaaauauaacaacaauauuuguaguagcauuauccauaauaacccaaaacuggaaaccugguccacuguccaccaaagggagaauggauaaauugugguauauucuuacaaggcaauacuacauaacaaugcaauaauauuggugaauuccauaaacauaaugaugagccaaagaagacagacacaaaagagcaucuaguucaauaacaggaagagugcauauguguugcuauaacucaagguagagguuaccccaggugaugguggaguuaucacuggaagaagcaugagagggcuguuuauauucuguuucuucauuuguaagcaggccacauagugugcuuacuuccagaaaauucuuugagcuauagacauaucugugcacuuuuuugcauguguguuauucuucaaaguuauucuuuaaaagugccacugguucacacacugugcacugagguucaaaugacugauguuguggagcggauaaaucaucucucacucagaaaaugaagugcuuggauguuuagcaaaauaagagucuucacuggauaggcuuuuguuugggggcucugcuguuuaagaacaccaaagggcaagcaaaugcuaauacuuuaagauuuugccuuuguaaacgugacuaaugugacaugagaagaccagagaaauuggauuuaauuauggguuuuuaauauacuauuuauuauacaucacaugauauauuuagagaacauaauuccuuuauguugcuuuuauugccacucguuacaauaggaaauuaugccaacguccuucugaacuacaaacaguuaaaugcaaaaucaacaauaaaagauauagauuuuaaaauauauauuuggaaaaguaaaaguaaacuccuaaauaucaaaaguucugaguugccaaaaaaacuucuaaaguuuauuagaaguguaaacuaaaaauaaaauucuguagacccaguguaaaccaaaaauaaaaaucucuagacccagaacauguaagacaggucccaguuuauuuagaaaguuuauuuugccaagguuaaggaugcaaugcacaccugugacacagccucaggaaguccugacaacaugugcccaaggugguuggggugcagcuugguuuuauacauuuuagggagucaugagacaucaaucaagcacauuuaagaaauauuugguuugguuaacucaaagcagggggcuguuggggagggggguagguuccaagcuauagguaaauuuaaacauuuucuggcugacaguugacaauugguugaguuugucuuaagaccugggauuaauagaaagaaauguuuggguugcaauaagagguuguggagaccaaaauuuuaucaugcagaugaagcuuuuagcuagcaggcuucagagagaacaggcuguaaaauguuucuuaucagacuugaagucuguguuguuguuaaugccagagagguauuaaugaggcaugucugacccccacuuccuuucauggccuaaaccagucuuucagguuaaauuuuaagaacccugacuaaaaaggaaguccauuuaguugguugggaggggccuuagaauuuuauuuuugguuuacaauucuaaggcccaccccaccuccccaaccaucuaaauggacccuucugggccaaggacauucuaaaguuagccugaaaaacuaguuucaauucauaaugggaaaggggagccagacacgccucauuauacccuccucccuuuuggaauuacugauagagcagacucuuuaagucugacaagcaacauuuacaaucuauucucucugaaggcugcuaccuggaggcuucaucugucugauaaaaccuuggucuccacaaccccuuauuaccacaacacagacuuuccuuccuauugauaauaacccuuucagucaauugccaaucagaauaucuuugaaucugccuaggacuuggaagccuccacuuccgguugucuggaccuuucuggaccaaaccagcguacaccucacauguauuaauugaugucuccugucacccuaaaauguauaaaaccaagcuguagcccaucauuuugggcacauguucucaggaucuccugagggcuauaucacuggccauuggucacacauauuugguucagaauaaaucucuucaaauauuuuacggaguuugaugcuuuuugucaacaggagaaaauguauuccuuaaaaaacauuuauuaguuuuuuuuuuaaaaaaaagcaagauugaaaauaaguucagcauucaacucaagaaaguaaagguaauaaaacaauaaaaauuaaaagaaugggaaauguuacuggaaagggaucccgauccagaccccgaaagaggguuccuggaucuugcucaagaaagaauucaagguaaguccauaaagugaaagcaaauguauugagaaaguaaagaaauaaaagaaugguuacuccacaggcagagcaguggcaucagccacugguugcccauuuuuaugguuauuucuugauuauaugcuuaacaaggguuauuauucaugaguuuuccuggaaagagcuggggaauucuaggagcugagggcuccuucccuuuucagaccuuauaggguagcuuccugacauugccauggcauuugaaaacugucaugcugcuccugagagugccuucuaccaugcuagugcauuacaauuagcuuacaaugagccauaacaacaaccagaggucacucucaccaucuugguuuugguaauuuuggccggcuucuuuacugcaaacuguuuuaccagcaaagucuuuaugaccaguaucuugugcagacuuccuaacacauccugugacuuugaaugccuaauuuacugggaaugcagcucagcagaucucagccuuauuuuaccagccccuacucaagauggagucguucugguucaaaugccucugacagaaacagguaaacaacugauauuaauguacaagaaaacaaagaagcaaaagagauuauuaaacaaaaacaaaaaaaaaaagagaucacaaauuaaacuauaguaacaaagugggaccacaauuagggcuauaguagagaauuuuuuaaaucauuauaaauuaaaccaacuuucaugcuauuuuuuguagauuuuucaauuuguagauuucauagcuuuuccaaauaugcaaacuugaaaauguagcauaaauaaaauacuuuauggaaaccauagaaacaaucaauauugacaucaauacaaacaaaaauccuacacaaaauuagauaucagauaauuuuaauugauaagcaguuuucauaccaaaaagaaacaauacccagauaaauucauacagucacauuuuacuaaucaccaaagaacaaacaauccuuuucuuguucaaaauguaaaaaggcaguacaaaaauaaaaaaaagcccaaucucacuuauaaauggaaagcaaaauaauaauuucaaauauauaguguaccaauaacaucaacaguaacaaugaaugauagcccaagaaugcaaauauaguucaguggcagaaaaucuguuaaaauuaaccaccauuuuagaacacuaacaaaaaagcauaucauuuaucuuauuaggugaagaagaagcauuugauacaauuuaacucucaacuauaaagacaacuuuaggaaaaguaggaauaugaagaaauuuccucaaacauauaaggaaucuuuauaaaaaguauucaguaaauaucacuuuuuaucauuauuaaauacuuauugagcauuaaauuuguacuaggcacuguucuaaguacacaaauauauaugcauacauacauacauauauuaauauauguauguguauauauacacacauauauguuuaauccucacaacauucuucugauauaaauauuauuguuguuguugcuuuuguuuauuuucauuucacuaauggaaaaacacgaacacagagggguuaaguuaucuggcccaaaucacacaacuuuuaacugacagagccuaaauucaaaccuccuugaucuugcauuuuuaaccagugugcuauguggccucuauaaugauggaacauuagaaacauucccuugaaaaucuggaaaaagccaaaaaugcccgcuaucacuccuaccauucaaaauuguacauaagcccuggccaaugcaauaagaaaaauaaacacaauauuuuuuaaauagauaaaaagagauacaaugacauucacuugcaaacaauaugauuagaaacucuuaaaaaaauacggauaaaauauuacaaaagauaacagaauucagcaaguuauuagaucaacgcaaauuuauuuucauucuagaauucagccauaccaauuauaaaguguaauggaaauugaagauacuuuuacaauagcaagaaaaacuucaggcuccuaugaauaauucuagcaaaaaaauaaauaaacuuuuagaagaaaauuuuaagaaucucuuuaaagacauagaagaaagccugaauaaacauuuauggaacagaagacuuauuauuaaagagguuccuguucugccaccaaaauaaucuacauauuuguugcaauuuuaguuaauuauaauaagguuuucauuaaaauggaccagccaguauuuauacucuucauaagaaagaauaaagaaauaaagcuuugaaggaagggaauaaagcauacaagaccacauacaagcguuauucuaacacuguauguaacacaauguuauuuauauaaagaagagacaaacagaucaauacaauacagucaagcaccuugaaacaaauccauggaaaauuugucaggccucugagcccaagcuaagccaucauauccacugugacuuucauguacacauccagaugguugguuccugccuuaaaugaugacauuccaccacaaaagaagugaaaauggccuguuccugccuuaacugaugacauugucuugugaaauuccuucuccuggcucauccuggcuggaaagcuccccuacugaguaucuugugacccccacucuggccaccagagaacaaccccgcuuugacuguaauuuuccuuuauuuacccaaauccuauaaaacguccccacccuuaucucccuuggcugacccucuuuucggacucagcccagcugcacccaggugaaauaaacagcuuuauugcucacacaaagccuguuugguggucucuuccauggaugcaagugaaauuuggugccaugacucggaucaggguaccucccuugggagaucaauccccuguccuccugcucuuugcuccaugagaaagguccaccuaugaccucagguccucagaccgaccagcccaagaaacaucucaccaauuucaaauccaguaagcagccuauuuuuacucucuucuucaaccucccucacuaucccucaaccucguucuccuuucaaucuuggcgccacacuucaaccucucccuucucuuaauuucaauuccuuucauuuucugguagagacaaaggagacauuuuauccguggacccaaaacuccagcgccugucacagacugggaaggcagccuucccuugguguuuaaucauugcagggacaccucugauuauucacucauguuucagaggugucauaccaugcaaggaugccugccuugguccuucacccuuagcagcaaguccugcuuuucuuggggaggggcaaguaccccaaccccuucucuccgugucucuaccccuucucugcuuuucugaaggagaggcaagaaccccucaaccccuucucuuucacccuuagcggcaagucccgcuuuucuaaaggaggggcaaguaccccgaccucuuaucucugugcccccaucccuuauuuccacaccccgaccucuuaucuccgugccccaaccccuuauuucugugccuugaccccuuuucugcuuuucuggaagguaagaacucccaaaccccuucccucugugucucuacucucucuuuuuucuaggcuugccuccuucacuauaggcaaacuuccacccuccauuccuccuccuucucccuuagccuguguucuuaagaacuuaaaaccuauucagcucucaccugaccuaaaaucuaagcgucuuauuuucuucugcaaugcugcuugaccccaauacaaacucacaguaguuccaaauagccagaaaacggcacuuucaauuuuuccauccugcaagaucuaaagaauucuugugguaaaauaggcaaacggucugaggugccugacguccaggcauucuuuuacacaucagucccuuccuagucucugugcccagugcaacucaucccaaaucuuccuucuuucccucccgccuguccccucugucccaaccccaagcgucgcugagucuuucuaaucuuccuuuucuacagacccaucugaccucuccccuccuccccaggcugcuccucgccaggccaagcuaggucccaauucuuccccagccuccaguccuccacccuguaaucuuuuuaucaccuccucuccucacacccgguccaguuuacaguuuaauuccgugaguagcccuccccuaccugcccagcaauuuccucuuaaaaagguggcuaaagcuaaaggcauagucaaaguuaaugcuccuuuuucuuuaucagaccucucccaaaucagugagcauuuaggcuguuucaucaaauaugaaaaacccagcccaguucauggcuuauucggcagcaacccugagacgcuuuacagcccuagacccuaaaaggucaaaaggccgucuuauucucaauauacauuuuauuacccaaucugcucccgacauuaaauaaaacuccaaaaauuaaauucuggcccucaaaccccacaacaggacuuaauuaaccucaccuucaagguguacaauaauagaguagaggcagccaaguagcaacguauuucuaaguugcaauuauuugccuccacggugagacaaaccccagccacaucuccagcacaacaagaacuccaaauaccugaaccacagcugccagggguuccuccagaaccuccucccccaggagcuugcuacaagugccggaaaucuagccacuaggccaaggaaggcccacagcccaagauuccuccuaagccaugucccaucugugcaggaccccacugaaaauuagacuguucaacucaccuggcagccacuuccagagccccuggaacuguggcccaaggcucucugacugacuccuucccagaucuucucagcuuagcagcugaagacugacacugccugaucgccucagaagccuacaggaccaucacagaugcucuaaguaacucucacaguagaagguaaguccguccccuucuuaaucaauacggaagcuacucacuccacauuaccuuauuuucaaaggccuguuucccuugcuuccauaacuguugugcguauugacagccaggcuucuaaaccucuuaaaacuccccaaaucuagugccaacuuagacaauacucuuuuaagcacuccuuuuuaguuauccccaccugcccaguucccuuauuaggccgagacacuuuaacuaaauuaucugcuucccugacuauuccuaggcuacagccacaccucauugcugccuuuucucccaguucaaagccuccuucacauccuccccuuauaucuccccaccuuaacccacaaguauaagacaccucuacucccuccuuagugaccgaucaugcaccccuuaccaucccauuaaaaccuaaucacucuuaccccgcucaaucccaauaucccaucccacagcaugcuuugaaaagauuaaagccuguuaucacuuaccuguuacagcauggccuuuuaaagccuauaaacucuucuugccauucccccauuuuaccuguccuaaaaccagacaaggcuuacagguuaguucagaaucugugccuuaucaaccaaauuguuuugccuauccaccccauggugccaaacccauauacucucuuauccucaauaccucccucuacaacccauuauucuguucuagaucucaaacaugcuuucuuuacuauuccuuugcacccuucaucccagccucucuuugcuuucacuuaggcugacccugacacccauuaggcucagcaaauuaccugggcuguacugccacaaggcuucacagacagcccccauuacuucagucaagcccaaauuucauccucaucuguuaccuaucucggcauaauucucauaaaaacacacgugcucucccugcugauugugccaauuaaucucccaaaccucaaucccuuauaaaacaacaacuccuuuccuuccuaggcaugguuagugcggucagaauucuuacacaagagccaggaccgcacccuguagccuuucuguccaaacaacuugaccuuacuguuuuagccuagccaucaugucuccgugcagcggcugcugcugcccuaauacuuuuagaggcccucaaaaucacaaacuaugcucaacucacucucuacauuucucauaacuuccaaaaucuauuuucuuccucauagcugaugcauauacuuucugcuccccggauccuucagcuguacucacucuuuguuaagucccacaauuaucauuguuccuggcccggacuucaaucuggccucccacauuauaccugauaccacaccugacccccaugacuguaucccucugauccaccugacauucaccccauuuccccauauuuccuucuuuccugugccucacccugaucacacuuaguuuauugauggcaguuccaccaggccuaaucaccacacaccagcaaaggcaggcuaugcuauaguacaagccacuagcccgccucuuagaaccucugauuuccuuuccaucguggaaaucuauccucaaagaaauaacuucucagugcuccaucugcuauucuacuacuucucaaggauuauucaggcccccucccuucccuacacaucaaacucaaggguuugccccugcccaggacuagcaaauugacuuuacucaacaugcccugagucaggaaacuaaaauaccucuuggucuagguacacacuuucacuagauagguagaggccuuucccacaagguguaagaaggccaccacggucauuucuucccugcugucagacauaauuccucaguuuggccuucccacuucuacacaguccgauagaagacuggccuuuguuagucaaaucagccaagcauuuuuucaggcucuuaauauccagugaaaccuuuauaucccuuacaguccucagucuucaggaaaaguagaacggacuaauagucuuuuaaaacacaccucaccaagcucagccaccaacuuaaaaaggacuagauaauacuuuuaccacuuucccuucucagaauucaggccuguccucagaaugcuacaagguacaucccauuuaagcuccuguauagacgcucauuuuuauuaggccccagucucauuccagacaccagaccaacuuggacugugccccaaaaaacuugucaucccuacuaucuucugucuagucauuccuauucacuguucucaacuacucauacaugcccugcucuuguuuacacugccaguuuacacuguuucuccaagccaucacagcugauaucuccuagugcuauccccaaacugccacucuaaacucuugaaguaaauaaauaaucuuugcuggcaggacuaugcugaaucuccuuaagcacucucuaaucagauguccuagguccucccaauucuuagaccuuuuauaccuguuuuucuccuucucuuauuccauuuaguuuuucaauucauacaaaaccauauccaggccaucaccaauaauucuacaggacaaauguuucuucuaacaaccccacaauaucaccccuuaccacaaaaucuuccuucagcugaaucucucccacucuagguucccgcgccgccccuaaucccgcucgaagcagcccugagaaacaucgcccauuaucucuccauaccacccccaaaaauuuucaccaucucaacacuuuaccacuauuucauuuuauuugucuuauuaauauaagaagacaggaaugucaggccucugagcccaagcuaagccaucauauccccugugaccuucauguacacauccagauggcugguuccugccuuaacugaugacauucuaccacaaaagaagugaaaauggccuguuccugccuuaacugaugacauugucuugugaaauuccuucuccuggcucauccuggcucaaaagcuccccuacugagcaccuugugacccccacucugcccaccagagaacaaccccccuuugacuguaauuuuccuuuaucuacccaaauccuauaaaacggccccacccuuauuucccuucacugacucucuuuucagacucaggccaccugcacccaggugaaauaaacagcuuuauugcucacacaaagccuguuugguggucucuucacagggacaugaaugaaaaaauuggcauuaucagagaugcugcuauaaaaaaauagagaaauguuagacuauucaauaauugguacaaaggcaauuggguuuccauauggaaacaaaacaaaauuagaagacugccuuagaucaaaauaaauuccagauacacugaggaucacaauacaaaaaguaaaacuuuaaaacuuauaaaaugauaaauagaugaaauaaaugauaaauaaaugaaaaauaacuucuugacugucagaagcaaggauuuauugagucagacaucaaagcucaaaccauaaaaacauucaaaauuuuauaaauuugacuaugguaaagcuaaaaaucuuguaaaugauaaauauaucuccaaaaagauguaaacaauaaaccacagacuugaagaaguuauuugcaaguuuugugucaaaauuaguacacauaccaugcagggauaaaaauuucuacaaaucaacagauuaaauauuaaaaauucaagacaaaaaaaaucacaaugacacaaacaggcaaaucacgagagagaaaaucccaguagccaauaugcauacaaaagauaauuauucucacuaauaaauuugaauuaaaaucuaauaaauaaaugugaauuaauuuuccucacuaacaaacacaaaguuaggaaacgaaacccuuugucaaacccauaagauugucaaauaucugacaauaccaauuauugguaagaauguagggcaauggaaacucauucaacgcuguugagaaaguaaauuugauauucuuuaguaaauauaaauaugacaauauuaugugucuggaaauucuauaucuagguauguacuccacaguuacuugugcaaauaugcacaaagaaauguguacaaggaugcuuauugcaguguuguuuauaacaacaaauaaugcauaccaguaagagaguggauuaauucaauuguggaauauucacacaaagguacuccauagagcaguuaaaaaugaauaaacuaucuacauauauuaacagagcuaauucuuaaaacaugauguugaguuuuuaaaaagaaacucacuuaaugguuuguguaaugugauaaaauuuaaaccagguuuaaauguguuuacaacaauacuauauauugccuuuauugaugcaucuauauguaauuuaaaaguugcuaacaguaggcaauacaguuauuuacuauauuauuagguacuuuuccguaugcuuguauucuuuuauaagauaaaugucuuucuuuuuaaaugaagugaauuagaggaggcaaggcucuaggcagggagaacaacuaggucaucuaauguuuugggugacacacauuggcaguuuggaauaugacagauggaugcuggguggcaacaguguagaagagaugucacaucuuagagacaguacaaaccaagaucaaaggcagaaaauuccauccccaaacucugggucugaggucauaccuguaacagucauuauuguauaagguaaguuggaaauauuucuguuccuuccuccacaaacagaagggaaauaaaagcucaaggaacacuucuaaucaauuuuaaaacauauccugggucccgacuauagugagaguuuuguaugaauuuguucaaagaggagauuugcucucuaucuaaaagcaggcagacaguaacuuccagguggauaaaaucaauguugugcuuuugagaggaggcaauaauuacaaaggaucuauggaccaggggugcugagcagcuuauuuggaaggacucauguagacauauaagguaugcaauucagaaaggcagagucuuagacucccaaaaucuuggguguccaagaggccauuugaucugcugcucagccuucaagcagaucaaugacuaaaccauucauuucggccauuacuuguuuccuuuaacaguuccacaaaaguaguccaucaugaaauagauguguauucaaauucugguuuuauguuugugugcuauaugucucccagaaacuuucuuaaacuuguugagccucaguuucuuccccucuagaagaagaaaacgguaguacauucuuuacaguuuguuaugagguauaaauuaaauucaauguaaaaccaucuaacacauugcaauugcucaauugcucaauaugguuaguggccauaauuaucacugccuguguuccagguagaaaaaaaaaagaaaggaccuaaaugcaaaacauaucugaucuaucuucuccuaucuuuagcggcucucuguccaguacauucucgcugcccuaagcauugaaguuuggcuugcaucuggaggagccaagaacugagcuaaguccacugcuaucugauucugcucgugaggucacuccaggcaguuggggacacagagcucaccucugcugacccuuuccugauauuucacauagcagaagccuauccagaauucuuuuuuguaggcccagugccauaaaucuuggacauaucuuuuaacaccauaugucuaaguccuuaauagauucuuugaaguuuauagcaguuuucuggguucauccuuuuaguuuuuuaaauuuaauguuugagaugcauuuggguggccaaccguaaacuuccucuaugcauuaauuauuugcggauguugaggcugugaguugggggauggagggugcuggaaaaauccaugcccuuuguucuucaugaggacauacuuuaauguacauauuuacaacugugugagcucaauaaaaaagcuuaacuuggccugaaauaucaaauuauguuuucucacaucuuagaaagaaaauggaauuaaaucugaagcaggcuagaaauuuuaagauucacacaagacgaggauaacaucuaaagggagcaaacauuuuccauaugccaggcauucuccuagaaauauuacauguguuguuuuauuaauccuuaucccccuucaccaugaaguugcucuuauuguuauccuuauuuuaaaguugaaaaauccugaagaucagagaguugaauugaguugccuaaggucacacagcugauggccuauuauaaagacucugaguuuaaagcugaagucucuuucucuacgggagauugaggaagaaugaauagcagggcaugagacaaguacuuucauuggacugaacaguggucagugcuggucuaacuagcagucaucaaaacccucgggggagaacaucaucuuuaucauuauccccauuggauagaugaagaauauaagacacaggggcuaagcggcuugcccaagauaaaccagucaaaaaaggcagaacuggaauuuuaaugcagauucuacacucuuaaccacucugccauauugccgguugagagggagugaagcacauggcaaaguuaucuccaaaugaauguuaucuaaagucuuucugauauuguucaugccauuaagaaugguaccguuuggcuaugcagggauccuuuaaauuguaagcacaaagaaggaccaagacuuuuaguccaaaugagaccagagacucagacacuggagcagcuugcucaagagcauaggacuagucagaggcaaugacaauaucggccuccagguccccuggccuccagccugggacuuuuuccagugucccccucacucuucugucaacucagucagauguuggaggcucuguagucaugggaaagaggauaaagacagaauugcugcucucagcagaaacacuguaauggaaaccauuucacaggcuguggcagaaagagccuucccuccucaucacauguuagcuucgggaagaguuuaugacucauucaggacauuugggugugucaguuccgcaaaacuaggguauccugggcagagucucagaagaaagacaggagucaggaaucucaucuacuccaggcagagggaagguggcugucuauuaagaaauacugaaaggccucucaacuguacuucuguagccaccaggggagcagggacuugaaauuucugaguauuucucauccagucauuucaaucaugacaauauaguaguucuggagaugaaauauuuaaaguuguaaagaaagagugaguuuuuaagccagaucaauuugcaugcaacccuguuuccucauucauagaaugcacauaaauaccuacuucgcagaaucacaguggggguugauugaaauaaagccugaaaaauuucuagcagacaaaaggcacucaauggguacaaaguaaagguugaauugaucuccucuugauaagaugaaaccaaagccaaugaaaacuauuuggagaauauagcaggcugaauaaugcuccccgggagacguuaccuuauauguuaaaaaaaaaaaaaaaaaaaaaaaaaaaaaaaaaccuuugcagaugugauuaaguuaaggauauugagaugaagauauugagauaaauggcuuuuaugaaauggagucaagaggaucagaguuaggagaaaggcugaaagauacuguacugucgucuuugauaaugaggaaaaggccaugagccaaggacagcaggcagucacagaaucuagaaaacguaaaacaaacaaacaaacaaacaagcaaaaaaacucuccucuagagccuccaaaaggaacauagcuugcugacaccuuaauuuuagcccgugaggcugacuuaggacuucugacugccagaauuguaagauaauaaaugugugugugaguuuguguguauguguguguguguuugaggucacuaaguuugugcuaauuuguuaaaucagcaauaggaaacuaauacagagugauauaucacaagcaaaacauucaccccaauauaaagaacaucccuauaaguagguggacucaauagcucagagaccagcagccugugaauauagaugaggucacaaguucaucaguguguaaauaacgguaguucuuaacaacccccaccaacaccaccaucaauuuccaauaacccagucuuuauuuuuuaauguuuccccgucccuucaagcauucucaggaacaaguucacucagucuuucuuugaaauccuuccaugagcagaauuuuaggaggaaucuucgcaaagccacagacacuguaaccuuggugagaucccgggucucucucuggcacuccuccagcuaccauccugcuccacacaucuuuguccaaugcugucacucagucuagaaccaccagaaauaaaaaucuuuugaguaaauugucauauuuguugccaaucuccaaagagcgcugcugcuucccaaaaucuuacaguuuuuucauaaacaugauuccuuaagcuuuagauagcacccucacagucucucaucgggccaggcugaguggaaauuaaucacguuauucccucucaauuuuaccucuuccuucucuacccucugucccacaugucaguaugucccccucuuccuccaguuaaaagcuaaagcaccgucuuuguauaacaacuuaugcaacuggacacuugauagaaaacaguaccauuaacuccacuugccagacacauaugaaccccagcucuagcuugugcaaaacacucucccuacccaaccuaccuaccaaguuguacacaucccuggauuuggagagucuauuccuggaucccucaggguggggugggguggguggcaauguagaaagcaugcucucuagaagcagcucaugcccaacaggaaaagaagagacagauccucacuaaggauguucgcuaaagauaucccccauguccauuucucauuguucucuaguaucugacuauaaagggaccagguuggcucaggaugaacauagugucuuuucuauaagaugauccuagagcaggaagcagcauguuagagacuauuuucagaguaucacucuuucucugacagcuagagaguuccuuuaagugaaacaauccuggcagcagcaacacugaagugucucuuccugcccaugagaaugaacacaucaguaacaggaccugaccugauauuucugcaaagucuguuauggagauaugagagagagaucaaaaaauugaacucucuuucuuuuccaagcuugaaaccaauugaaaauuaaggcagaggaguaaaggcaauggcgggaaucaaaaccaccguuguuacuuguagaucucaaauuggaggauauggcucugcggaugaauaaauggagcuccaggauuagacagaccuaccuaccaaguuguagacaaccauauauccagagagucuaucccucaaucccugagagggcaagguagaaagcaugcccgcuagaggcagcuuaugcucaauagcaagaggagagacagaugcaacgcccugcacauccagcuccuggaaucaccaaguagauggcccccuccuucuucccuggucagaacgaguguggguaugcagacagacaaagagcauuaugugaguggaauuccacaugaagcucugcccccacuguagaagauuguguccuugucaaaauacucacugccucuuucuccugugcucaucccuuugagaguguuauccuuccuguggccacaagacuugcuuuggucaacaagaugucaguugaaaugacaugagccauuucuucacagaugcucugagagccauugugugucucugccaucuuuccuuuccuucugccacugaauggcaugccccagauuagggauucuccaucaggcuugguuguaggaugaagagggaauacaggcgcaguggcucacaccuguaaucccaauacuuugggaggcugaggcgagaggaucacuugagcccaggaguucuagaccagccuaagcaacauagugagagacccugucuccacaaaacaaucuuaaaauguagccaggcauggugguacaggccuguggucccaacuacuugggaggcugagguggauuguuugaguaugggagcucaaggcugcagugagcugugaucaugucacuaugcuccaggcuauaaaaaagaacaaacccugucuccaaaaaaaaaaaaaaaaaaaggcaguggaguagaauuuuggccaacucacaguggacaugaauaugaaugagaaauacauauuuguugcuuugugccaguaagagguuguuauuacagcccaccuugucucacacuuacauauacagggaaucuccuccccagcaacuuuccuuccucucuagucucuauccuucaaucaauccauccauucacuguugacaccagucccuguuagaacugcaauaaugaauaagauaugccucgugggggauccagucaugucaagaaauaacucaaauggaaaguagucagugcuauguuagaagaauguacaaaauuccuggagaacccagaggaggaugaugauucagaacagcugaggggaucgggaagggccccaggcaaucucugcaggaacccuucauuccagggaguuccuacgaagugugacugaaacucuagccauauuuuguuuuuguccuuauucccuggaacacagacccagcagaaaaggcaaccaagauguugggggaauugccccacacauacaggauauaugucagauucuaagaaaugccauagggauuccaaggaauaagggagacuuuucauccugagcuggcacaggaggucuuugaggagauaggauuucagccaagcaguaaaagguagauuggauuauuucaggggugugggguaaaucuuggggcaggccauuuuauuuauuuauuuauauuugagauggagucucccucuguugcccgggcuggagugcaguggcauaaucucggcucacggcaaccuccaccucccagguccaagugauucuccugccucagccuccugaguagcuggaacuauaggcgcgagccaccacaccgagcuaauuuuuguguuuuuaguagagacaggguuucgccauauuggccaggcuggucucgaacuccugaccucaggugauccaccugccucagccucccaaagugauuggauuacagacaugagccaccacgccuaugguggcaggccaucuuaguagaaggaagagaauguacaaagaaccaaaggcaggagaauaagcucuauuccagagaugguguagagcaggaaugcaggagcagugugugaguggaguggaggaaaaugagacccaaaauguggccugagagccagauccuaaaugcaagacuaagggcagugcccuuuaggugagaagagccacugaagucucugaaaacugaaauggcaugauagaaaagacauuucgggguaacaggaagaugacccugguaugauggagaguggaacuggagggcaaacuggagaggggcuacuaaaaggguuacuaauggggaggcuguuuaauguuccaggcgagguaggagggauccuaaccaaggaaggguccaaaggagaagaggaaacaaaaguaagugagucauaaagaagggauccacaauuaaugggguagggguucugaaaacagcuuggacagucauggaagaggacccugaggagguguuagaguagagcccugaauaaugaacaaaauuuagauaaacagaagggaguagggagggcaacauaaggaaguacagcuuuucaaggugagaagucuaacuugauuaaguaaaaguuuucuguagcgguacuacugaagauaaaggcagcaaguugaaaacuacauguguauguacuaugcucuuucuuuuaguccucuuaagaaugcuaugaguucuucucuauuaacccauuuuacagaugaggaaauggagacuuagaaaagauuguaugcaaaugaccuacauaauuuguguggccuggugcaaaaagagccuucuuguuaaaaaauuauuaagacuuucaaggcagugacagcagaguaguaagccaagccacaaggcccuucugagcaccaggcccuauacaacugccuaagucacaugcacauaaagucagcccugguucuaugacuugcccagcuccauacagcaaaaaaaaaaaaaagagucagagcuagaaguaaaauugcucuugcagcagaugaggagaaaguaggguugaugugaaggcuccugcagccuggaucucugcaucauauggagucaagccuccauuauagcaugagugugaaauaaacuuuuguuguuuuaagccacugaaauguugggaguguguauuacugaagcaucaccucucucaugcuuacucauauacuaaagcacagaaaaaucuccuacagcuggggagguaggucaugagccucaacagccaagaccuguguucuuuccucaauaucuaugucuuccaauugcaggucacaaccuguuagagagucaugaaaacaaucuacugggucacaggcacauuuuuacacaggaaauaauuuaauaaguaaaauaucauagaaacuguguguguuacuuauugcagugguauuuuuuauuaaacuuuuuccacuacauguguguguugagagucacaauaaaaaaaaaagguacuucugacuauggguuauugucaaaaauguuaaaagccacugcucaacaucaugcuuuugacacaggaaaggaaaaaaagucuacacacaucacccugacagcuuggauacucauaauaccuuuugaaaacagcuaaaugggaggacacuuggguccuuauugucaauguaauuaaugcuuuggauuuuacaguuugccagauagaaagcauuccagaucuuaaccaauaugaaacucaaucuuuguaauaugcuccuuuaacuccauuaauccucuaucuccucugcuccaacucuuacucugccauaaaagaaucaugaagucaucauuucggauacagggaacaaacccucauugucucaugacaaauuccgggcacagaugugcccacuggagcaacuacaaaaaagcaggcaagaagccacuuugucaccagcacugggccuggugccaggccucucccucucuuugaauccuugaugggcuaagccccucagaagugagucaucaaggauugccaguaucugcccagggagggagacccauuuacuuugaaaaacucugcaggaaauacuugugcuuugcucugccagaagcugucaaauuugcuucucucaccacagcaacugugguucugaaccccaccccccgaacccaacuuaugacaaaaagagcauaugaaagaacugaaaauagccuuuuuuucaguugcuuggugaaaauucccagaugugagcugcaaugacuguguggcacucauauuucaguuuugaguguggauauuuucucugaaugucuccugcaaauugaaucaagaagaacacuauuaauuauuuuagccaagguuauauuuuugcuccaaccuucuauauguccugauuuuggggauguggagguuugaggggcauuguccaugauuauucucugugcaguaauugccuuccccugaaacaagaugguugcaucaagcuuguugaguuuuuaacucuagaaugucuauuuucuuuucuuuuuucuuuuuuuuuuuuuuuagagauggagucuugcucugcacccaggcuggaaugcaguggugcgaucucggcucacugcaagcucugccuccuggguucaccugccauucuccugccucagccucccaaguggcugggacuacaggcgcccgccaccacgcccggcuaauuuugguauuuuuaguagagacgggguuucaccguguuagccaggaugaucucgaucuccugaccucgugauccacccaccucggucucccaaagugcugggauuacaggcgugagccacugugcccguccuagaaugucuauuuucuaucguauuuccagaucacccuaaucucuggcaaaggugccucuuccauaaccuccuucuaguuuccagacuugcacucuuguuuucacccacuuuucuugcuaucauuuccaauagccagagcaauagucuuaaaugcaaaucugacagccacuuucucucuugaaauccuucaguaguuuuaaugucucucuccagaccacaucucaccaacauuagcaaagcucugcagggaaggggacugggcuccugcuacucucagggcucaucccagacuauucuccuccuuggccucugaaauucacacuaacacacuguccuuaaaaguuucuggaauacaucagucuuguacuugacuugggaccuucacaucugcuguucuugcugaacacuauucuucuuaaugcuccaaauuuuuaaaaccuaguuagcuuucaaucucagcuauaguaucacuuuaacaagagcuaucuucuagcuaaaccaaauccuuucaaauucucucccaucaucuuacucuuuuccauuacugacuguauuagucuguucucacagugcuaugaagaaauacuggagacuggguaauuuauaaagaaaagagguuuaauugacucacaguuccacaugucuggggaggucucaggaaacuuacaauuaugguggaaggcacugcuucacaggccagcaggaaagaaaaugagugcaagcaggggaaaugccagacacuuaugaaaccaucagaucuugugacacucacucauuaucacaagaacagcauaagggaaacugccccaagauccaauugcuuccagcuggccuugcccuugacauguggggauuauuucaauucaaggugggauuuggguggggacgcagagccaaaagauaucacugaccauaucauaauauauagaagaguauaauuuuaacaucuuucucccucacuagacuuggcuucacagaaacaaggacauuguuucuucauuauguauauucauaucuuagcauggugccugguacauaguagcuaguaaauaaguauuuguugaauaaaugcuaaaggccuuuuaaaugaccucucugagaucuaagugcuugcaaaauauuucuuugacuggggaacugcuauuuuccuaaggacaaauaaaugaaucuucuucccuuuucuucuuuggcuucugguaaccagagccgcauauguaucucggauauauuaaucauguuagauacauaggguucgaauauuuguauuuucucuucccuuggucuugaucuuuuacuuuuagugcaguuccucagggggaguuuuugccaucuuuuuccaugguaaauaacauaugauaccacuauugaauagcauuacaaucuuuuguaacaaaacucaagauggcaagucacauuuaauucuuugaggaaagaggugagagcaaauauuaucuccaaggugucugaagaccucacauauuugagaugcgaaaagggaauugggcagcuaucugaagaccuggcugccuguauuaaugcuacuggacuugggcaaaccaagucucaagccucagacucuucauuuacgaaugagaggaacucuguugugcuuaacacacaaggcuguugacauauuguaugaucgcuuuuagguugaaaagcaaaacacaugcacacauaccuaugcacacacacccacuuaagaauauaugauuaugggcugggugugguggcucauaccuguaaucccagcuacucagugcuaaagcacaagaaucgcuugaacccaggaggcaaagguugcagggagccgacaucaugccacugcacuccaaccugggugacagagaggcugucucaaaaaauauauauauauauauauauaguuaugaucucaagggggaacaucuuugaugagaucacauuugauucucccuuucaugacuagcucaugggcaaaaaaacguacguaaaauuucccuuuguuuuacucauuuucuccagccuuuccucuugggucuuauucauaaagcugcucaaucauaucagucucagagacccucacuggggaauauccaaagacuacccagauauuuucuuucuacuuccuauguucuccaucagaaacugccaguccuauaaacaguuucuccaaaguuuccagacuucuaaguccucuaagggcuuguagcugauacauuuaucuggcaaacuaauuaaagcuaaaaauaaccgacaauguagagagaaagauaauugagcaauuaaucauagcaugaugagggcuauggugggggaggcccaaagaaagguacaaagguuuccuagagggcuuaugcugagccugaacacuggaggaugguuaugagcuuugccuuauauuucugcacacuaguucuggaaccacacugaagucuaaauuucugacagcccuggagaaauugcaggauaguaaaggucuuccaggaggccacaggaagguuucugagugucuuaguccauuugggcugcuauaacaaaaauaccauaaacugguggcuuaaacaaaaaauacuuauuucuuauagucuggggucagagaagucuaagaucaaaaacuccaagaucuagaauuucaugaaggcccucucuuccugguucacagaggaucaucuucucucuguguccucacauggcagaagugaaaacaagcuuucucaugacucuuauaaggacacuaauucuauucauaaggguuucacccugauuaccucauuuaauccuaauuaccuuucaaaggccccaccuccuaauaccaucacauugggaaggaggacuucaacauguugauuggaggaaggaaaacacaauuacucaguuuauaauacugauguaauauugagucaaagagcuaucuggcugcagaaggaaacuuaucacauaggaagcaugacaagguggggucagugcucaaggugcaucccaaggcccauggcaguaggagcaggaggaacucacugcauggcacuauagauaaaacucaggacuuguugaaugcaucauuccucugggauccagcacuuguuacccaucugccacgaggccaagugcaaaacaucuccccagggaucaccacucuggauaaaagcaaucuaaccagcaagguagaugcucauuccucgcugcaagccugucaauaagauuuuggcauuuaguauguaccaggcaguguguugcagagaaaguagcaaagaagaaagauccagugccugcucucaagaagcucaaggaggccaggcauggugguucacaucuguaaugccaccacuuuggaaggcugagguggguggaucacuugaggucaggaauuugagaccagccuggccaacauggugaaaccucaucucuacuaaaaauacaaaaauuagcugggcaugguggcaaaugccuguaaucccagauacucaggaggcugaggcagaagaaucgcuugaacccgggagguggagguugcagugaaccaagauugcaccauugcaccccagccugggcaacagagucagacuccaucucaaaaauaguaaauaaauaagcucaaggaauuacccaagguaacagucaaguaaacugcugcugacaaagcagugaauggacagaagugauucagaaggcaucaaccugggaaaaagggaagaccuccuggggcauuuacagaaguccuguaccaccgaggauugggugaccauccuuuuguccaugguagcucucaucuccauggcacucggcaaauaccaggggcucuauaaauauuuguugacucagaauuaauuaguuccauuugauuagucauugaucucugauuagcauuugacagggaaagcaaggugacaucuagucaguaucuuucaguggaaagaucaucaauagguuuugguaucaaaaauucuugguuuaaguuccaacucugccacucacacccaugugaaucugggcaagugacuugaacccuccaggucuaauuuuuuucacagucaacauuaggauaauaucuccuugugucauugugagaauugaauaugaaaaugcacucaggugauauugaauaugguagguucuuaguaaguauuuguuccuaauaauaaugguagcagaaguggguugauccuuuaaugugugccagacaaaggacauuauaugcauuauaacuuuuaguccuuacaucggcuccauaaaauggaccaacuaucacuuccauuuagcaggagagaaaacugagucucagagaguucaggcaauguguacuaugccaugcacuggucugaaguggagcugcacucugaagcccuauucucucccaugucucuaaucaugauuuuguucucccacauauggccuccaucuuuucccacagagacgucaagauacugaaaaguuuaugcaacuuacacaaguucacaugguugaucauugaccaugaugcugugaugaaaaaaugcauucuaguaaaagggacuucuuaccacgauuaggcaacagagcccaacaccuccacucuuuuuuauaacuggaaaugaugugucaugagaauacauggaaaguuucaacaaugccugacaccgcuauuucucuguugcuggugacuuagcuuuuccauuaagacccacaagggaaggagagcaacaaaaucccagcaugucccaucacccagcccagaaugcccucccccaagaagguucugaggugucaggaaacacauuuagacucugcagcuggcgugaaaauagugcugcauggucugguucuuguccucaccauauucugucaaaguacauaauuugcaagucaugcccauggggacaucuggacucugucauugcccccaggaccuaugccagucuggaccagcugucggaguuaaagaaucucagaauuaaaguacaguuuagcugaccaaauugauagaaaugaaaauggaucauauaauauuacuguuacccaaacauauugaagcuucccugugugacaaucccuugaagaaugacuacgcauucauucucucauuuaguaaucacaacacucccauaggaaagaaaauauguaaguuuuauauauaaaaacaaugagccaggccaggcgcaguggcucacgccuauaaucccagcacuuugggcagcugagguggguggaucauuugaggucaggaguucaagaccagccuggccaacauggugaaaccccgucuccacuaaaaauacaaaaauuagcugggugugguggaacaugccuguaaucccaguuuacucaggaggcugaggcaggaaaaucgcuucaaccagggaggcagagguugcaaugagcugagaucacaccacugcacuccaggcugggcgacagagcaagacuccgucucaaaaaaaaaaaauuaaaaaaaaauuagccgagcgugguggcgcaugccuguaaucccagcuacuugggaggcugaggcaggagaaucacuugaaccugggaggcagagguugcagugagccgaaguugugccacugcacacuccagccuggaugacagagugaggcucugucucaaaaaacaaacagacaaacaaaaaacaaugaaugauuuguccaacaauucacaggguaauaugaaaacuuuccuuuagucaguguuccagcucccuacuuucucugcagauauuguccuuuugcuguuauuuauagucccccuccuugcucugguauggucuuauccuggcugaguggguguugaaugaaagaaauaggaagauauaauuuuggagaauccacccuuugccaaggacuacaucaaguaaccagguacuuauaauacuucucucaaguaguuucucacaagacuaaauaucaccaucuccuuuuuacagaugaggacaaggacacucagcgaagugcacaaaggacacuugcaagugagagaaccuuggacuccaugccaugaucuuccuaccacccaggagagcaaguuaauaagaacauuaaaauggucaaauaggccgagcauggugguucaugccuauaaucccagcacuuuuggaggcugaggccggaggauugcuugaacccaguaauucgagaccagccuggaaaacaaagacagaccccgucucuacaaaauauauaaaaauuauccugccaugcuggacuguaccuguagucccauacucuggaggcugagguagcaggauugcuugagcacaugagguugaagcugcagcaggccaaaguugcaccacugcacucuagccuagguugacagagugacagcccaucuaaaaaaaaaaaagaaaaaaaaaaaaguuaaauaguaagccaaaucaagggccugggugauucaccaguuggaugauauauccuacaaaaauguggcagccuguucccacucagcuucucucugucagagggugaaacaaaaaaggaacuagaauaugguaaaaagcaaaaguuagaaaagguguugauccucucgaagcuccuagaccauagggagggcuuaacuuguuugaacuaaaccuuugauucacugguugacucauuccaucauucauguuuauugcuugcuuuguaccaggcaccauauuaggcaugaagauaugagcacguuaagaauacugugccuggcccaaaguggaaaaucacguacuauuuauggaagaaaggaaagaauucaagaaaagagaauaugagugagacucaaucccugucuucaaagagcucaaagucuaguaaccaccuaaaaaugaaacagacacugccuaauagcaacuacaauuacuagaugucagguuugauaaugagcuaggaaggaaaaagaaaaaaaaggaauaucaugcaagauuccccagaggaagugaagggacuuucaaguugaaaucugagagauauuuuggaguugaaccuaagugggaagucacaggaacaaagauguucuagccaaaacuaugcaaagguccaaggugcugggaccucauuaaggauucagguauuucagagagacuccaauauugauuuugggcuucucugugggaaugcacaugacuguauuagugggguaggaagagauguguugagagauaugccuggagaaacuaucagaggcuaggauuuaaagauucucuaaagagagucuaaaaaaguagaugucucagaagagcauaaagcaauggaaggauuuucagcagaagugaaauaucuuuauaguugucugcuaugcauagaauggauuggagcagcugagacugagggcagagaggcaagauaagaggauacugccauaauccaggugagaaacacugccaaccuaagaaaagguaauuucaacuucaaaagauucacaguccaaaauggacaauuguagauuauuacaaauauucugaagacagaggcauaagaaucagaugcaagaauuaaucagguacaguccgugauuguauacccaacuuuaauuuucuccaauagaauaacuacaacaauaaaaauuucuuuuauuuacuuuacauaaaucuuauaaaugacaauguguucccacuugucuuaaagccaaugucuacuuuacaguagauguucaguaaguaaaggcucucacugaauucccccaguaguccuuuaagguaagcaggagagcuaugaucagcaucuccauucaacagaugggaaaaaugagacucagagaaguuaaugagugccugaugguccaagaaagcuucagagccagaaauaaaacuaaauuucauguuuuuuuuuuuuuuuuuuuuuugagaaggaaucucacccuguccucuaggcuggagcacaguggcgcaaucucagcucauugcaaccucugcuucccggguugaagcaauucuccugccucagccucccaaguagcugggacuacaggugcccaacaucacacccggcuaauuuuuguguauuuaguagagacgggguuucaccauacuggccaggcuggucucaaacuccugaccuugugaucugcccgccuuggccucccaaaguggugggauuacaggcaugagccacugugccuggccaauuccauguauucuuaacagguauucuaacuaccuugaugcuagaaguccagggcaugauuuuuggugccuacagacagaagccugaguuuguaucuuaaaaacaguugaucuuaaagcuuauuuuccaaauagcauuuuaaaggaggauuugaaugcaggguccacaaacacagcuggcaggcaggguuaagauaagggaguuugaaauaccuuaagguggcagaaaaaucuaagaugaucucucacccaaggcuccauauaggcaggucgaacgggucuuauccugggucuucgugugcuaaagacaaauuuaugcguguuuauuuccacugacaacaaguaaggauucuggucauugucccuaucccugguucacuccccuacuggccccuguagaugccaaacuccacacuugccaggaguugaucuucacaauugauaugugcugagccagugcuggcugacaaagaugucucagaaaucugggccaccagccucuauaucccgggagaacaccccuccaaacauuaggaaagagacagauggugaaauccaucuuucuaccuccuaaaaagccacauccugccaagaucuuuccagcucuggauccaggccccuucccucagucucccuuccuggaccagguggagaugaagucagucuccuggcuccuccaacucauccccggcgacucagcccagcucacagcucucccacacuaagugagguugacagcuggucacuagugaaaggagaaagacggggagguaaaccagaaggagcagagagcaccgccaguuaggcccuguccuugcuguuuguaggagaugauauuacugcucaccuauccugugccucuauccugugccccucacauggaggauuauauaccuucauccuguucaauucugguagauucacaagacuuguuuuggccaaggaagcauaagcagaagugaugugugucacuucuaggaagaugcuucuaagagccaaugugugguugcuauauucucugguccaucugacagaguuccagauagaggcugcucagucagcuugggcccuaggcagagacugaaguggaacagagccacagcuaagcaacauggccacauagcacaguagggaguugaaaguuguagcugcacauuaagguuuagggaucauuuguuaccuaagcauaauugaaacuauccugacugacucccuuuuuguccuccuucuucagcccucuaacaugggccguguguucccacucuggguucccuugaaaagccccuauguguuucuauguccuaacauguaccauggcauauuggaacauguauauguugaguaucuguucaccagucccugggcucuauguuccuugaucuguaccuauacaguuccuggcaugcaggucacacugcauaauaaaugccuuuugagauuaacugaauuuauuuauucuugcaaugaauguuuuguguuaucccuucuuugggcaugacacugugcucucuacuaagaagaaauaaacaaagagcaaacaccaacucugaauucauaaaucuuccgggauggcaggggugauggaagacugucaguuggcuaaccuaacuuaacacacaguccuuagaaucuggaaaagcaaccagaaauggcuacauuauuugagccugaacaaguggaaauuuucuggguauuuugaaaaaaacuuuuccuuuucugauaaagaggauugcguguagguaaugccacucaucccccuuccuccugauuugagugaaauguccaaaacugugacugccaaaugagaugcucaugaaaaaucaaaucaaauacagauaccaacuuugauauuaguugauauuguuagggccagauuucuuaauaagugaaaaaauaaacucagaguuguuuuacccauugcuagucagauuuuucugucaguggcaaccaaacacauccuaacugauaccaggaaauaaguuguucauuuuuggaacaucaaccuuuaccaucuuccugcauugucuaccuccuacuaacauuucaagauucaacucagucauuauaucccuccuaaaguuuagucuguaugccagaacacaaacucuggauccauucugccuggaucaguaaaacaaguuacauaaauuuucuauaaacagcuaguuuuauuaacccuacaauucuuagauccuaggaacaaauucugccuagaucuuugauuucuguagguguccccaaagaauccauuuucuauggguugcauacauuugaaauuucccccuaccagaacuugagaauccuuucuguggacuuccagggaccuuccuaugaccuggggccaaucuggaacacagggugagcagcaggaucuccagggucuaccacauacucuguauugcuggguaucuucagacccaagaguugucuauggggauaaguuuuaguuguuguacacuacuagaaaacaccuaagcaucucccaaucauuaguuuuuuuccccuugccacugaacuugaacuaaaugugucccuugcuuagcuucuaugaagccugucaauuacacuguccccuaccucagugaucccucccccaccugcuagcugggccaucccagaaaaccaucacacguaucauuguguaaaauggcuuuggagacccaugaccugagcucaaaugcuugccacaguagauccugaacaaagaaaggaaugguguuucaagagggaaaguauagaccgggcacgguggcucaugccuguaaucccagcacuuugggaggcugaggugggcggaucacgaggucaggaguucgagaccagucuggccaacauagugaaacccugucucuacuaaaaauaaaaaaaaaaucagccagguuugguggcaggugccuguaaucccagcuacuugggaggcugaggcaggaaaaucacgugaacccaggaggcggagguuauagugagccaagaucgcgucacugcacuccagcccaggugacagugcgagacucugucaaaaaaaaaaaaaaaaaaaaaaaaaaaaaagaagaaggaaaguauaacaucaaggcauuuuccagaccccugugcaugaucauaguauaacgcagggcuaacgggcaauuuaugggcucagauaaccaaagcucagauguugacuccaccacuuacuaguuggguaaucuuagaaagguuacauagcuucacugugucucaguuguucaucuaaaaaauagaaauuauaacaguaccugcuucauagauugcagugagaaucaguuaagcuaacauauaaaacacuuaacauuuuuucuggcuauaguaauuacacaauaaagauuagcuggcaauaucaagccauaaaaguagagauaaauugguuggucccuagcaucaaagugaggaggagcugcuaugaaacuuuugaacaugaaaaaugcauacaaguagacaaccgauaagaggagucagaaaacagaaaagcauaaugccaaugaaaauuagauuggugaaaauauaauucugaaggccaagauuuguuaaugaauagaaacugucuuuggcaggugaucaaguaacccaauuuggagaaauaauuagacuguagacugaaaauauaaacgacuaaaaaaaaacaagggguaguuuagugucauaguuaagaggaauuccucauugcccuauguguuuucccugggaugagcucaguuuaggaguaagaaauugguccccuccauagagaugaugaacagcugcaauucauuuucaguuccugucaaggaagguggaugcaagaagcuagggcaggaauacaaggaccugacauugagagaggccauauucaccaggggaccaugggguagauacagaggcauccaugauuaccgggcagaaauguaaauuaggaaaucuuuaaugugaugagauaaauugcuccaaauaugcauuuccucuguuucaacuuggaauugguuaaagugcaccaugguuauguuggcuggaugugugggucugagcccaggacugggagccugcuaucuccaguuacuuucugagugacuuugagaaaaugccuucccauuucuggacuucaguugccagcagcuauaaagucagcuagaccacuccaaagcuccuuccaacuuuaaaauauaccugacauauggccauaaagaauaaguaauuggcuauuauggugguuuuaaggggcacauguuuagacaccauauccucuucucacccacaaagucagaaccaacuuccuacuuugaaauuagagucauauuuaaacaagggaauuaaaaugucaucuucauuagauaagguuugguuggagaacaugguuuagguaucugaaaucaugggcuuuccaacagugcaccugaaauuagcauacaggaacaccuauucaaggacagcacugcauagcugcauguccuuccccaacuccaacaggcagacccuuuuuuuaaccacaaggcagaaaacagacacagccucucugugagcaggcagguccacagaggaugaaggaaccagcuaacuagugguucucaaacucaaauggucaucaggaccauauggugggcuuguuaacacacagauggcugggcccaucuccagaguuucugguucaggagccuggaguggggccugagaaucugcauuucuaacacguugcuucacgcuauuaaugcugcuaguccggagaccacaauaagaacauugagcuaaguauauucagcagcuccaaaacucaucaauugaauacauaaacucauuucuccccugcugggggcagaugagaagagggaggagagccagcauuuccagggacucuacagugucucuauauggaauaaggaguaaguucccuuccacaucaacuauuaaguuuuagcagaauguagucaugcaguacuuacugauuuauuggcaaaaguaaagaaaaacaaugcuauuauaauugugcuuccuuaaguguaggaauucauaauucacuaggauacuaguaguauaauuccuaagagaaguuauaccacucuuccaaucaaaaauaagguuucguaauuuucaauguauuaaccaacaaugaaauaguauaaggaacaguuggacaaggacaauaauucuuauaauuauuagcuuucaaauuacagaaguguugaauuagauaguacccuggacuuugcacacaugcucugauuuaaacaauucgcaaucuucacuaaagaaagucaguggguuuaucuucugauaugcugggugcuggcaaaagucauugcacuagaagcuauaaacugggauuauuguccacauuggcuauuuuuucaguuggauugccuugggcaugucacauuucuucucugaccuucuuucuucguaugucaauuucagaugauaauaccuguagacaacugaaaggucugugcccccuuaccuuugucuguacggccuugagcgcuuuauauuuuugcaagcuguaaguucauuuggugccuguugauugagagcccuuaaaaucaagcaacucuucucaccuaguaaagcagaaauaugucuauauauauagauauauguauauauauaugcauauauauauauaucacuagcauuccacuuuucuaagcauccauacauacguauauggauacacagccagcagugaaaugcuggcugucaacuuggccuucuuuucagccuaaauugauuugauuaaaggagaauguaagagucccucauauccccagguuuagaaaagaguucuuuacgugaaacuggcagcuggaaggaguuuaaacauuccuccagcuuuagaauuccuguaagauugaaaaagcuauaucaagucaaaauaugucaucaucaaauauucaagaggaauaauuucaauugugcaauuacuaagagagcacgguuucucugccuucuuaaggaaauaucuaguaggaagacuugaaaacagauaaagaggaagcaguaagugagacugaaauagaaauaaggagguacaacaagggucacauuaaaacccacuuaucagaugagagugugaguugucugggaccuagcagcccaugcccauagccugccagcuauccaauacaggcagagcauagagauucagaagcuauucaagucaaagcccaggccugaaugagggcacgauggcaagcaaggguggugcuagacaaagaagaauaccaaaaacccaacccacaagaagccaaaaauuuaagggacagagaaggaauagacagagugguucaagcagaggaacagugcaaauagaugucaaaggagacuugcgcuccagccaggacuaauuaacauuaucuaguucagugaagaggucugguaaaagaagaaacagaaagauggccacuggguucaguaauaugaacacuggguugaccucagugggaacagacucaggaaaggaggguggagggagaaggcuaaugaaaaugaauugacaagugacuaugagaggaggacaggcagugaguauagacucugcacagaugagcuuaacagaggcugacacacaguaugugaucaaaaacaugggaauaaagaagaaagaaagggauaaaagaaaagcagagaaauguauacuccagcguaagaagaaaaugccaugaggggcauggcagaaggaugaagaggcuaagguuucuaugggacucuuuuagguaaauugauaguuauguauuauucaaagacauguauccacgaauuaaauuacaagccugaagaaaacaacaaagagaaaggucucuucucccucuggacagauuauuugcaucuuuggcacauuuucuauucagucuaaauauuuauggagacaguuuuacuuggaguugcaccaucuccaucaagggauguuagcaacaugacaaagaaacagagaaagagaugaugaauguagggugugugauggggugggugggagugcuggggccaggagagcucgcugcauuucccaaaaagaugcuuugagggaaucuggccuuguggauaggaacgcauuaauuguaauccauggcaacaucucaagaugcaugaucagagugauucauuugcuauuagcuuuuucuuucucuaugcaugaugccauaguauugccagcaaugcugaccaggagggaaauuauugacaagaccuacucaccugugacuugcacaacaucugcaaucuggucauugucuaugucuguaucuccaucuccuccugcaguaaccucaauaacucuccuccaucccuacuggcuuuugcucuuuuucuuucuuuguuucuuuuuuucuuucuuucuuucuuuguuucuuucuuuuuuugauggagucucgcucugucacccaggcuggacuggagugcaguggcgcuaucucggcucacugcaagcucugccuccgggguucacaccauucugccacagccucccaaguagcugggacuacagacgccuggcuuuugcucuuuuucaaauacaucaagcugguuccugacuuaagacauugguccugguuuuuacucugccugggaagcagauauuugcaagguucuucccugucacuugcuuuaguucuuugaucaaaagacuuccccuugaagaggccuucccuggccacccuuguaaaaauaaaucuucaacccaauauuagucuguagaccuuugccuuguuaugggccugucacugcugcaaacuugaguaauauuuuguuuaguuacacuuguugcauuucucccaugaaggugaggaauauuuuugcuuucuuagugcugcaucccuuaauaacuggaagaguaucugacacagaagaggugucugcuaaauauuuguuguaggaaugaaauaaugagucacuuuaaucaauuaauccuccaggaagacaggaagacuccucuaauuucccagguugggguaggucuucucauauucacuucuauauccccccagcuauauauuacauaugauuguguaauaauguaugaaaacaagcuguucucauaucugacucuccaaacugcuccuaaguuccugaagcucaugaaccaggacugauuuaucuuugcaucuccagugucucccacagcaguauuguucacugaaaugaaggugaaaggcuuuauagaccaaaugauaauaaucaaugaaaaaaggagcugugggacaaaaaaggacucgagacuuagcaauggcuuaccuugaagaaagagagaugguucugccauacauuacauuauuuuuaaccaacuagcaaaauacauuaaauauccaugugaagugacgggccuugucagaauaagcauccugaacugagagucaggcaccaucuauucuggcccuagccuuugugugagucugagcaaggcccuucccuucucugagcccauucucaucuguaccaugagaagauuagaccaugggaugccuaaagguccuuccaauccuguguuccaggauucuauauaccuaggacagugaauggugcaauggaggaaaaaaaauguguacaguguguaaccuugcucucacaaaagccaaccaugcaggauuuggagucagaaacacaugggucuaaacccagagucugaaacuuaacaaacuuugugaacucagacaaauuucucaaucuacuuaagccuccaugaaauggaaauaguaauuccuaacuacacauucaauaaauaacaacuugcucugcacuucuuucccauacaucucauggcuggcuguuuuagccauguugacucgagaacgagaagguucuuuuauuaacaacauccuagcaguuuggauagcucaagcgcugcugcaccuccagcugacuccaacacuggaguagacagccucccucacaaggcuaaaguuuuccagucacucucuuuuggggccucugagcagacucuauuuguguuacccaggaaguuucuugagccauuucuuuugcuagaauuccacgguaaacauucuuacagaugacuuacugccugucacaacauucuacugcucucuuuccagaaagaauuccugcagaaugaggucagucgcuuacuaaccgugacuucuauuucuuucaccccuuuuggucuugccauuaagaugcugagugacugacucuggcuaccuuaaugggucacuuccaacagcugugggagcaaaauguuccaacaguucaagacagagcccagaggauccacaagaugaagaacagacuccaaauacaaucagagggccaauggggaaauuccaaguuuguagauccaguaaccauggaggggaacuaagaaguucuuagauauguuucuaaaagauuuggaaauguauagagugcaaagaugcuugccuucuuauaaacauucuuauucaucaauggccccgcgaugcaggaauguuguuucuuuuuucuaugcuuccaaagugcuggaggcccuuaaaggaauugugauaaggacauuauagaauauacaacuccuacuggaaagggcggcagcagcucccucuccccagcuaugggggagcacaaaccaggggccuucagguaaacaccucucacuauuucccucaagaggaaaaugggugucuccuuugaccucagagugagugcacaggaauaugcuccuucucauaaucucauauugcugaauuaugaauacauuugcuacaucacuuuaucuuucaugucauauagcucaugcuugacacauaauguugcagaagugauggcuuuuaguuugaacuaaagacuauuggccaacccugauuuaggaaaccguuccuauucccaucucuaguagauaauaauuucucugugguugcuuacuaaacuaacacuucaaaaaggcaacagaggaacuauauugcaaucaaucuaucgucuacucaguuauucaacagaccuuuacagagccucuaggagaagcaaaggcucuuacacuguacuacuugaauuucaaccccagccacuaaccucucugauucucagcuuccuaaaucaugaaaugguaauaauaacagaaucuaucuccuaggguuguuaguaggauuaagagucaugucaacuuuacuacauguaauaaagugccugacauugucugugcugugauguucaguggguuagguguauuaaaugcauuuuugacuuaugauagguuuaacuuaugauggguuuauugggauguaaucccaccauaagucgaggagcagcuguacucaguucucuaguaugauagaacaugggauccuugaggauggaauuuuaugugauuuacuauuauguucuuugugcccagcacaauuaccaacacaggguaaauacuuaauuaguauuuuucaaaugauggcaugaaugaacaaacaauaaauauagaguaaaaugcuugagaggaacuccuuuauuuaaggugguguuuuuauuucagagggaugauuuuauucacaaauauuguggggacaaacucuuugggguugauuuuguccgaaacaaucuauagggcuuuuuacauaaagaauuuccccaugauuuucaguuacauggauccagacuggggacacauguuugguauuuuauaaaugggaggaaaaaaaaaagaaaaauuccagagaagcaucaagcugagcccaagugauaagagaaauaccuaaagaaggaacaacauugaaagaaauuuuuugaaaauauucaaaguauauaaaucauucugaaaccaugguguccugguaagaaacacagaauagaaaaaaaaauuauuuucuucugugcuaauauuucaucauaacuggcagcucaaaacccuugagagccuggaguuugaagaucuuugagaugggagcuggaaggacugaucucagagcacuaccuuggagccaguucucgggaaaaccacagcacacuguguggcuuucuggaacccuuguggagaccucucauuauaguacaguuucaaggaggagacagggcucccucagggggcugacugacaagagaaacaguuaaaggauaaagucauacuaggcauggcgccaaaacccaaguaguccuuggggucuaucaaccaggcugucaggagccugccacucagucauuccugcagcacccuucaugccuaugacuuuacuuaggcaacugagaccccagucucugccuaacacuaugugacaugauggguagcaagagauguaaaucugaaugcugguuccgucacuaugcguggcuuaccuuagcugaacuucaaaauucuugucugggaauuuaaaaagaaagaagggaaaaaaaggagaaaggaaggaaagaaaggagaaaagaaaaaagaggagagagggagggagaaacaaagaaaaagaaagaaaagaaauaaggguaagugaagggaaagggggaaggggguagaggaaagggaagggaagagaaggggagggaaggggaggaaaaggagaaggggaggggaggggagaagggaggggaaaagggaagggaaaggagaaggggaggggaguggaggggagaagggaagggaaggggagaagggaaggggaggggaggagaggagaggagagaggagaagguggaagggaagggaagggaagggggaagggagaggaagggaagggaagggaagagaagagaggggaaggguagaaaagggaaggggaggggaggggagggaagggaaagggagggaaagggagggaaggagagggaaagggaggggaggggaggggagggugagaaggagaaagagggaagagaagagaagagaagggggacaggaagggaagagaagggaagggggaagggaaggacaaagggaaugaaaggggagggaaagaggaagggaaggggagagaagggggaagggaagggaagggcaagacaauaaaagaggaaagaaaggaaauuauuauaaugauuaaguggaaucauaaauuuaaagcaugguuccuagcacacagcauaacuuuguuaaauauuagugcccuugccuacauucacucauuguccgcauaagggucuuucagaauccccuuguuacuuagcucaaaaucggugcuacaugcauauaaauucacccuacugcuuguccccagaugaauaagauuuaauuaacacuuaacauuuugguacuugcucacuuuggugggaguauggaggaguuucucuuccuguugaacacaccaugcucaccuggaaauguccuugaugacaacuucccucauugauugcaaaauauuuuaauacuuuugagcuuaagcuuagauaaacuggaaucccaguguucuaaaagauagguuugggaucagucaggucuaaaugaaaucucaguuuuaccaauuaccaguugugugguucuggaagcauuacuuaaucucugagacccaauuucguuagcuauaaauaaagauaauauauauaccccacagaguuaaaauauuaaauaucaucauguacauuaaauuguccaacacaggugcucaugaaauucauucauccauucaauaaauagguaucaagcaccuccaauguauaaggagguauucuaggaacugaugaugcaguuuuaaacuaaacaauauuucugccuucguggagccauuucuuucaguuaaaaaaaugcuaugaagcaaaagaaugcagaauaauaggauggacagcaauaguaaugguguugcuagaaauaaacacuagauccuuuuucccuguguucacacaguucuccucuuuuugaaucccaaacucuccugcccacugaccacaggucuccagggaggaugaauaaaggguuagauucuguugaauugagucaucugacaucauuuaaauaaaguuguggacaccaauagaagaguacauggucaucaacaggacggauagaguugggugucgcuuuggagacccuuggagaugcacagcuaugcucggucuccaggcuugucauaguugaaacuacagaggcgauucuuggagaaggacauuuccccccaaagaggcaguccucaauaaugccaucuuuguugcagcagaacaucggcaaccuuguucugagcugaguccaaguugaggggaaagaggggaacagccagcugugaaaagaucaauuuguuuccaauccauucuuucuuaugguuagagaggcuggcuccccacacuggcugggucugucagggacagaugccaaguagggcacagacugaagaaacacccccuguucccacugaagcaggagcauucagccucugcucugaguaagccucagagucuauggcauuagccauccccuaguuagguugcuuuggggagacacaaguuggggcagaugagagggacgccccaagucuaauucaaaacuacaauuauucaaacccuccauuuauuuauguuuguaaauacccaguguuggcagguugugggaaagcagggguuaccauauaccauagcugagaguguaaauugguauaaccucuuaagaaaaccauuuggcagaaucuauggaaauugaaagugcauagacccuauguuacagacagucuacuucuaggaauuuauccuucagauaaauucucagaagugcacccagaugaaugcacaaggaggauguuuauuacagcauuguuugucacagaaaaaguccagaaucaacugaacauuauguuguagaguaaaagaaugagccacacauagaaagaggucugagagaaaaaggaggaaggaauauucaguuugguaugcaugguaaaaaucuauuuauuauacauaaaguuaaccccugcaucaacauguauguuuuacauccuguuggaucucugcuaauaccucugucuguuccuaccccuaucccaagauucaauaauacaaggcaagaagacuccuguacggcccuguggaugugcaagaugcuaagaaugaguggauauuacagauagauguaaaaguaggaaccuugccagccucuauuaccuuuccucaguagaucugucuuccugggccagggugagguagaaacaauagcuagaugaguaaucaguggcuuguauggcuuggcauuuuuccugagcucccuuuggagagggaacuaagaccauacucaguauuuucagguuuucagucucuucauaauugacggcccauucccuccucuuaucaaauugcacagagaucaaaugugaaggagccugaaagaaaggacagcguguauugcucaauuaagaauuugcucccuuccagcucuaaaacauccccaaauuuuccaguugcaaauguuaccaaauuuacaaugaccaccaaauguugaauaaaacauauguaauucuacccauccuggcaauaauucacuguggaguuuuggucaagcuuccugcucucagucagccucaguuuucccugugguucaugugauaaggacuauguaccuaggggggcaagagcagaucaccugugccccucucucccugcuuccucugacaggcauagcuaaucaaucacaacaugcuuuccuacagaucucagaugauuccucugacuacuucuugacacagaauuguaagcaaucacaaauauuuaauccaaauugauguaaaagucaacauuuaauuguccucuccauacuagaugauaucugaaguucauuccagauuuaacauucuguuuccacaauucaaggauucauuugaacgccagcucguucaugaagucaaccuagauugcugaagaacaaguuaauuuuuccuguuucugacuuauggagacagagcuauauaagucgauaugaacuugacuucugguuucuuugcauuguuaucucauugucaccuguauaacaaugcugccuccauggggaaauuuaauuuaaguauagaaaguacaucccauauaauaauuuucagacugugaugcauaguacccccagaguuacucaaagauuuuccaugggcucuaguuggcagagauaaggaaauuuucagauucucagcuuucauuugcacucuuucucaggaaucugaagagagucccuuuuucguaaaugcuuuucucucacuuuacaaauggaauucauaccucucacucaucucgaguugcuuugggguauaaaaauuucugggggaccaaacaaagguacaacucaaaauucuuucgagaaaaaguguugagaaagugaaugacuaaugaccuugcagcaaaucauucugcaagucagaugacuuucaaugcuuuaguuacaacaaaacugaaggggaaccuaauuaaaaugucaccugagaaaguauuaaaaauccuauuugaugauugaucuuuaugugauuuuuggcauacaaccugguaagaaguuauaacacugcuauaagaaaaguuuuucuuuucccaucuacuuauuuuugugaauagguuucucagugcuuacaaccaaaaaaugaaaaguaaauaaaauuuaugaaauaccaucucacguuagcaauaaugaauauuccucagcagacauauggccuaauuuuuuaaaaaguucaccucauucagagaagcauuucuaauaaaaccuuauguuucacaucacauuuagcaaaauuuuaauaaguguaugguagauugaucaguuguauacaucuaauaauuguuaugauaauuuaauccagaagaaauuggguuuuguuagcaucuuauauuuacagaacauuaaagaaauuuuaauaugaauuuauauacauguuuuguuucagaauaauauaacaacaugaucagugaaagaauuuccaguauaaaaaaauauacuacauuaggaaacauuucuauagagcaaaugaaauggaaauaaacauuuaaggaaaacaaaagaacuauguaaguuuucaacuguuagggaagauucuacuuguauauuuuuaaauggaugaauggugguaucaaauuaaaguggaauuucaauccauuaaaucuauuuauaauaguuaguuuuauuuuaaaugacuauauauucaauauacuuuacauuauaucccucacaacuauuuaaacuuuuauaauaaaagcacuugucaacuuaaaaacguucauauuuuuccaagaauauuuuagagagcauuaaagcgaacuacuaaggacuguauuuuaucagagugaauucacuucaauaauuauaauaggggaaucaaaugguaguuguuuaagaaaauccaauguacugauggacaaaucuguauaaaggacgugagaaugacacauuuucuaaguauaaauguuacacgucaaguuugggcugcaauuggacuaagucuacacuuccuuauuuauccucagccagccaauccaggucuuauagcccuacccuuugaccuaugcuacccuguguaacugguucccuaauuuggauuagaaaacugaaagauuuucaaacucuaggucuuuguugauagauuuaaaaaaaaaucucuuuaauuauaguauauaauucuagugccuaggaaucaaugccuuaucuaggaaacacaagccaagcaauauguagcugcaucauuucuuaggauauuccuuccuuuuuuggucaguucugaugcucucuuuucugagcagauugcugagcuggggugaaggcaaggcaaagcaagaagguggugggaggaaaaaagguaugucaucuaccuacuguuguuucaguuuuaacuugaaucugcuuauccacugauucauucaguaaaguuuuccuaaacacuuacucugcgccacguucuggguuaggauugggggcuaccaaggccaagaagguacagguuuuucccuugaagagucacaguuuacuaagggaaagaugaacucaacaaauaauugagaugcucugcaauaagcucuauauuagaaaaaacucaagguuccagggaucagaggauagaaugaucaauucuauaagaggugguaauauuugagcaaagccuuaauuaaggaguaagaacugaggacagucccagcagaagguacagcacacauuuuagcauggggccauauguggucaugacauuuugauaaauagaaaauauaucauaucuaaagcagaggguagagucagcaccuagcagguggaggcaggagauaaggcuaaagaagcaaguuggggauaggucacaaagggccaugaaaguugucuuagucuuuucagguggcuguaacggaauaccauacaguggguggcuuauaaacaacagaaauguauugcucacaguucuagaggcugggaaguccaagauuaaggcagcaguagauucagugucuagugagggccccuuccuggugucuucuugcugugcccuuauauaguggaagaagaaaggcggcuaucuggggucucuuuuaugaaggcauuagucccauucaugaggacuccaccucaugacuuaaucaccuuucaaaggccccaccuccaaauaccaucacauugaggauuugguuucaacaugaacuuggagaggacacaaacauucagacucuagaaagccuuacucaacauuugaaaauugaacuugauccuuugggcaacaggaaggaacaugaugagauaaagacuuuagaaugauaauccgagguuagaggacaugagaaaaaugccuaaugcagcacaggauacagauucuccaaaaaacuuuaauugaccuuucaacuucccuuucucccuuaaagaaagcagggcucugaauccccaagacaaagugcauccaguauuauauacugagaagagaaaaugaaccaagaauaagguaagaacuauucauuuguuuuaucaguauuuaucaggugccuacucauguacauauaauucugcuuuuuuuuuucucuuaaacaaauuugucaaauaagagcuauggccccuacuuuaucaaaguggacacugaaucacagauggcuucaguaacuuguccaagcucacauagcuaauuaagaaugagccuauuuacaaauccagcagucugacuuacaugcacuuaaccauggugccaucccucuguaagcaauauuauuauuuuacugcuguggacugugagaauaaagacaugccaaaccaauaggguaagggccucuaagagaugaacuuugccugcuguuagcuccaucuuaagugagagggugauauauguaugugcuggcaggccaagucuggagauaaggagagcacaggcacgguuuccugcugaggccaggucuacaacagaauuuuuuuguuucgauugccucuauuccuaagcuggaacuaccaggcccaaacaacagucacuucucccucuucucccuaccugccaauuccauuucaggauauuacuucucucuacucuuuacccauaucccaucaaucaccaaacccuugcaaguuugucuuuaauaucacuagacucugcccaauucccuccaucccugcaacucccacccugguuugagccaccauccuuucuugcuuaaaugacuacagcagccccuugcuggucucuccaacuccaaucugcuugcaauucugcuucacaauuauagccaagaugauauuuuucaagcacaaaucuaucuuuauuccuccuuguugacauccaaaaauggccuccuauaacuuuucuagaaaagaagaguucaaaauccuucccagggcucucaagguccuacaugagauucugccaauuucaucugucucauccaaacccucccuccauuccugacccucacuccauggacuuuccccaaaugcagcaugcuguuucuccucuucacacucugguauggauagacaucucugccucucucccacugccuccuuucuucccuuuuccucccaagcucuaaaucauauucaagauucuguucaaguguaauccucucuagcaagccuuccuuccccacacccugagccacuauuaguuccuaaauccuguacuuucccuuuaaugacauugaucacaauggguuaccauugucacuuugcuugucugucuccuguucuaagcuaugagccccuuaaggacaaacccccugguucaucuaaauuccucacuucccagcacaauacucaaugcauagcaagagacaggcaaauagguguuaaacaaaugaauaaauauucucauuaucaucuuuaacuccuaaugaauauuauacauucuccuaguagaugcuaugcauuugcaaacuggaugauuacaaaaguuaagugaacuugaacauugccauuaacucauuagggccacccccagccucucucuuucaaguauggucaauguggcuuuauaauugccauaagaccaaguuccguuuagugggggaaacccacauauccagcucauuggcaacuagggcuagcaaaugcuccugccacaguuuuaaaagucugaacagucugucugaccauaggugagaacaggugaauuuuucacaucugcacuucacaacagaaaagaauccacuccaaacucugugaaagaagagcucuuguagcauuuccuuuugggggguggggauuuuccaauagaucaggcuccagacuacugaauggaaacuauuuccucacucuucccuccauccccccaacauacacacacacacacacacacacauacacacacacacacacacacacacacagaugucuaaaaauuuuucugaaaucagggauugacucaaggaaaggauguguuucauuagcuguuccaucaaaggaaagagacacggagucugcuaaaggucaagagagaagaagagaaggagccgaacaccgguggcccagaugcccaggcccugccccucauugugacacacagcuguuuggaagcacaguguugcaaaucugauccuaaaauauuucaugacgucgcuggcguucuuucuaucacgaugaagcacagaacaauacauguccuuuacuucacaguaaaugccuguggcaggagcccaaaauauuuaaugcucugacuccuuugauacaacacuguugagauuuccuagcauauuuuuuuuuaauauaagaugaaccuuggauggagauugccuuacuucaguagggaaaagaaauaguccaagaauuucaauaaaacucacuuuguucuuaccauauucagagaacuguuaugucacguugguggagcauacagagcuaaauaaaggcauaaauuuuaagcccuccaggaguuuaaaaucucagaaccuccauuuuacucauuuuuguuauuuuuuuuuucagagacagggucuugcuauguugcccaggcuagacuugaacuccugggcucaugcgauccucccaccucagccuucugagucacaggaguacaggaacaugccaucacacccaguuuuauuuuuaauauggggcugguaacaucugcccauagucaauuugggaagauuccaugaacaagaauuuauaaaacaauuaucccagugccugccacauagagguucauaauaaauguugcucuccuuauuuuauaaucucaugagaggggaacauaagaaagcaauuacuuaggauccuggcaaaguaggguaaucaaggaauagagauaaaacuaaaauauaaagcgguauucugggcuaaauauggaggaaugauuuauggaucagguggcauuuuguugcauauuagaagauguaauggcauuuuagauagaaugggaaggcuaucuucucagaagucuauguaacugaagugcaucauuugagcauaaaaagaaacacuuccuggcuucgcuagucauuauugugucauuuguuaacauuaucaaaucuuuuccauguggcucugcuuccuauccaaaaauagcuuacaaacgagaaguuuagauucuaguucccaaagaauccucauccccuguaucuuccauagaugcugguggcgggaaggugcuaaaucucuucauaguaacuauacagugagucuaucuuccucucugaagaaaggaaacagcuaucuaguucccugagcauggagggaggaaggacaucauuguauaggagaauccuuggcaaaacagaaucguaccuaaguagguagagaaucagugcccacuccggcaugcaucauagccaugagagacuagaauguguagcagauguuguauguggacuacggccucaaggaucacuugacuagaagucccuaaccuagugccaagcacacugggguggcugguggugccgaaaucccuauggaagaccagcaaguucucauaaggguuagcugugggcaguucccuuguauauugugaaaaucucuauuccuaaguggacauuguuauuuuugggaggucagaaaaaccgaauaaaugcacacugcuuagcacacaguacucaucaugaucucuccccuauggaucaugugcccaucucucccaaacuacucacugcuccugaagucucuucuaugccucuuugcuuuugcauaugcuguauauucuaccagauuauccuucccaaacuacuuugcuuugaggauguuucaaaacucagagauaaaucagcuaauccucccuauagccuggguuagacaaccuacaucuagcauguaccuaccucagucacaggauuuauucugcugcauuguaauaacauuguuccuugucuuguuuucacacuugacuguaagcuucuugaagagcagguacugaauguuuaggucccugguuccuagcguaguaucuaguaaaagggaacaccuggaauuugaggcaggaggcagcauguguauauuggaaaggcauagaauucaugcccaggugagagaugagaggcuuugguaacucauuuuaccuguuucacccauuugcuaaagagcaacaacaagaggaaucagaaaugcuuccaucacuccucaguugcuggaagaucuuggauuagucaugcuuucugcaaaacauuagcuaucuucucacucgaaccaaacuaaaccauuuaguaagaagcaucuggcuuagugguuaagacuuaggucuugcaggaagugagagaggaguaggaauccuggcuuuuccacuuaguagcuguggcccugaagugagccagcuuugcugaucuuccauuacaucugcuuucaaguggagaagcuaaucuacacaucaucguuuuagaauuacaugaggcaauacuuguuaaacacauaacacaguacuuauguuauuauaacugcucaaaaauuaauagccauuuugacucuuuuacauugcuauaggcugaauauuuguaucccccuaaaauuauguugaaauauaauccccaaugugaugguaguuagagguggaaccaccggcaggaagguggugagggcagugcccucaugaaggaauuaaugcccucaugaaaaagggcucagagagcuuucuugucccuucugucaagugaggacacagcaagaauauggcugucuaugaaccaggaagcagguccucaccaaacacugaauuugcugguaccuugauccugaacuucccagccuccagaacuauaagaaauaacauuuauauuguuuauaagccacccagucugugguguucuaacagccuauaacaaagacacguaugaaauacagacgcccuggagaucucuauaauuuauauauuucuucaaaaagacuacggaauauuuaucaccugucauaauaaacacaagaaauaaagacagaaauauccaggcaccauuuucaacagaagauaccaauauccuuuuggcuuuuucuguuucucagcuuuuguccuuuugagagauagaaccacaaacaagccccucuccuccuguguguuggggugagcuuggguccuggaaggugaaaggccagcccagagcucaucaagcaacuuuggucucucagagccagagcugcuggcgauguaauccaaucuggcugcagagaaugugacuaaacgaaaccccaucugcugcgagguuucccuggguucccaggagggaccugagcaggauaugaggcggcggcgguggugaggugaggggucugcaaggaaauggugcgaucccccauguguaaugugucucaccgcaggccagcgugggucucccccagcaugacaucaucuuggagcucacccgggcuccggucugcuagccgcuauaaaccaggguuucucaaucucagcacuauugacauuuuucagcuggauaauucuuuguugagaaguguggggggaacugcccugugcauuguaggagguacagcagcaucccugaccuccauucacuaguugucaauagcaucuccacccagccuaguugugacagcccaaaaugucuccagucauuuccaaacaaugggggacaaaauugccccccgucgagaacgagaaccacuggcaccgaaaaaguggaacaaaucagacucccuuucuauuaaaagcaagggaaaaaaauccagaaaaaaauagaauacaguaaguuuccaacuccuuauguaguuuuagaaaugaauuaaaaguugagcagcuagcuuugaugguucaggugagagccuuccaauaaagaggaaaaccuagaagugauaauaaguaccaucuacuuagugcuuucuguguccuaggcauggugcuaagcgcuuuaacucauugaccccucaaaagaacacugaagguaggcgucugaucucccugucauagguaaggacucugaggcccagaggugugaaagucuugccuagaagcauauagcuaguaaggacugagaugggauuugaacacagcucugcaugauuuuaagggaacucagagccauuugguucucuuaguccauuacucuggagucuguauccaauaccauaaaaauuucaagaucugugcuuuaaaccagggaguauuuaauaggaacuucuacauccagcaucagccuagacagaagguggguggauuugagugggagaaucagacuuuccauguccuuacuuaaacaagacuaauccacauuuauaaaucaacaugagauaguauauaauuaaccccuauaugggugguagauguuaaaggaguauaaaguaaauaacaggcugaauagaaagaaugcguuuuaauaagcaugcuucuaauaaauuagugaaacugucucugaaugugguggcucauaucucaugaggcucccuuaugaggacuuggagugaagugcaugggcuuggcguuggacaauucuggcuucuaaucccagcuccaaaacuuaccagccggguggcuuuuggcaaaacacuuuacagcuggaagccucaguaaacuccuuagcaaaauacagauuaaaauacuuauuucaggauugaugggauuaacuaaaaccaggaaguggaaacuaauauagagugucucauaggcaauugacuuuucuuucauugcacucauagcucuuuggaauuacauguuuauuuguguauuuguguguuuaaugguugucucuuuuauucucugccucuucagaaccucccauaguacuuggcauauaguaaguacuuauuuaaaauaugcucaaugcauaguaaacauuagugcacuuucuuucucuguaguuccuucuaugacaaugaguuuucggacauuaaaaauacucaagcaauggaaauauaagauucucuaucucuuugugucccaaucauagccucuuauggugacuguacugcagcacuuaugacauuguuuuacaauuacuguuucuuugguuauaaacuccuucagggcuggauggaucacuuuauuuuuuauuuuuuuauuuuuauuuuuugagauggagucuugcucugucacccaggcuggagugcaguggugcaaucucagcucacugcaagcuccgccucccggguucaugccauucuccugccucagccuccucaguagcugggauuacaggcgcccgccaccauggauggaucacuuucaaucccuaugacauggucccauuacuugcagccaaggugugauacaugucugaaucuaacaaguauuuguaaaauaaagauauugaugccuuagggggcauuggcccacugaauuggaguuccaaaaaaauuauaguuccaggcuuuggcaacccuaacuacugccaacccugcucauacaacaucuaaucaccaagaacaaaagguuggggcuguuauuuuuauuguuccagaaaaguguagauaauuaauaacucuguauugaauuuaauuggcugcuuuuacaaggaaaguugugagccaaauuuuccauauccaagcuagcaccucaaaggugauuagauucugccauaaauucuuauaacaaauauuuauagagugcuuaguaugagccagccacuguucaagguaccgguuaaaucuuguuggauauuuuaaggcuuggagaaugauuuugacauugagcauucuucucaguuacccaaaggaaaccagcuguuucuauuggauugcuugaggcagacagcaauaaggggcucaggagucuuggagacaaauucuuaaaccucuggucucagcauccugguccuuggagaagggaacaucuaauauacgaaggaaacaguuuauaagccaagccguauauacuuccuaacuagagguuagcauccaaaacagaaugcuuaggcauuggaaaguuuaucauacccaugggucucaucuccucaucaugcaacuuucauaaaaacagggaaagcuauuacuucaacugcaauuguuuucuuuugaaagaaagaaaacuaccaauuucuguggcuggccagagaagcugggagauauauauaucuccucauaauggguacauuacaauacuugaggguaagauauaucucacuucuuuauuucuuucaaccaugccauacuccuuugugacgguagaaaauucagucucagcuguguugaguguugcuucucuuguccacuaguuuauucaauaaucuagaagucuuacauggccuagaacauuuaggaaccaguugcaugccccauuccucucuggccauggcagauauccucaguuuugggucugcaccccuagaagugaguagcucugcuucuuccaucuccaaauaugauauugggauccuggugacucacucaggacacagccccucugaaugcacucuguggcaugaccaguucaagucuccuuacuuccuaagacacugcauuagaagagaguguuuaucccaucucaugaaaccugugucucuacacacuaucccauugcaugucuguuggguuaguucugcccaaggucauaaauguuagagugauucugggguccaaguucaggucuuuucaaucucuauguuggauauuugucacgauucaacauccuacauccucacuagaucagcauuauucaaacagcacuauugacauuuugggacaaagaauuauuuguugugggagaccauccucugcauugcagacuuuuaguagaaucucuggccucugcccacuugaugcccauagcaaaccuccaaacuccgacagccaaaaugccugcagacauuagcaaauauccucuagagaguaaaccaucccugguugagaaacauugcccuagaagguaagcucaaaaggaaagugauuacaucuguuguguuuguggcuauaucgccaauagcuauuagcacagggccuguguaucccaucaaucuaagugcaaugaagaaaugguuggaagaauuagucaacaaaauaaauacaaauaaauauuaucaugcccuuuccuuucuuccucuucuuuuucuuucccuucuuuuucuuuccuucaacaaggaaaguaaagcaguaaaacauugauaugguuugacuauguccgcaccuaaaucucaucuuaaauuguagcucccauaauucccaugugucaugggagagacuggugagguaauugaaucaugggggugggucuuucccaugcuguucucgugauagugaauaagucucaugagagcugaugguuuuaaaaaggggaguucccaggccaggcgcgguggcuaaugccuguaaucucagcacuuugggaggccaagaugggcagaucacaaggucagaagauggagacuauccuggcuaacacggugaaacaccaucucuacuaaaaauacaaaaaauuagcuggguaugguggcaugcgccuguagucccagcuacuugggaggcugaggcaggagaaucacuugaaccugggagacagagguugcagugagccgagaucaugccacugcacuccagccugggagacagagcaaaacucccucucaaaaaaagaaaaaaaaaaaaggaugggggggaguucuccugcacaugcucucucuugucugccaccauguaagaugagacuauuuugcuccuccuucgccucccaucaugauugugaggccuccccagccaugugaaacugugagucaauuaaaccucuuuccuuuauaaauuauccagucucugguaugucuuuauuagcagcauagaauggauuaauacaaacauccucugcaggaaaacauagugaagaggauccugugcaacauguaaagaguuuuggguccuaaucccauaucugacaccagcuauuuauuauugaucaaguaacuuccucuugcgcaugccuucauuugggacuaauaauaguaucuauccauagaaauguuaugaagauuaaaugaaguuaauguauguaaaguucuaaaaaugguauccagcacauaauaaaugcucaauaaaaauuaacaaucacuauuuacagaagauccccugugucauagaagugauagcguaaaacuccauucccuuccauggggcucauuagauagcaacuauccauucacauguuugcccagguguagucucaagaacaccaugccuuuuaccccugcuaucuggucaucuccauggcucucuaagggccuaaaccugaacucugauacacaauaucagcuugugacaucucuuuuauugggugucuuccugcucuaccuagguucuaccaugguguugauaucaguacaguauccacagaugggagaaaaaaauucaucugccaaccauggcugucagaacugcaagcaugggguuaacucacuguccuucacaaauacccugccccauaccaaccuggccugucuuuccaucgcaagagugacggugggcaaaaccuuuuuaaauuuagccaaggucuggucuggaauuugucuuugucacagauuuggugauagggcuuauacuguauuaaguuuaaucauauuaaaguaucauuuuuguaggucaaauauggcugaacaggagcaauuucauaugaauuacuucuuagauuaacugagcaaacaagauugcaacuugcuaaaagccaaaguacuuccacuuccuucaaaagcaaccacuuaugacugauuucugcucauuaagccagacucucggaagaucucuccuuggcaauacuuuacuaguuuaaaggagccacuggcaaaauauacuucaaaguaagcuucccuggauuggucuuccacaaugcagcugucucacugauucauccuggccccugcccacuccuguccauggggauuaucaaacuuucaccauaauuuccuuauauaguauuuccacaagggaaauccaucaucugucucaaacgaugagucaucuaucuauauucacccaagagcacuccccauauaccauucaucugcaaguugagcccaaugugggccugggcagguguuccaaagcauuuagaaagucuuugaaguucuccuacagaggcugcuuucugauacagugucugaaaaacuugccuggcaucucacuagggggcuucuuugguccucugauaccacagccacaucgaugagagcacugcacacauccaaaaccggagaaaagcaggagagagagagaagcaacauuauacugcucacggaagcucagagggaguagagagccugguguguguucaccuacuccucucgguccccuuuuuauguccuuucuaagugaagaagcccaauccguguaaaggauuuuuuuuaagcaauaaauuccuuugauuuuggcugguucuacaccaaucuaggcaagcuucuuccuccauguggaacauaguuucacaaaugagcagaccuggauuuuagcucagagugggcaagacaagcaacugcuuugggccccauuuucuuaucucuaacuugagcaggauugucucauagcucuuuucacacuugucaaagugugcugugggugaauccucugaauuauggaugagcagggacccagauaagccugccacuugcuggguucagacugacccuggaaugauaggaaugucauguauaaguccagauuuacuccucacugugggcuaaaccacucgacacugcaaagcucccaugucaacaggccacuucaaaacugucgggcuaaugauggagguugcaacucccuccaacuucccuuuccuucucugucuuucagccuacaacuaaaaugucauguuaaaggagcugugacaaaaaaaacuacuugaaaaucuagcaaugugcauuuacaucauagaacuacaucucuauggaaaagcauuccaguuucaagguaaguuaaugccauuucucccagaaaauaaucucuuggaccaauacuaaccauuaccauuuuuaaaaauucauuacuuuuuguagguacauaguagguguauauauuuacaggguacaugagagguuuuguuuaauaaucaugucauguaaaaugcgguauucauccccuuaagcauuuauccuuuguguuacaaauaauccgauuacacucuuuuaguuauuuuuaaauguacauuuaaauuauuacugacuauagucacccuguugugcuaucaaaauacuacaucuuauuuacucuuccuaauuauuuuuuguacuuauuaaccauccccaccccccagcccuccucccagaaccuucccagacucugguaaccauccuucugcucucuaucuccaugaguucaaguuaagcauuccuguuuuuaaggcccuguuaugcacaacacaaagauacuuucccauuuauuucuuguauuaguuuuauauugcuacucuaacaaguuaccacaaacuuaaugacuuaauaacacagaaauguauucucuuacaacuauggagaccagaggucugaagugaguuuuaguaagcuaaaauccaguugucaacaggccuggucuuucugggggcuccaagggagaauccauucuuugccucuuucaguuucuggugucugcuggcauuccuuggcuuguggccacaucacuccaaucucuguuccuuggucacacugccuucuccuccucuguagucaaaucucucucugccuuccucuuauaaagacacuuuuaaguauaugcaaaauagucuccccaccucaagauccuuaacuuagucacaacuccaaagucuucuuugccauacaagauaauauucacagauuccauggauucaaacacacaucuugggaauccuuacucaguuucccauggcccuuccuuuaucccuguaaaauaaguauucucacuccucuuuuacagacucagauacaagauggggucacauaagugaaggaaauugaaaaaaggucaaacacuaauaaaugguagagcuaagauugaucccaucugucuaguaucagaucaugagcuucuucuuuauaccacuguaccccauaaaacugauaaaauaauacucuuuauagaugguucuguaauggaaaccugaagagcccaguagcucaguaauuuucauaugcggaccuucugugagaccacauacaagcugugugacuuucagcaagucucuugaucccuccucaccucagcuuucucacuuguauuaggggaauggccuggcgugaggacugagauaaugccaaugccuugucauguuauuagcaaauacaaguggguauauuugucaccaccccuaccauuggaaggcuguggggcaaggaaguagucaagguuaggacugccuaguaugugcucacuaaaauaaggagggucaauuuacucuccuccuuaggaaggguaagggacaaagggccagcccagaguacuucccaaggaggagagugacucaaauaccuaugugaugccaauccaucaaccucuaggcccugccgagggagcuucuggcucugaggcaagugaaaccacccagcugacucuggauaggguaaauuuuuccaccugagaaacagaauguacaaggcuugaaagacgauuaaaaauaauaaugccugcuauugacuggaugggcaaauguaguucuacuuuucaaaggaaguucaaacuauuucucucucagagcaauacuaaacaucccuucaguaaaauacucauuucaaugagcucucucucucugugugugugugugugugugugugugcgugcgugcauguguacugcauguguauagcaggauggaggggaaauuuaugaagaauauuagagcacacagggugacuaguacaguucggucaaucugaaaaucuuaugucccaugaugaaaagagcuguauauuuuuauuugcauguacauuuguuuuauuaacccuucuuauuuuagugagcacauuucugaaacauaccucugacauuaucuuuuccaucauuuuacagaugagaaaguaaaggcucacaguagaauaagugacuuaucuacaauagccaaaggccacuauuuugagauuacuuagaauguggcaagcaacggcauaagcauuugacuaaguauuguucuuuuaauccugagacuagcuccaaggaguaucaguuaucauuguacccguuuuacagauggagaacuuauaagaaagguguuaaguaauuuacccaagguccuacuccuuuuuguagcuauuauugguuaaauuaagguuugaaaccaagugcaugcuagguaaucccaaaacuccaggauuggcacaaauagacagggacaaaggaaaauaaccaaagacaaccuugccuccucagaucuuuaugugcaagcuccaaaucacucaaucuaguucaugaaucaaagaaugccaucuuugccuuugggcaauuguuacauuaaauacauaagaaagcacccauaauaauagacaacugggagcuggaguccucuugguggguuugaauccucuugcuacuauuuauuacccaugcacccuggacauuucccuaaccucuccaugucucacaccccccaucugcaaaaugggaacaaugauaggacuaacccaaaggcucauuguaaagauuaaauaauuuaauacauccaaacugcuucaagagugccuagaucacagaaaauacucaaucaguguuagccacuguuauucuuugugguccacaaaagaaaucuuaagaaaccuaagagagaaggaaaacaagcaaauuauacuuccucacaaguauccaacccagcuguggaaaaucaaagaaagaaauucaauuugcauugauuucaaagcuauauauucccucugugaccuguauuaagcccaagaugguuugagccauuuguauucaucaccucagccugagcucagaccgguaaacaugaucaaaacugccuccgagcccucuguuggaaauauacaacuccacaucuucuaauuuagcuugggcaaugcuaguuuuuuaaacuuuuccucuuucccuucaaccuccgaagaggcagccuuuugaauauuuuaacaagacagcaccagguggcuucaacuccccucucccugcugccagccccugcaaagcccagaagugcuucagauagaagcuggguuccgugcuuucauaaacacaauauagcuaugcagagauugagcuuuuuguugggauuugggggguggggggcggggaagggaacuacaucauuuagcaucaaaaaacucuacauagggcaucccagcuuacuaagcacuuugucuuacacccucuuacuuggucuucauaccaauuuugaaagguacucaagguacagauuuuuaucucaguuuuauaaaacaggaaaccagaugaaucccaagaagaagaggaggagcuucagagaggggacaugcuuuucucaagguaauucacauuguaagcaguugggccaaauagaacccaagacugugugcuaauaucauauauuuuccauuaugcagccaauuaguugaucagucaaucauuucauaggaacauuaaucaaccuccaagugcuuugggucuguacaggugaaaagcacaguccuuggccucaaggaguccucacagaccagcugggcaaaugaaugaguaaauugaugauaacaauuaaggucucuaaucauuucauaaaagucacuucaagaaugccuuuauugcuuaccuccaaaaucugugacaggucguaugcuauucuaaacacuaugauauguaggaaugauauucaaaauaauuaacaaauaacaugacauaggcagcagccaucaacagaugcuggcaacaaagagaacugcugacaaacagauggaaaggcacagugucuacccucagguguccaugaucuagcaggguaaacaggcaagagaaauaaaaugugcaacauacuaaaaguuaaaaaauggugguguagaugagcaugaaggagaggcccuucucucuggaugugagggucauaaaacuuuguuagaagaagcacuaugaaggaacucuugaaaaaaauaauaaaggaauuugucauggcaauaagacaggguucuuccuagggaagugaaugugcaaaggcuuggagacuucuaaauuauuucuuuaaagauuuuacuugagaguuuugaguugcuauaaucccugggaauuccccacuugcuaaccaggacccugugugucagcggggaaagcgauuuucccaaagucacacagcgaguugaugcagcaucaagacuuagacacucaaccaaugcucuccacucugcugugcugaccaggcaugacuucuugguugauggcgcagcuaaauugccauaguccauccaucagagaagcucucauaugucuugccacacacuccauauggucuuugaacuugauuuuguccuuuguugucgaaggaaaagcaagaagaguuggaaaagaccacucaacaaugaucugcaagcaaguugggaaaccuugacucuaacaaaaugcauuuaauuaaaugacuggcccacugugugggaucagagauccaucccggcuuuggaaaagauuucugguaauuauggagucacaugagacuuuuggacuggaguuagcacaccagaugagaugaaucccgggaagaggaggaggaagguugggaacagugaaggaguauguaaucagaguaggaagcaggggauuccauggggaaguggacacucagcuuccucagcacuaguccuggccaaaauuccacucauugucuguucugucuggaagaaaaaguauuacauuuaacagaccuuuaaagaaaugagaaugaucucaccugaggcaaaccaugacauuccucuggucucuaaaccacagccuccaccagcaacuccugaauaagaacugcaaacaagcaacaacaaaaucagucuuuggcaggaagcucugugcaggggugguguuuacaugcauucauucuacccucucaaguggaaaaaagugcuuaugcuucucagaaggaugcaaccaugagggauuagaugccaagagguauggccucugccaaacaggaggaaaaaugguucuucauuuccauaaacuuccucugcuguaaugucuaguguggcuugguugcucaguucugauugugacaguuuucuuccuggaaagcaggcauaguggcuucagacaagucauucuuccucucagcaccccacuuucugaucugugcgauggaagcauuggacacaauaauccaguuuccuuuucagguucuaugguuguaaaaggaagaauuuaauuauaaagcacaacaugucaaacauuuauuuguuccuccauuacuucauucauucuauaaacauuuacugagcuucuaugauacccaaggcucuaugccagguacagaaaaagcaagugugaucaccagccucaggaagccuagcaucuaggaggaaaaucuagacaugcacauguguaauuauaccauguagaugcaauggauguccuaauagaguuacaaaugccauagugcauagaaacaucucuuccuagauggauuucuuccauuuaggaagcuccauagugaagucagaucagaaauggaugauaaauagaugugagggcauggaggugaggagccuagggcaucauccuagcaugaacaaaguuuggguauuguagaguaccuggugcauauggacccaucuaccagaaacagaggcugcgaacaguacagggauggaaaacacguccucgucugggcacuccuuacucaaaugccaaaaagcuuaagaugccacauagcuuuuuggagaaaaugccuuuuacaaguagccucuccuaaaaaugcauaaaucaucucuucucuauguuaucagaauacacuuauaugauaguuguuaacuuaacccauaauaguauucuuguuugucaccucugcuagccuuuuccugcuuugagggccagccuggucauauuuggcuuaguuucccugugauugaccauaccacuugugguagacacuaaucaacgauuguagaauccuaaagaacuggggagaggaguucgaguuugagacauuccccgaaaaagccauaucuaucuaguuuucuagcaugcgcucuugucuuauuuaaaaacucacauagaauuauaaauauauugauuauauguucuauacaaauauaguuuauauaccauaugacauauauuguacacuauucuaauauuuuaaucccuaacccaagagauuaacucaguaggaaccacucacugcugguugagacacagcuucaugcuacugaaauauccuuuggcuaaagcacagaauuuaaaacuucccaaacaaccaacauuugaaucagccaaaauggaucaaaaguucaaaugagcgguuuuaugacaugacuauuuaugggcuuucuugcugucugggagggucacuuuagcagagaauccuaaaauacuacagccaaagcaaccguaggaugaccuaaucgugucuugcuuuuuuuuucagauggggaaacugaggcccacagcaacaauaauaacuguggggaugauaucauuuaauauugaaaauaaguggauaauugagaccuccauuauuaguaguuaauuuuuaaaaaucaaagaucucuccuaauuagcuuuauggagcaaauaaauauauuuuccauauucaaauauggcugugauuucuacacaaaugguguuaacaaucuaauacagcauaaaacauuguuuaaauaucaucauacccuauuccuaaacaguaacguguaauagaucucuggagcccaguguuguaauauaaacacuucccagguguauucccuugguaaaguuucauuacuucucuaaacgucaguuuucuuguguaaaaaagagacacuugugucuauccuacuuacugguuacaaggauauaauaaaaauagugaacaaaaauaguguucauaaaguacccugcacagcaccugauuauagacuuaauaagggagggcucaaugguaguugcguuuugaauuacauuuaaugcuucauuuuacuucacugucacaaacuacuaugcucugcggcaggcucagaagucucuaggcacgggugaagugcuacuucuccacucccuuaaaugccccuguaugcccugaggauacucaaugcaugcuaaccaccaaacgaacggaugacucagagcuuggaggaaauccacggcaggcuggaaagcaaaggcgcagcuuauggcucaaggauuagguuguuaccuuuuuaaauuauugcuuuucuuuaaagaaagggcugugggggacgccuuucagcacuaagagaaaaccucagaaauccuucccccuggagacccagcugagaagaccacaccaggcacagggcaugaacaaugucaaaaagcuacugcccugcaggacacuggggcuggaacaaagaugccucccagcagcugggcaaggcuggcucccacacaagaaaagcagggcugaugugagcgucccgcacgauccccaccugcugagaccuaauccuggguuaucucuccgcuggcccagagaaaccugaaaccccccaggcuuuugaagggcuuuaucuccucuuuccaggaacugggcucagucccuguacucgcuccgaggugccacugagcagcugcugcccagagcccaggcgagcccuggucccauuuccagcuugaccaaguacaagaggggagccagggcugcggauccuacucccucuugcuccccaggcauccgucucacaauuagaaaacccguguggggagcaaagcaaaaaucacauuucacuaacagcuacucggggucgggggcgggcaggcgggaauuccuacuuucgccauaaauuguaugcaaauggguuccuucccuggccgagagccaggagugagugcgucuuucaugagcuaacccuguuccgcugggagggcuguuccuuuaauucgccaacugaaaaagugggaaaggaugucuggaggcgaggcgucccauuacagaggaaggagcucgcuauauaagccagccaaaguuggcugcaccggccacagccugccuacugucacccgccucucccgcgcgcagauacacgcccccgccuccgugggcacaaaggcagcgcugcuggggaacucgggggaacgcgcacgugggaaccgccgcagcuccacacuccagguacuucuuccaaggaccuaggucucucgcccaucggaaagguaagucuguuuugcccucaucacuagagauccuuaugauguaaggauugcauuccugguaccaaaugaguugugauuuuauauuauaauuacaaaacauaugggguuuuuuuuuccaccgcuggaaaaaaaaggaguguguauugguuauaucagaugcaccuugacuuuucuggucuuguaauuuuguuuguuuuaacuuuaugaauagucagacuuggaaggaacuuuucguaaaguuguuaucuucugcuguucugcagaggaaaaguaaaaauuuucucuucaacugcucuccuacuucuagucuggcugauucaccuguauauaucuuuuauuuugaggguuagggcaguagaguuuuaaggcagacuuugcucauagccugccccugggauggguuagagggaguuugauagaggagugcagggagaauauaaaaguuuauaucuaaacagcacuuacauaaaguuuacaaagaguuuuguacccauucccucauuugguccucaaaauauucacccuggaaaugagagcugggggacagaagagaggagguggcuccugggccagaugaauaacugacaggcagcuagagagugguggagaacagcuuuacuggggugccuagagccagcagcgucccacaugucucuagaaucaccuccuccuccucaccucucaucacagaaagaucugagcaacaacaucccccagguaugggaacccugcugccccugguguacuuuggaaagaacacagggguucuucucacccaucaguguuguaagaggaauaagagcuuagguuugaagccagagguguuugguauucuccccaccaccauacauaugacccugagaaagauacaucacuuccuuaauccucaguuuucacaucucuaaaauggggacaauagcgucugcugucguuuugaggagaaaaugagguauagaaagaucagcaaugacugcuuaauaacuggaaguuuggauaaucauugucauugccaaaaacugccaucacucuggaaguuaaaagaggcauugagccagucuuggauuguuucuuguguguuguuccucagcccgcccccagcccccgcuuuuuaucucacccaaucugagggugucucacuaggcuggcaggucugagacuuggcuguauuuuacaagcaggagguuguguuggcacagguuggagaaaagguaguagcccggggcuggaaguuaaugucaaauuuugauuccagaaugucaggagguuuugaguuuaggcaucugcagauucuaaagcugacagcuaugaaguacgaugcuguuggaaacucuuuggaaaagcuuucuguccggagggagggcaggacagggagcaccacuugaagaaugaaugccucuuuuucauguuuuuguagacuuuuucccccauuuuuacagagcuuucccauauguguuuuagaaaggaaaacuacuauccaucccagccaggcaagcccaauucaggacugaagaagauuuauucaguccuagacaaccaagugaagaguuucuggcuuugugcgcauacaagucauuugcaggagauguaagucagcgugcuuuggcccuugcauuucaggaaggugacugcuuuguggggaagaaaaaggugcacaauaugaguauucucugguuugcucaaacaggguaaauuggacaaggauugaaagggauguugccaagcucuacagucauuaaauauuuuuuuccucuaugcuuuguuuuaaaaaccuagcuucucuauuuuaucccacacuaaccuccuccuuccccacucuaagaagugacuaacguuucagcccucaacuuugucauucauauaauggagaugacaaacuaugucucacagggcucuugcaacauucaaaugagguaauauauggcaaacacuuggcauaguaccuuccacauauuaaggguucaauaaauggaaacuuuucuuaguuucucuguuuaucauuuuacaaggacuuguccaagauuaauauucuaagaucaugauuuuuaaacuuauuuuuaaugaugaaaauauucauuacaugaauuuagggcaaacccccaguauaugacagguaaaugcagggcugcuuugguugaaguggggucacaaggucuaaaacuuacaccuuugcucuuagccucugggacauugccacagaaucuucaaugacaaaaagcacauuuacaaaucaugaaaccaggcugugugcauucugguugccauucugcccuucaacaaggauuuuugccccucugagucaccaucuguagcagaaguaagagcaaguccacaaauaguguaauagacaggaauaugaaugagaaauaaaagacuuaacaaaggcuauuuuaauuaauucuaaugacaaugauagccaaaauauaugaugagccuacucucuaaacuguaggcuuuugugggaucauccacagcaugucucugagguauggacuauauuuguuggacaaagagauggcuucaagaacagggagacugaauaacuuuaccaagguccuagaacucagagugauacagccagguuucacacccagguccccgugaucaccaagucagagguacauucugccguguuccuucugaaugcuucucugcuucuugccugccuuuagaaggaaaacacuuccuuucugacuaaauaugccccuccaggcagacuguggccacccauaaauacagcaguagccugaucauauaaccagaauggaauuuggaaagagaauucaagcugacagaaugaaaaacauaucccccuuaauccuacccuuucuaaugcuaacaauaaauuaagagcacauauucucuccucucucucuagauuucuauagacaccuagcugugcuuucuuacaagaaaacauauccacuggaccaaagcgcagcccccuucaugcugaagccacuucaguuugaaacguaaaaaguagguugcaaacauuuaguuggcucgaaauauauguccuuuugugaugguaaaacacacaaacacaaaguuaauagugucacauauguaauaggaggguuugccaaugguuucucaucucauucucacucagacacuacaaauuauaaauuacuagcucaauuuuaaagaaaucgacacucaaggaaguuaggugacucaucugaggucuuuccguaauugaggggcagagcuggcuuugacccaagcuuucuaacuaauaccccacuguucuuucugcugugcuauauugccuucugaagucaggcugugcugaccaaguuuagaaccuuaaauggugucuuucagugaaugaucaagaugguggagaagcccccagcuggcauuggugccuauugauuuuacagaauagcccugcauguaucauuuuucaugguucucagcaaaggucagcucucaauggugcaacucucugccuggaaacaggaaaguucaaauuucagcccuggaagagagaagaaugaaacuagagguagcagucaggucacuccugcugauuuucaucucagaaaaguaggcacacaggugagccaaacaucugguuuuaaaagggcugauugguagguaaagugaaaucggccuuggggccaugaaucccaggacagcuuggaaaugguuguaggcuccgagccacaaauugagccacaaauucagcggaagccucagagaggaagauuaugauucaaauaccucucacucugagaagauuguagggaauccccuugaaucuuaucccgggccaguuugaacaccuucaacaugugggaaacauuagaugaaggcucccuuccaaggaggaaaaccccccucaaagugugacaugaccagccuccugcaaaccccaggccauaauuccauucaauguaaaagacagagauggugaacuuaccuaccuucgggggcuauacaugcuuugugacuucucuguaaaggagaaaagucugcaaaccaaccugauucuaauccugguggccagacauuuuucaguuaugcccuuaagccuaaacuccuuucccuccaccuugucucacauuuccagcuucucuuccacuuuagaaacaacccugucacuaucauuacucucuuuggcccuucaucauggaauaaaagcaaaaugcccaagucaaaagcagaucgcgaacggaaaaucccuuccaugugcauuuuuagucuaucugugaauggagauuuuaaaaauauguauuucaugccacgucgucucagaauuuugaaguuuccugaaguucauagguccuucaugauauagccaugguaacuuaaauagcuuuguuugguccuuuaacccuccucaaauacccuauaccaagagccagagauauaucaugaguucugaacauagauagcuuugcuucagaauugaccguuguucaccucuaacccuaaagcuggcugcugcuaacuucgacaagaaugugucugaaauguucuccuaggagaauccuaggggauaaucguaauagcuaauauuuacugaggacucuauaggcaucaugccauuuagucaaccauagcuucuaguaagucuuaucacccacccuauucaaauaugcacaauguaaggcugaaaacguuuaaguagcuuacccaauaccaugcagaaaguacuugguggaguuaaaaaucaaacccaguucccaguccugagaggcuaguuauaaccauuucaguaaggaagucaugcucagcucccuaauucuauucaucuucugacaagagagagggcuagacacagcaaagcuaagaaagacacaaaagcuugucuuuuuggcccugguguucuuugacagacugguuaauuuugcuaucuccagcuugcuccuucaggcuucaccucuugaaaaaaacuguaauuaaaugauuagcaugugacccauaauguaauacguuuucucuacuagacuuuaagcuacaugagggcaaagcccgauccacaucacaucccugcaaccagccugagaccugaagcauagacacacauaagcaagugcugcccaagggaagccaugagugcccugcaggcugccuggaaucccccugcuccagguuccaacugagcucugcacgucccccacugucugugucauaauuaccccuaugauugccuucccugccacacuggacuguacaccacugaggucaagaauguuagggaggcgggagcuuugucugcuggaguucauuuuccccaaaaacggacccaccaugggcagacgcaccauuagcacaguccccaaaggagaugcccaggacugugggauggucuugugaaggucgaugcacagauauugcagaggaaugcuuuaacuucuagguagguuacuauuuucuuaaaucuccuuagggaauacagaauuuucaaacuaaaagggcuuacgggcagccucuaagccagaaucuugcagacuggauuuuaaaaagaauuuaaaaagauuugggggcugcuguggagagacagggaggccaagcaggggauuccccucaaccuuauuucaaugaaagccccuccacuuaucuauuuuguacacugagccuccucaugaaauuuuauuugaugaaagggcucugugcagaaaaaacagaauguuuuuguaaauugcuggccuagguuagcauaccucauuuuaaagagggugaaacugagacauagagaagggaaagaucuuucuaagaucuuccgccaguuggcaacagggucagguuggaauccuaggucuucugacucuugcucuuggaagccagggacaaucuuaaaaguuucagaauuaagacauucuuuuagaaaagaaaaaugagcagagucuuauucucucaacagccuuaacucacacggaccgagccaaggaugacuaguaucuccguauucauuaucuauuacugcauaccaaauuacuuuaaaucaacacucauuuauuaucucaugguuucuagaggucuaagcacagcuuaguuggauuuucugccucauggucucucaugagguuauugucuguguuggacaggguugaugucucaucuaaaggcugaauugggggaugauuagcuuccaagcuuguugaugugguuguuggcuggacuccauuucuugagagauauugaacugagggccucaguuccuucaaagcuguugguccaaggcuacccucaguuccuugccacaugggcuucuccaacaaggccauuuacauuaacaaagccaaugagaaagagaguuaccgggcauggucgcucacaccucuuaaucccagcacuuugggagcccgaggcggguggaucacuugagguuaggaguucgagaccagccuggccaauaugcugaaaccccguaucuacuaaaaauacaaaaaaauuagccuggcaugguggugggcaccuguaaucccagcuacucaggaagcugaagcaggagaaucacuugaacuugggagucguagguugcagugagccaagaucgagccauuccacuccagccugugcaacaagagcgagauuccaucucaaaaaaaaaaaaaaaaaaaaaaaaaagagagagagagagaaagucuauaagcaagaggcacaucacaauccuguguaaccuaaucauggaagggauauuccaucaccuuagucauauucuguuuguuagaagaaagucacugggccaucccacacucaaggggagguaauugcacacguaugagaaugccgggaggcaguaucaauggggccaccuuagagucugccugccacagccuccagcacuccagugucaccaauuucuggcaaccucuuaucaaugacaaguucacucaacccuucaguacccucacugaugaguaauaaaaaaauugaucgagaccauggugaaaccccgucucuacuaaaaauacaaaaaauuagcugggugugguggcgggcaccuguagucccagcuacucaggaggcugaggcaggagacuggcgugaaccugggaggcggagcuugcaguuagccgagaucacaccacugcacuccagccugggcaacacagugagacucugucucaaaaaaaaaaaaaaaaaaauucuggcagccacuaaaguggacuaguuuuuauuuaacauccucccauguauauaguggagccaaguguuuugauuaguuguuuuaacucauugguuagccauaauuucucuugaauuucaccccagggaggggccuuucacggcaaugauuccaaauguauuuuauucuaaagcaagacagucagugugaccaaaacuaaaacucauccauuguuccucccucaaucuauuccucucagcagauauaaugaauaguaacaucuucgauuaauucuuuuuucuuuacuaaccccacacacaaaauguuguagucucuacugccuugacaagcaaaucuguucacugccuccccacuuucuugaucaccacccccugccccaccuccauuaccccuguaguucagaucuuagcaucucacagaugggccacugcaacagcuuucccacuggcccccagcaacccagccuuccccuucuucaaccugagacauagagguuaacauuccugggccucaagauuuccaaaugcuuuucuucugccugcaaaaaaguccagauauucugacauucaagauucuccaugaucuugcuucuggucucuaaacagauccuguacuucagcugucauucauacuguucacaucaacccuuuuauucuuuuuauauccuuguaaaugccauucccucgugccuagaauauccuuuuuuauguuuuucaccuauucauauuuuucucucaaaauucaguucaggcaccacuuccuccagguaaauuagaugcccuuuuacugucaucucauucuaccuauguuucuuuuuuuaaaucuaucaucuccuuuaucauccuggaauggccugucugccccucuugacaauauaguuccuaaaagaaaaaauuguaucugguuuaucugaaaccuagcacaacuggaauaaaguuaaucuuuagcaauuaauaggaguccuugcugugucccagauuuggacauccucuuccuuagcaguuugcucagaaagcccagagcuugaaguuguuuucacgcuucacccacuggcuugcaaguaugcagugugaugacacaacaugugauaggaggaaaccaucccagcccuaggacaggaaacugucucaggacacagaccucaaggaauguguuugcuuucagagguggccuucaggauaaaaacacaaauugcuuuggauuuggaaaaaccaguaccaaggacagaggaguccugucuggggauuugaggcugagucacaagagauagcugaaaaucuggagguuauaacaaagauuagucaacaacuaauaggaggaaagaacaggcucaagggugggauggagacaaagagcucucuaucuuaggacauggagaagcucacagcccacaagaagaaaugaauaaugguuaagaguaugacuuuggcauaagaauccucuggguuugagagguauuugcuugcuaugugaucuuggccaaguuacuuagcuucuuuaagcuaauuucuucuuauccauauuaaaagcaaaguaguagcaccuaguuuaaaguuuauugugaugauuaaaugauguaguucaugaacacugcuuagcacagaaacuggcauucaauauaaauguuuuguuguugucauuguuuuguuaccuguugaucaaauaguucuugaugauaagaucccacuagagaagcaguucccaaaagugugucauguggaaaagcauucucaugggaaucaccuaaaaaaggguuuuguggccaaaugaguuugggaaacacuugguacucuucuguucuuggaaaugcacagcucauauguccauucaauacauaguuuuagggcuggugauacaauagaaagcaauacagucaagauccuuuuauucaugguguuuacauuaugguggcauaucuuaguuuguacaagcugcuacaacaaaauaccauaaacugagugacuuacaaacaacagaaauuacuuucucacaguucuggaggcugggaaguccaagaucaagauggcaccuuauauguccucacauggcagaagacauaaggcagcucuauggggucucuuuuaauaagggcacaaauucuauuuaugaagccucugcccucaugaucuaaguaccucccaaagacucugccaacuaauauugucacacuggugauuauguuccaauguguggauuuugagggaacacaaacauucagaccauagcagggggaaggcagacaauaaaaaggaaucacauaaacuuauagcacaauuucagguagugauauuugcuaagaagaaagacaaaacaagguaagggcauaaacaaugacugguggugagaggagugcucuuuuagauggggugagaggugaaugugccauugugcagaugucugaaugaaaugagagaaggagcucuguaggcaauggcuaggaguuugaauuucauucugagugugguuagaagccaauggaugguucagggaaguagagugcaucaucugagauaucuugcuguaauuaaucuguucaacuuucguuagcccaguaucuccaaacauaccugaccauaggacaucuaccuaaaaacaucuugcaacguagucugggaaauucuucacuggagcacaaggcuucauagauuuuaaagggacugcaaauuugcucuuguucaucuagaucugcacuaaaaauccaaacauacugcuugggacaaaauaggcaugcccaggaaggaaaaccuagcucuagagguagagacaagcaggaugucauccuaauuagcagcucuuuuuggcaaagacaaucaaugagcacagccaggccucagcagauucuggaagcccauuugaugccaacggaaacucgccaauaucuacccaaggcuaauaaguguuugcaaacaguacaccuuggcuuaaguauucuccaaaaaggaaguacauaaaacuugagauccagccagagguucugggagaaaaacagaggucaaauauuuuggugcuuacaugugcacagccaccaaagagcugcugaaggucuaggaaauggaaagugaguucauccacuugaaugcugaucucuuucuuuauggagcaguaaaaauuuaaguuuuuaccuuaucugaacuaagaaaauuccuuuaggagucagcccaguguagcucaauguaguugaaagcagacauuuuagaaccacaaauaaaucaggauucaaaagcuggcucugccucuuaagccagucauggaaacucccugagucucaaauuaauuuucaaauaagcauaauaauaccuaacucaccagguugucaugacaaaugacaagauaaaugauagcaugaauaaaaagcauuuaguguaagauuuggcauaaaaauguauauaauaggcacucaacaaaauguuaguuuccuuauuguucaauucaaucuguauuuaguuucauaauagaagcugucauuuauugaauaacuacuauauuccagcagagguuagcaaaccauaggguggcagccuauuuuuguaaauaaaguuuuauuggaacacagccaugcucauuuguuuguguauuaucuauagcugcugccucuacaauagcagaguugaauaguugugacugaaaucaucuaacugcaaagcuuuacauauuuucuauuuggucauuuaaggaaauguuuacugaucccuuccagucaaccuuacuaaauuuuuauacuuacuuuccagucaccuuaaccuaacaagguggauauuaucauacuuguguauauagagauugaagcagaaaaaaaaaaucaucuaguaaguuccccuccaaaaacauaaugccaaacucuauaccuaaaagaaguucagaauaaugauuaaaaguuauucauuuguaugauucaucuucauuugccucugccuuccucugacuaguauuucucucuggcuaauuucuugaauuuccugccauaugcugaauuaaaugauccuauuuagaaggaauuuucccuccuuuccuuacuuauacaaauaaguuguuuguucauagaaguccaugcuuucaaaacugaaagugguaauuuccagccccucugaaacgcucucugaucuugacugauuucuuggaaaccacacguuuuuuagauaguacauagugugaagcccaguuuuccagaaaugauagauuuuuagcucccccaucugcuacuucucacuguaucuuccucucacuuauuaaccuucucuucaggucagacucaaggagagcaggcuuuucuccaggggcuuuaaagauuugccuaagacacagauauuauaguccaccuggccuaugcccuccccucaaguucacaacaguaaauaaaauaguuauguaaaccccaauucccaaacaccauccuaccuuguuccauuuugcaaauccaacaacucuauucauauuaaugauauuguguuucucucugauaguuaguagauaaauauuaauucuuuaacuugaacaaugaaucuuacuucaaagguaacuugauauagcagaaagagcauagacuuuggaauuauaagacuguucuuaauucugauucaaauaauugcugacuaggccacuuacuuaaccuucuuaagccuucaguucucuuaccaguaaaauacaaacaaugcucccuaauucccagaguugguaacaugauuaaacagcauuuguaaagugccacgcacaguauaaauauugaccuacuugcuucacucuuaguuuaaauugcucaagauccucuaacauagagcuucacauuuuaucccagagaggucauaguuagguauaucucuacuuccuucuaauacaggaagaaaugaaaggaguaagggucuaggauuuguucucuaucaguucuucccccaucgugugccauccaaccuaauccugugacucacuucaaacagaauaaucaaguagauuugggaaacacucuauaaacuguccccuucuucgagauuuccaacgagcaugaaccuauuaaacacccuggaaaaaccugaaguaaagaaaguuguguaauuuguuuggcuuaaaaucauauuugguuuaaaauaacauuuuccaaacguguuuaauuaggaaaucuuuuucccucagauuaguaccuaucaacguguuguagauuacacuuuagaaaaugcuguuuaaaguuacacagcuaaguuaaagccaaguuaaggggguuagacauaucucuauuuuucagauuuuucugcaguuuuuccuguccugccuguagaucauaaagauauuucauuaccaguaguuucucuggaccccgaccuuaguuaugcaaaccacccuuuaacauaauuaaaacaagugaaucaguucaccugauuuaaauuucuguuccccguuucuagcuaugugaucuugagcugugugagccucaguuuucuccuccauaaacugugaaaaauaaagacaacuaccucagaagucuuggggaggauucaaugagauaauccacagaagacacaaaaagcagugucuggcacagacgacauaugcaaucaauguucauuauuauuauagcauuuagauggucccauuuugggaaagggaaaauagacaaugaaaguauguuugcuuugccugaggucacacaaauuaauuacgggaguagucuuaguuuucccugagagucugguuuccugcuuccaguccuagagacguauuuuuguuucaugagucauauucuaucaaaauguaugagacuuuauugaacuugauuuaaacaggauuuuguaauugucaauggcuccaucuggcuccuucugaugcaaaucccacucaagcaggauuccauucauuugaauauuagcacauuggaucgggaaagauuuccaaagcugucuaguuuugcuaugccaaauauuugguguacacgucaacacucuccacuccuguacccaugguggauauugcuaauccaucacagcaccuuuucccgaaagccuaaucauagccacagaaucuuucucaaggcaguuccagguagcuaugucagcucuuugaguugaaacauaauugaucccaaaccaauucuacuucuuaaccagugcuugaaccaccucuacacuauuacucuuuuauuuuuuaauaugcccaaugucauggagcucucucauaaagggagacaggaaaaggaaagaagaggagaagauauacuaacauauguguaacguuuauuauuaauaugucaggcacuuauagcuuuguugucccauucacugccucaaacaacccuggagagauuuuauaguugaauaagccacaauucagaagguauaggacguuguccaaggcuccccagcagauaaguagaaauuggucuuaagucuuccugacucuaaaggcaaugccccugucucucccaucacaaugccuucuuaaaauuuuucagggucuuucgggacuaaauuucugacuuuggguggcugauaacaguuucacaaaggcaaccaucucacagaccccuauucagaaguucucuuauuuaggguuguguuguaagucugucuguaaucgguucuuccuagauaaaucucuuccauuucuuaaccuuggcucaagacuuugagaacucacuauucaaugcuucugaaagagccaacuagauuucuuaaaauucuggaugaagaccaaaauagaagaggucauuguuccauugggaaaugaauucaaauuuauuuuugaaauaauuuuccagaauuuuacaggaaucuauauuguugccacuuguccagaaccacuuuuuauuuucuuuucugucuaggcaagaaauagaagagagaaagcaagugcucugcaguuuuauuucaaaaauugaaaccagaccacaccagggcaguuuguggucugaauguaucaauggaucuagucauauuucaucugagcauuucuuagguauacuaaaccacaaauaugaaucucauuauugugucuggauggaaauauuuuauggauuaagauuuguggauuuaauuugguugguaauggaacuucuguucaaggggcaggagggaggaagucgugaggcaccaccaaugcuuaagccaaacuauggaaagaaacacuauuuggaggguuuguacuuaauguuggccaguugacuugggucuaaagugaaauucaaaauuaaguucaacaaaaauauugugaaauuagcaauggaccacagaucacuggaaccaaagggaucuuagaauuggaaaccauacacaguugcucauuuuacaagagaaacugagaccucaagaguggaugcgacuugcccaaggucacacaaugacccuguuggucagaccugcuuggcagaagaggagcucagagcuucuccuccagaucuuccauuuauugcacuuccuguuauauggccucauaagaggccaaguaucugggaacuuaaaaaaaaguaaugaagguaaaaauuuaaaaugagaaagggagaccuauauuuaacaacaguacaacaaaaugauaaauacugcaaugaaauugaaaggguuacuaacuaauaacccaggaugcuuccuucacaccaaaaccaaauuuucaugcugagugcaucuuaggccuggccaauuccaccuucugccaaaggaguuuacuugaucauagagaaaucuugucucaaaguagaaaguacugagcucuuaaaagcccuuggguugaugucuagaaucucaugggaaggagcuaggucugucuuugucacuuuuguaccuucugcacuuaguguggugucuggaacguaguaaauacucacugaauaacugaaugaauuaaaacgaacuaauuacagaacugaggcugugacaaauuccuugauacaucuuacuguagaagagauuacaggagagcuaauuacauuagggccaucaggaaaguaagaguauuuguucauucauuaauuccacaauauaagaaccugcuauguguaaguucaaaccaagaaauacauucagcuucauuucauuuaauauaaacauauugugcauuuacuauguucuagauaaaguguuuuguguugugcauucagagaugaaugucucagauauaucccugcccucauagagcuuauagucuacauacaaucuaacugcacauaugcaaaccaacuguuuauagacuaauauaaauacaaucuagaauuagcuaauuuccuaagagaaggaguuaugcaugcauaauaaagccauuccaaaucuuuuuuuaaaugauaaaucaaauaauaucauaucaauuccccagacaauucagaagagagaaagauaaauuuaggccaaaguuaccugauaaaccuuucaauaguagauuucuuuaagcagcaucuugaaggacugauagauuuauucaugcagagauggcaaaaaggcuucuagaagccuucaaggcaucuggaacccucgcugaaugaucacugagaaauggaagcaucccaaauguaucugucagcuugcuucaucuccacagcagccacaggcugucuggcaucuuaauggucuacuucuggaggauugauaguauucugcuuugagccagguguugggaaguuauauagucagagguuggggcuggucuugacucauagcuccuuugcuuggcccuccagcacaaaaggcuguauaaaaucaugguucagagcccugacuuuggacucagaugggauuugguucaaauccugacuccauaacuuaauaaugucugaacuugcacaagccauguaaagacucuaugccucaguuuuuucagcugcaaaaugaggguacaaauacuaucucauaauuguaugugaauuugaaauuggaaauguaaaaugcuaacuaagcacaggcucuggcaaaaucaacacuuaauaaauuauaguuaaugauaucuguauuacuuaugauggugaugaugaugaugucaacuuccugauuauuauuauuaugucaacuucuuaaugaucuuccaaggccuuuucaaccacuauuuggugauuguaauucuuuccuuuucuaggaagccccccaugaacuucccagugcaaagugucacauaauuaucucauucaggcuggcauuaauaccagaccuugcuuguguaugauauucuaguuucugagaucucuaggaacaaaaaauagcuccuuacuuggccuauuuuccaaaguacccagcacauugggagguccauacuaaguaaauagcauuucgcucuugaaagaauguuaacauuuauacucuugcuauuggcuugggagagugcaccauguucccaaccugcaguggcacuuaagaauaucacaaauacuaaaucaacuguacauggaguuaaaaucaauugcggccaggugcaguggcucacgccuguaacccuagcauuuugggaggcagaggugggcagaucaccugaggucaggaguucgagaccagccuggucaacaugaugaaauccugucucuacuaaaaauacaaaaaguuagcugagcgugguggugggcaccuguaaucacagcuacucaggaggcugagacaagagaaucgcuugaaccuggaagguagaaguugcaaugagcugagaucgcaccacugcacuccagccugggcaacagagcgagacuucaucucaaaaaauaaauaaauuguauuuugugacucuuugggaggaaauuaugagcuuugcgauuauacagaacauguuuaucuucuuugguguuguaucguuuauacuuaacucagggcuuggcacguauguacugaaaaaguagauaguuggaugaauugauggauagauagacagaaaaguaaaaaacucaucagggccaagaagucuagaaauacuuuaacacaaaugcucuccaggaucccaccacugauauuucucucuggagaucauuacaaugaccucagacuaagaauuacugaaagacuuucauaugcauuuuuaaagguuuuuuucccccagcuuuauugagguauaauugacaaauuaaaauuaaaauuuuauacauuuaagguauacaacgugauaauuuaauauauguauacauugugauaugauuacuagauucaagcuaauuaacacauccaucgcuuuacauaguuaccucugugugucaaugauaaagacacuuaaggucuacuacuaucuuagcaaauuugaaguauacaaugcauuauuauuaacuguagucaccaugccguacauaugcacuccuuuuugaaggccucccaauggucuagaggaagagauagaucuuaaucgaauuccuugacccaaaggcaaaaucucuggauuuuaauaucagcuuuaggaguuaauuaguaaagucaccacugauuagcuagugacucuggguguuucaauucaguuauucucuuaaauaacuagguauuauggcaaauaaguuucaugugauauacuaccucuauuuauauacuacuuaauuggcugccugaagugaugauuuagaaugauucuuaaguggggcuccucagaauuguguuguuaucgauuagcugugucugccccaugcacuagaaugaaguguuuugugccacagacuugccaugccuauaccaaaugaucuucuacaguugcuucuaaguccugcucaagcaugauuuugauccuauaauuugaugucugucugugucuuuggaaaguacugagaagcugggccaaauguuucccguuaggaacacagucuugaaagacuaaaccacaggcagucuauucaguagaaagcccuggcucagcagcauggacagccaucccaacagcagcacugccccugaggaaccuuggccaggguccugaccucccagaaaagagccccacaccaggcuaauucauuugcuuuucuugcuacugaguuagaagagauaggauaacaggaaaaccagggcuguagccacagccuccucauuuuccuaaaaauuuuagagugucccugcuacuugacaaauugaaauacuaagauuuauacauuuccauggaaaaagcaacagugggaaagagagggcuucccagauuugucuuauagaucucauccuucagagacuagccuucuguuagaaaugcugucuccaagcacaagacagaauaaucauauaauaccaauacacaccaguugcuaaggucuccauccuuuuaaguauuuguuacugaguguuuugccuguauuaucucauuuuucucacuuucaguugaaagaacuuuauugugcaguugauauuaguguuaccauuuuacagaugugaaaauuaaggcccagacaggcaauguuacacaaccaaaacagcuacuggauggaacccuuuggauuugcuacuacccaacuauuucugaccuaaaagaguggugauuccaugugguucaaauuaauagcaaguggcagaguaaagaucuaacaguguuugacugauguagagcagauauccucaaacauugcacagauguuucuuggauauuuguccauguuaguauuuaucauucuucacaacaaguaucuguuuacaugucugcuuucuauaccugacugugagcucauuaagggcaagaccuauccaucauuggcuucugaaacaccccaccaccacuaggcuaucccauagcccguucuuacacuuguucaacacaucucuguugaaugcaagaauaaaccauuuagaaauuaauucucaguccucuuggauaaucacuggcucccccagcaucuuaacugggcaccagcuaagccacugugcugccuaaauggacaaccacuucucaguucuggaauucuucaaacaccuaggguuaggagggucuucgcuuuggcaguuagaguuuucucaauucuuuuaugacacagguugcaccggacucacucaacuauggagaucagauguccucaggaaaaaaaaaaaaaaaaaaauacacacuuaaggcuguuuccuggcuccucucucuuccugacacauuccaaaaaggaauuuauggauguugggaaggacaaagggugaggaauuucuaggacauuuaagaacgcccauguaagcaacucuaugcuugacaggccaugcacaauaaaacucuuuggccuguaagcgagaagaaaaauuugguguaagcugccucauggguugccaaaaugauguggaaacaaauucaucugcauuucuaaacaauaggaauucuccucguccucccaaaccuagaauauuucauguaugugcuuaagucaacaagauaaauauauuccaugagcuacuaaaaaugaaaucauaaguaacuaauucugaaauaugauucuagccaguuggaaguuucaucuuuaucuaaaaaugaaguuguuuauucuccagcugugaccagggaaaaaaucagauuguugauuucuucgucuagcaaugaucuuuguccugcagugaggugcccaaaaauaacuguuagccuauucccugcugcuuccaaaagguuagcuaccaaacagcucuacuaguaaaagagaaaaaaagaaggauuugacagcaagccaagaggcagcuuaauguguaaaauuaugagcuaaaaagccauuacgacuggcaugacacuggccuugguuucccaaccugguaaauaaauuuuuaucucacaguaaugcucugaauaaaagucuauaaugccaaaaucugaagaaaugauucaacacugauaacauuuaacaccaaggcaauugaaauaagauuaaagcuuaacauuuaacccuucuuccaccccacacuccccacaaaagcuuucaggaccauuguuuuuaucuucuuauuuuuuguagcgggcuggggccauaaauguaccagguauuuggagaaugggggacuaaauauuaaagccuauauucuacccagccuucucaacagaugacuaacugugagcaguuaggcaccuagccuuacagaggugccauauugcuuacugaguuaaguaccagcucuucauauugaucuuuuauauccuucccaauauggcuucugccaauaccauguagucucuaccuuucugcuuuccuaugcauuauuuuauacccuaguagaacaagaccucuccauauucccugcaugcuacaccaccuuggcauguaucuggcacccacaaggagaugccacuauuauuacagcuaucuucuuaauucuccucaccacccaugcauuccaacuucuuugccuuuucucaugguguuucuuuuuucuagggugcuguaggcuucaauuugaacccaccuacuggaguuguauccaaccauuuuucagaaucuugcccaucuuucaaguacaucucaaauaccacuuuuuugagaugucuuucuugggaccuucaauggauaugaguuggccaaucucuuuuguuacuuguuauaaucaugaauguaucucccugauucccccaucccuucuggauacaagguuuucuuucugaucuauucucuauuggaucaguguuguuauuaccgcugcugcuaucauuagcuaccacauauuaagcacaccuuaaugugugccaggcacugugccaguagcuuaacauaugucuucucauuucaucccacucuccugcaacacuaugagauagacauauguaucuccagggagaggaggcggggaaauugagguucagaggagaaagggaauggccauagggagcagcugcuaaagugauagaacuggauucgaacacagguuuauuuuacaccaaagaccagacucuuucccccacacgcaacugcuucauuaauggaaauguuuagauggcugaaggauauggacugagugcccucaaaacucuggagcacagcagugcaggacagcagagaaacgggagucaugaguugucuuugacaagcuccuccagcuucuaaggagaggcugaagcagacagaaagagacauuagacuuggccagagugguuccuggagcaacuugguuuuaguuuaacguggggagaagauucuuacgagacucuaaggugugcagagggaggaagaaaaaaauauuucuuaacccaaggacaaggcugggggaaaagaugcugaucugacacaggguaguuaucucuucagaucugcaaaggacaauagcauugaggauugcuucucacuuguaccuggauauguucaaacauguaagguauggaaacuacaaugcacauacaugcuugcuauaguuaagugaguuaguugcuaaaaagaagccauuuuuucucccuaauccccgggcucuugugucugagguacucacccauuuucauuagucaagaaacuuaacaacauugaaacuuucuuauagacucuucuugaucgcuuugagucucaguuuccucauuuuguaccaugcgcuuaguaaaaacaagcaauccucuaaaccaguacugcucaauaaaacuucuuuggaugauagagauguucuucaucugcacugucucauauuguaaccacaagccccaugggcucuuaaguacuugaaaugugagugauacaacugagcaaugagauuuuuaauuguauuuaauuuucauuaauuuuaauaaucacaugcggaauaugggacagagcacuucgaauucaagaccaaugaauucgaaguguuuuaucucuuuuuaaauuuucuaucucacggggaaguuuuuauuguggauuuuauguucaccagauuaacuagcuuuugagacauugacagggauggagauacacagaaaaucucacaaaaacaauuucauaagucacagguauuuguuugacucuaaaaauuaauuuuaauaaagaaagcaaagucugacacaagugugucuuguuuugcguuagauacauaagcugaggcggagcaaaaagcagcacaacaugcuuagcuuggaaauagauuuguccuggauaugggaccccaaaaaucugcguuuugugccaaugcaaagacuaugucucuuccugauucccuucuuugcaaucauugacuuaccagauccuuaaauaucaccaucaaagauauacacacacuuacauauauaauaugauauguaauaauauauuaucuuucauuguauuauaauauguaauauuauguuacaucacauauuauaauauuauauguaauauaauuggagcaacuauuauauuauauauggagauauauauauacauauauauacauauauauauacauauauauacauauauauauacauauauauacauauauauauacauauauauacauauauauauacauauauacauauauauauacauauauauacauauauauacauauauauacauauauauacauauauauacauauauauacauauauauauacauauauauacauauauauauacauauauauacauauauauauacauauauauacauauauauauacauauauauauacacauaccacgacaugcauauuuucugggaucacugagagaggaaaaguucucacuuugcuguagaacucuugucuuugcuuaaaaacagacauaugccaaaguagggguuucaaagguuaggagaaagaaaauccuagaaaagaaaaacauucauuaaaguccauauuuuucauuacaaauguuuccuuuuauuaagcucuuacugcuaccaaagacuguuugccauuucuuucgcauacauuaucucaugcacuuuucacaaugauccuaugaggacucccuuaacacauuuauugaugacaguacucuggcuuauggucacagauaauaaccuugcacaaggaacaggaagugaucaaacagugauucaaaccuaagacaauuugccuauaaaacuugugcccuucaaugccauucuauuuacauucuggugcuuuggaaccugcuacauucucaaagaagaccuuucuauuggguaccaauuccaacuagaaaagucuuucuccuguugugcugaaauuugucuucucauaaccaacccucccucccugcaucauccccagcacauaaacgcacacacacacacacacacacacacacacacacacacacacacacacacacacagaggcacuuguucuguccuuaggggcuacaagaggcaagccagugccugcuuugccaggauuucuacaugguaacccugacccacucaaccuugguuuucucaacuacaaaauaaaccugcccaggucuguaguccuuccuccuacaagauauuuuccagaccuuuuauugcugaucaauuuucuauaaagauuagaaucuguguuuucuaaagagucucuguagaauaaguugcucauucugaaauuauaaaaguccuacuaucagaacaugauucuucaugucugaccuaaauaccuccaacugcaaucucaaguaaguuucccuggguucauccacaaaggagacuuaaaacagccaguugucugcaugagaauauuuuacauucuuaaaggucauuauuugcuuccuauuuuuucccucucucauauaaauauuucuaguucuaguaaauuuaccuccucacccaccagugauuucugcagcuccucuuugaucuagauccaaguugcugcugaguuuaggacuguauucaacuaggcggucaagcucaggcuuaaguaaaaggaggcuauugacauggacucuuguuagguuuuguuccccaggagcgcaacaaaauaggaacuacuguuuaaugagugccuacuacgagcuugacaccaugcuggguacuuuauguacaggucucuaauccuuaauuuucucuggaaagguuuugacuccuuuguuauauaugaggucaugguuuagagaggauaaguagcuugucaaaguugcagggcuagugagugacauuugaacccagguaugccuaauuccaaagccuaaccauuuucuacaacacugaaaauauaauggauuuuucccaaaguacaaaaacacccacugcccucagaccaccaugagccaauaggaaauacacaaugcucaagaauaacauacucuuucccccaacgaugcaacauuuggugguaccaguuuacgucucuuaaacacacagugagaaauccucacucuacucacacucuggucauuauuacccuaaacucuuugccuuggagucucaaucagcaacuauaauggcuuuuuagauggaaauuuaagucauuuagcaacacacagaaaaguguuggggagaaguccaaaaacauuucaaacuuggcccauggcccuuucuaaaaaaaaaaaaaaaaagcuaagaauugauggaaaagggguaggaaaguagaacuuugugaaggugaagagaguuagagcagccauucuaguagacuaugcagccaauaaauauuuguccaguaaacacauaagauggccaaauugguuugaaaggagagaacaugccaagucuccuuuuuuauaauaaucuucauucaguggccuuaccuacauuacagacccacacauuguuaguuaagaagcuaauuucaaugagaaagcaugcucaaaagaggguuggguauuuuuuguuucuuuguuuuuguuguuguuguuguuuuuguuuuguuuuguuuuugcagauauuacagggacaguugguaaagugucaauaagaauauaauuagaaugugguagguauguggauacgaccuucuuaguuaaauucacuagugcuuucucaguccuuaggccccugaucagucauauagaaugcuucccaguucaauuuuccuugccacaauuccucucuaaguuuugcaaaggcuuucugucaugaggaaggagauggucaguugggaucauguugaugcauucuaucauuaggauaaaaucuuuccagaaaaaaaguuagaaaccuucuuauaggcugaauaauccaagcaccaccacuaauugacauaaauaacuaacuuacagugugcgaguauaagaauaucaugggcauagggaaaugucaauuuguaaaugacaugcuaaaaaccaaauagcagccaggcacgguggcucaugccuguaauccuagcacuuugggaaguugaggcaaguggauugccugagcucaggaguucgggaccagccuggggaacauggugaaacuccaacucuacuaaaaaaaaaaaaaaaauacaaaaaaucagccaggcauggcagugugcaccugaaaucccagcuacuugggaggcugaggcaggaggaucacuugaaccugggaggcggaaguugcagagagucaagaucaugccauugcacuccagccuggacaacagagugagacucugucucaaaaauaaauaaauaaauaaaauagcucuucaauuaucauuugaauuuuacucgggugcaucuccuaauuaaagaaaaccaugaaugacuucauaucguguauagaucauucucacaugccuccauagcauuguuuuaguaaauauuauaacugccauuucuuccugucuuuauuuaguuucucaacugccucuaacaaguccccuuuucucugcuaccugauugcucauacaggugaauagcucuaagagagaugaauaagauaacuuggcaaagugagaauugcuucaugguagcauauucuccuccauauucuguucccaucuaauucuucucacuauuuaaggcucagcuuaaauuuuacccucccuuucccauaagcuaugccccaccuuucucuugaccauuccuuuuuauuuucaaaccccauaggcaguuauacacuauaccacaaaacaaauccuauacauucuuucuugcuuugcuccuuaaguacuggauggaugauuccauuuucuucuuaauucuauuguuaaguccccugaugguauguauacacuuggucuuauauuuauuucuaccacccucagaccucuguaaaaaugcuauaaguacuugcugauuggagaagacaucagaggcucuuagacauccuuucugagcugugagccucaguuuagacaacugguucaagaauauucugucaggcucuucuaaaaacuggacuuuugaagguuuuggaaauaaaucaaggagcagggaaacugaggugcagaggaguagacugaaugcuauacugacagucauauaacuaguaagaagcucggcugggauuaaaacuguuugccuccuagaguccuuuauuuuaaccucugccucucaugacagaagagaaccagcagaugguguggaaaucaguuuugaaaaucaauaagaggcaagaguuacugaacaucuaccgggaccagggccuuuauaacacuauaauaauucacucagaagacauaguaaauacugaaggaauuaaugaauacacaaauaacuucuacaucauucuuuuaacccugucauuagcaacuaugaucuucacuauacagaaagugaaauaaggcaaagaaaaauuacauaacguauccaagggaccagagcuacagccaagauacaaaccuaugucuauuuuauuucaauauuuuaccuuuuucucucuauuuuucugucuccuuaaauuuacagaaguugaauagugagugaaaucauuccuucaagugacaaaguucuuuuagagaccauuguauguuauuucaaggguauauaaugaaaaauuaucaggagagcuucaaauacagggauauaaaaucaaaauucacuuggaauuguagauauucaauauauucaauaguagauacucauaauuuuuuuguucaucuuugcuuguagaaaauaauucuuucaagaagaucagggacaacugauuugaagucuacucugugcuucuaaauccccaauucugcugaaagugagauacccuagagcccuagagccccagcagcacccagccaaacccaccuccaccaugggggccaugacucagcuguuggcaggugucuuucuugcuuuccuugcccucgcuaccgaaggugggguccucaagaaagucauccggcacaagcgacagaguggggugaacgccacccugccagaagagaaccagccagugguguuuaaccacguuuacaacaucaagcugccagugggaucccaguguucgguggaucuggagucagccaguggggagaaagaccuggcaccgccuucagagcccagcgaaagcuuucaggagcacacaguggauggggaaaaccagauugucuucacacaucgcaucaacaucccccgccgggccuguggcugugccgcagccccugauguuaaggagcugcugagcagacuggaggagcuggagaaccuggugucuucccugagggagcaauguacugcaggagcaggcugcugucuccagccugccacagguaugagcugguggcccgcccagucccacacugugcaaacauggagaaaugaagagcauagcagcauccaucacuugcuuccaaagugggcucacuagaaaacuagcuucccagaguguucauuacaaagagauuuuauguucaaauaaguguggagacugcagccaucucucuccugcuuggaggagucacggcgacaacugcuucucagaggaauuuucaggcuucugauaaguccugcuuugaaaaacccuauuuuaccuuaauuauaaguuucuaaaacguauuugaccaugaaaucuacccacuuucuaccccaaaaccuaugaguacgccaugaaauuucuaccccagagagcacucucugauagguacugcuguggccccaucaccucauuuuacaaauagagaaacugaggccuggaaagaggaugggauuccugaagguccuccaauaaggaguagaguuccucacauuucaguauucuuacaaaugcacagugcugccugugauagugcugaguuauaagaauuagaaaaaaguuccaauuuaauagcaauuacaaugauuacaaucauauaagcucccucuguguaacaggcacuguuguauuaucucauuuaauccucccaacagcccuuuaagguaaagauuagaugaggggaagauaaguccucuucuacagaucaaagaaaugaaucucaaggggauuaacccacuggcacaagauggcacaaagagcaauaagagauagggucuuuggcuaggcgcagugguucacgccuguaaucccagcacuuugggaggcuaaggcgggcggaucaccugaaguuaggaguucaagaccagccuggccaacauggugaaaccccaucucuacuaaaaauacaaaauuagcagggugugguggugcaugccuguaaucccagcuacucaggaggcugaggcaggagaaucacuugaaaccgaggggcagagguugcagugagcugagaucaugccauugcacuccagccugagugacaagagcaaaacaccauccgaaaaaaaaagagauagagagagagagagagagagagagauagggauuuugcaugugccugugugucuccagagcucauacucucccauggaugcccuguuuccacaugcauccuauuucaaggaauuuugcugcuuuggaauuaugucuuuaucuccaauaacuaaaguugauaaagcuacaugaguuucaacaacuucaaaucagagcugaaaaucuguuucugccacucagaaaaaaauuaccaaaauguucuucaacaauuauuucaagaguaaaccuaaccacccuaagugaaauagucuuacggcucugcaggacaggcucuagguuucuaaggcaauuuuuaaaaacauuuucuuuaggcauaaguuaguuuaucuuccacuucugucaacucccuggaaaaaugcagaugagaauacacaguaggaguaaugcuaaguagucaguuaaaaugauuguuuagagcagugcugucuaaugaaaauaugacucacacauguaaucuuaaauuuucuaguagucauguuaaagaaaggagaaagaaacaaguaaacauaauuuuagucaucucuuauuuaauucaacagagccaaaauauugguuuuucagccugaaaucaauaucaaaauuauuaauggauacuucucagucuauuauuuuauacuauuuggaaucugauguguauuuuacacuuacagaacaucucaauuuagacuagccacguuucaaugccuaauaaccacauguggccaagggccaccauacuagauaguacauacuuagacucucacuuuacaaaucagcuuuuuuuaaaaaauucuuucuuccugcugucaagaaugagauaaaauauauuaauacaagcuguuucuacguacagagacuacagagugaauauacucuagugcagagaauauagaacuggguuuuguuucuucuccuuaagcuccauggagaucagaccaaugacuucugcaaacugagcuaaggcaauauuuaggccucaaggggcucgaguaaugucaaccuugaccccacauucuuuaaguugaccuccacuuagccuucaggauagaaagaaauaaaagauaaaggcacuauacuuuucuggggacagagccaaacugaaagguguccuuauagaauuagaaagccauuagcuaccucauuuuaguugcggaaaauuagaauguuuugguuauauaaacccacauaccaacuugagccaaccuuccacaaaaaacuuuggaaaauaaaacagaaaaaaauaacaaggacacaagagugagcucuuaagggguuuacuuaacucggauauaccccagggaagugggcuauuggcccaacuucacguauaagaaaacuaagcuccagauagucuaaaucccuugccaaauguggcauagauauugaaucaaaaagucagaauuacauucaguucaacaacuauuucuugggcaucuuuuaugugccuggccuugaugaggcacuaaagaaauaauaacauaguggccagucgugguggcucacaccuguaaucccagcacuuugggaggccaaggcaggcagaucacgaggucaggauauugagaccauccuggcuaacauggugaaaccccaucucuacaaaaaaugcaaaaaaaauuagccgggcaugguggcgggcgccuggagucccagcuacucaggaggcugaggcaggagaauggcaugaacccaggaggcggagcuugcagugagccaagauggcgccgcugcacuccagccugggcgacagagcaagacucugucucaaaaaaaaaaaaaaaaaaaaagaaaagaaagaaauaguaacauagccccagccuaaugcauuucacaaggcagugacucauaaucaucauaggaauaguaagacuucuugaaaaugugacaaaaacuaugaauccgcuccccagggguggaaauacacacacacacacacacacacacacacacacacacaccccuaugcauaaucacacacuguuuuggcauacaagccuauaauuucagggaauucagguuaugaauuccuaccugguauaacaggaugugagucucaucugauuucacacacuacaacaaaugguucucaagccagauggagccugagggugcaaccguccuucagcugaauuugaaucugggugcccuggguagauacagaaaaauguggcugcuuaagccuggcugagaacuucuguuucuuuuguugcaggccgcuuggacaccaggcccuucuguagcggucggggcaacuucagcacugaaggauguggcugugucugcgaaccuggcuggaaaggccccaacugcucugagcccgaauguccaggcaacugucaccuucgaggccggugcauugaugggcagugcaucugugacgacggcuucacgggcgaggacugcagccagcuggcuugccccagcgacugcaaugaccagggcaagugcguaaauggagucugcaucuguuucgaaggcuacgccggggcugacugcagccgugaaaucugcccagugcccugcagugaggagcacggcacauguguagauggcuugugugugugccacgauggcuuugcaggcgaugacugcaacaagccucugugucucaacaauugcuacaaccguggacgaugcguggagaaugagugcgugugugaugaggguuucacgggcgaagacugcagugagcucaucugccccaaugacugcuucgaccggggccgcugcaucaauggcaccugcuacugcgaagaaggcuucacaggugaagacugcgggaaacccaccugcccacaugccugccacacccagggccggugugaggaggggcaguguguaugugaugagggcuuugccgguguggacugcagcgagaagagguguccugcugacugucacaaucguggccgcuguguagacgggcggugugagugugaugaugguuucacuggagcugacuguggggagcucaagugucccaauggcugcaguggccauggccgcugugucaaugggcagugugugugugaugagggcuauacuggggaggacugcagccagcuacggugccccaaugacugucacagucggggccgcugugucgagggcaaauguguaugugagcaaggcuucaagggcuaugacugcagugacaugagcugcccuaaugacugucaccagcacggccgcugugugaauggcauguguguuugugaugacggcuacacaggggaagacugccgggaucgccaaugccccagggacugcagcaacaggggccucuguguggacggacagugcgucugugaggacggcuucaccggcccugacugugcagaacucuccuguccaaaugacugccauggccagggucgcugugugaaugggcagugcgugugccaugaaggauuuaugggcaaagacugcaaggagcaaagaugucccagugacugucauggccagggccgcugcguggacggccagugcaucugccacgagggcuucacaggccuggacuguggccagcacuccugccccagugacugcaacaacuuaggacaaugcgucucgggccgcugcaucugcaacgagggcuacagcggagaagacugcucagagggugagugccagggcgcagaccagcauauaauggccaugauggaguggacuccuaguauggguuggaaaacuacguuuauauauauaaacauucaugcacacugauucuuuguacguauuaauauauccauuuaaacacacacccauaaugacuuuuuaagggggcccugucauuccguuguuacaaggugaccuauuuaagggcugaagggcucagagagguuauauaauugucccagggacacacagcugacacaucacagagcugguauucaagucugccuaacucaucuacauagaguuuaaaauaaaguuggagaggccagaacacaucuaguguucaagaugagguagauaaagggauacucucucuuuugcuaaauaucaacuuuauuuccuacucuccacugacaucaaaccaacaguaaacaaaaucucuguauuuggauggauguaaaaauucagcuaaauugaauacgcagugagauuacauaaaaacaacuguuucaaaugcauacuuggcuaaagacgaaaugccuauuaucuacaagauugaccugucuuuucauugucuuuuguaacugguuuuguuuuuuugauuguuuuguuuuuuuaauccuaaagacugcaagcuccuauccuuaaaagggcacuauuucuagcaguuaguaugggaccugguacauauuaagugcuuaguaaacccugguuaagugaaaacacaggagagaaaauuaaugcucauauuuaaugagugucuucuuuguacuccucucaucuacccauauuaucauugucauaauggagaauuuuuuccuuuacuaaaguuauugguaucuaaacauaaauaaauggcuuuguguucaauguggcgcaagcagggaagccugguuggaaagaacaccaggcuggcagggaggagauacaaguucuaaacuugaugaggugagcaagcuuggucaaggcguucugucuuacucaccucuauaauauaagaaaguuggaccagauaugcccaaaauacccucccagugcuagggacacguaacucaaaguucagagcagggagugaggcucagacugcacuuucccaugccaacagccugcaucugagcuaagacccaggaagcacagaaaguuggagaggccagaaacacccaagggcacacugcugaccugggacuccagccugaaggaaauggacuaaggaacagccaccacaggucuuaagauggaucacagcagggggucccugaugccaucugcauuuuagaggcaacagaagaucuucagaccucuguggcugacaguggaaaagacaggucaaacaaaccuagagagauuuuagaggacacacuguugacaccagauguccuuucuuauuccugccagugucuccucccaaagaccucguugugacagaagugacggaagagacggucaaccuggccugggacaaugagaugcgggucacagaguaccuugucguguacacgcccacccacgaggguggucuggaaaugcaguuccgugugccuggggaccagacguccaccaucauccaggagcuggagccugguguggaguacuuuauccguguauuugccauccuggagaacaagaagagcauuccugucagcgccaggguggccacgugugagugagcagaacucuuuugggcagccucaccugaugucagcccacccaguguauaacccucccucgccacggccccuacaauccuauaguuguucuuuacaguuauaccaaauaagagccuagaauuaaguccauagaaucacuuauuaaagaaaucccucauuuuccaucaaaucuuucuccuugcucuccuauauacuuccugccagagaaaaucauuacaaguaacauuuagcaaguguuuacuguguaucagacuuuguuguaagcagucuacauauuaguauaagaguccucauuuggccgggcaugguggcucaugcccguaauccuagcacuuugggaggccaaaguagguggaucaccuggggucacgaguucaagaccagccuggccagcauggcgaaacccugucucuacuaaaaauacaaaaauuagucgggccugguggugcaugccuguaaucccggcuacucaggaggcugaggcagagaauagcuugaaaccaggaggcagaguuuguagugagcugagaucaugccacuguacuccagccugggugacagauugagacucugucucaagaaaaaaaaaaaaaaaaaagaguccucauuauaugaguuaguauauguaugaaauaggagcuauuguuaaccccauuuuacagaugaggaaacugagacugcaugguuaagcaucuuaucccaagucaugcagcuaacaaggaguagaggcaaaacuuuaacccuggcaguccuggcagguuuauguucuaaaccacucuauuacuuuucaguggagaucacugacuauuuuucuuuaaguggaaacauucugguuuaugaguuuagcaucaguauaauuaccuucauaucuaaaaagcaagcucuggcuagaaauugacccuuuuuuccuuaauaauaacauuggcugccauuuauucaacuuguucugcaugccacgaaccaggcccagcagucuacacacuggaguggaguauaucacucacuccucaaugcauucccaagaaguagacauauuuaccuucuuuuuccaagugaagaaacucaggcuuagagcacugugugcaauugcucaaguucacauugauaguagagcuuagauucuaaccccaagucugucugauuccaaagccugcguucauuuuagauuuaaacauaugaaauugccaaaauuaaucauaccauuuuuccuaauauuaauuuuuauacagccucauagagaccucaucccagaagaagcuuuaaaaggacaccugcucugguugucagccccugacuguugcagacauccagucugguuuaguggaaucguggccgcguugcccaaucacacaccugcccuauccuuacguucuauuuauguuguuacuuacagacuuaccugcaccugaaggccugaaauucaaguccaucaaggagacaucuguggaaguggagugggauccucuagacauugcuuuugaaaccugggagaucaucuuccggaauaugguaaggaguacaaaagagcagauccauuugaucucaaggauuugaaagaugaccaaaggguucugaagacuucuguaucaacuaauuuuccuuaguuuuugguggaggacaaggcucucauuagcaucauuuguguuugcaucuauauuuuaagggauguugguuuuucccugauuuuaauaaguaaguguagcacuuacggcugacacccuagacaaauagaaguugucaccucaagguuccaauuguccaucaucaccuuagaaaucucuacucagaggcaaagaagagaagaaacagucucucccucaaaauaaagguacaucucagauuugagcaacccuucucuccaggcccaaaaguacaugugaagcagggaacuuguucucugaauuuaagcccaggcucugccaccaaccagcugugugacuauccaacaaucacccuacuccucugaugcuggccucagucuacccaaggagggauugagcuugugccuucagaauuccuuuggcucucacauucugucauuugacuugcaugacaaagggguaaaaguuuacgaaugggagaaacaaacuagagaaaugucuuuaucaucucuguauccucaguagcuuacauacugaucugaugcauaguaagugccuaaugaaucgaugaaagaauaacagaggaaugaaugaaugcagagugaaugaaucacauaaauuaagagacuggcaccuccccuaacucuuaccaagcugccucuaucucucagaauaaagaagaugagggagagaucaccaaaagccugaggaggccagagaccucuuaccggcaaacuggucuagcuccugggcaagaguaugagauaucucugcacauagugaaaaacaauacccggggcccuggccugaagagggugaccaccacacgugaguaucaccuuuaauacuuauagaaugauaaggcugauuguaccucauagcaccuccugguugagaaagugccuucucauauagcaucuacaucauuuaacuuuugcugcauuuuuaaaaauccagauacagugguuuaaaauaacaauucuuugcauguuggugauuuggguuugggcucagcugagcagcuuaucuguucuugacugcacuccucauguaucugugugcuuaagggguggauuggccuaggauggccucagccaggauggugucuuucuguuucgcagagccucucauucuccaggaugcugguccuguucacacagcuauugaacagguucaaaauuggcauuagaucacuucuaucaaagcacaucccacggccaguuuauauuuaaggaauagagaaacagauccaucucuugaugaaaggaguuucaaaaucuccuuucaaaggggugugacuaccugaagauaauuaagcccauugcuaacaaucuaauuagcaucaugucacuaguuuaauauuagcacccaguuguaggacagaggaagggaaaauauuaauguuaaggcuuaaagaagcuaaaucacuuuaacaucccauaguuaacaccaucaggggcauaacuuuaagccaggguaaguuuuauaacuuuaaccccauuuccacuaacauugacuaggcucugguuuauguagaauguugauuccaucucuucaaugggaaccuaaauaaaauuucauucaauacuaaugaugucagaaguucuugggaguagaauaggauuuagcaguacuagaucauuuggugagaaaaagaccugaauuuggaguugcuccaccaggaaacauuuuuuuuuuuuuuuucugucacccaggcuggagugcaguggaacgaucucaguucacugcaaucucugccucccagguucaagugauucuccugccuuagucucccaaguagcugggauuacaggcucccaccaccacaucuggcuaauuuuuuuguauuuuaguagagaugggguuucagcauguuggccaggcugguuuccaacuccugaccucaagugauccacccgccucggccuccuaaagugcuaggauuacaggcgugagccaccgugcacagcugcaauuuuuuaaaaagaaaaaaaugcauaauuuugcacuuccauauaggaaaaccucuuuauuuucuucaagauaacauaugcgccaacucuuuaaguaaucgacucuucuuggcaggggguuguuggaaaaauuaaaucaguugcuaaugacaagaaagaacaucuugcauuuaaauauuugcacauuuugccuagcucagagccaauucaaaggauuuucucuuucauaagcaaguguuuuccaucauccugacaccaccucucugugguagguagaaaagcagguaccaacaggaaaaaaaaaucauuagaucaccagaaagacaaagaaaagacaaagcaaaugcuuaguugcuauggaggaggugcacugaacuuuuuuuuucacugcucuuuuguuuaucuaaauuugggaauugucugcuuuauuucuucuuauuuuagaacaaacauuccaacauuugaaguugcauaaucauaaauuucaacauagggggacaaauauuuaccuguucauuuuguauuuuuaguagagacaggauuucaccauguuggccaggcugguuuugaacuccugaucucaagugauccacccgccucggccuccuaaggugcuggcauuacaggcaugagccgccacggccggccacaauuuaccacauauaccugaaaccuuuaaaccuuuaaccuuuuuuccagauguaaagggccuuaaacuucuaguucagaacacauuuggcuccuucugucuggcaucuauauaaaggugguauuauacuuacuuuugaggucaauauguuugagagguguugucauguaaagggggaaaaggaugggcuuuggauucaaucaguucugaguuugaauuccaucuuuaccauucaccaucaccuuggaaaaaucuauuucuuuaagcuccagauccaacagcugaaaaauggguuuauaguauucuccuuguggggucgucauaagacucaagacauaaauaacaaagcaccaucuuugcaccugauaaauacagagcauuguuaguuucugcuauucaagggucccaaaucuagggggauaucaguguccuugacggaaacccaacuucuuuaaugcaagggguacuaaggaagguaguagguacgguuugggugcuugcuagcaccuauaagaacacagagcaggcagcuucuguccauuuuugcgacaucauuuucauugugcauuuuacaucaucugugagcugggacugaugugucaacaccuagacuucaaaaacagacucugcaguuuucucacaaucugcuguaaauuauuguuccuuuucauucccuguauaaagcccacuuccugucacuuguuauuguuuacugaaccaaugcugaaaacacauuuaaaaaaaaaaaaaggagaagaagaagaaagaaagauucaaagauucacugaauacccagaauaugccugucucugcugggaauuuaaaagacucacucucucaaucaaugaauaacccuaccuaaauugacucaaacuguacagaaaucuguuaugaaacaaugagacacguaugauauuagaaugcucuucaaggacaguggcagccacagggagggaauauguguuuaccugacugaagccggguuaaaaaaaggcuucucauuaggagacaacauuuaagugggauuuugaaggaugcauaggagauuuuuagagggaaguaugaucuuagaaagaagaaaugagagaacagcauguacagagaccaggcggugcccaacagcauaaugugcuuccagagcucugagcaucuaucagaguacaacaccagaguagguggggcagaaaaagucaagaugagccugcaaaaacaggcaaggcuugaaauagcaaugacuuucuugcgugaauucuuucuaucaaaaauaaguuuccauacacugucaagacagucuauugccucacuuuucugcuugguaauucugauggaaaaguuuucaggaaacauccaggaaguuuugccuaauuaaaaauuuaaagagacuaaguucaucuuuucaaauaaaguauccccaaagcauguuuccucaacuuaugagaacaguaauaauaauaauaauaacaaaagaacaaccuuuuuuuuuuucaugugacauccaugggccagucucugugcuagaugcuuugcaagcuuuaucucucuuaagauuugaaaaaaacaaaaacaaaaaacacuagagguagcugcuguuaucccuacuuauagcuuaucaaaccaaaaacuaagguucagaaaggcaaaguaaagucaagcaguuaguauaaguauucacccacaggucuggagaguuacaaaguccucucucugcuaagccucaggcaauggcccuaaccucugaagccucucuguccucugcccaucauaggcuuggaugcccccagccagaucgaggugaaagaugucacagacaccacugccuugaucaccugguucaagccccuggcugagaucgauggcauugagcugaccuacggcaucaaagacgugccaggagaccguaccaccaucgaucucacagaggacgagaaccaguacuccaucgggaaccugaagccugacacugaguacgaggugucccucaucucccgcagaggugacaugucaagcaacccagccaaagagaccuucacaacagguaaaaggccucccccuguuaacagauauaguaaaggaaagauugaaagauuuccaucccacuccauguugggguaucuuccaggcucauuuuacaguacgaaaaaugaaagggguauuucuacuccuguaaauuuuaaaauauuguagcaauuuauuaauuaauuuuucaaaaaaaauuccaaauaaccuuccaaagcacuuuugggggugggggacauauguagaagaugcuggucugauauucucagacaaaaguucugguuaaaauaaaguucaaauaaauauuuuuaaaguaaaauaugguauauggaaaacauauaugacaaaugagccuccuaacacuuuagccuacggcauuauuuuaaaaguucaaaagugucaauuuuucauucaguaaauauuuuucagagcucaguaaguacuuugugaguuauuagaaauaugaugaggaggccgggcgugguggcucacgccuguaaucccagcacuuggcaggcugaugcaggcagaucaugaggucaagagauggagaccauccuggccaacauggcaaaacccugucucuacuaaaaguacaaaaauuggggucaggcgcaguggcucacgccuguaaucccagcacuuugggaggccaaggcgggcgaaucacgaggucaggagauugagaccauucuggcuaacacagugaaaccccgucucuacuaaaaauacaaaaaaaauuagccaggcgugguggcgggugccuguagucccagcuacaggcugaggcaggagaauggcaugaacccaggagguggagcuugcagugagccgagaucgcaccacugcauuccaaccugggugaagagcgagacuccgucucaaaaaaauaaauaaauaacugggcgugguggugugcuccugcaaucccagguacucgggaggcugaggcaggagaaucacuugaaccugggaagcagggguugcagugagccgagaucgcaccaacacacuccagccuggugacagagcgagacucuugucucaaaaaaauaaaauaaagaaugaaauaugaugagaaaaugcaaaagaccaguuuuuacacucaugagcuuauuuuuaagucuuugcauuguuucuuuaaccacaaagucugagaaaaacacaaaugacuaaagugucgcacucauccauaauagggaaaggugccaaaucuguagcacuuguuuagauuugcacauccacuauggggacagaugagugugcugagaauuuuguaauuucucuccaguuccaggcacguuucauaugucagcuugagcugucaaagacuccugcucucuugugacugauauguucaauacaaauguuccuucucucaaacaggccucgaugcucccaggaaucuucgacguguuucccagacagauaacagcaucacccuggaauggaggaauggcaaggcagcuauugacaguuacagaauuaaguaugcccccaucucuggaggggaccacgcugagguugauguuccaaagagccaacaagccacaaccaaaaccacacucacaggugagcucugcaucucugcaagccugagccagccagcccuagagggcccuuaaaggaugggcaccugcucccacauguccccauuugcaacccucagaaauaaguccaauuuccugaaauacugcuuauuggauugcagugaguucuuuuguaaaacauuccgaaaauuuguuguagccuccagagaccaacucaaagccauuuuuaucauccucugaaagucucucugauuucaggaugaaucucaacuugcacauucucuccuuaggucugaggccgggaacugaauaugggauuggaguuucugcugugaaggaagacaaggagagcaauccagcgaccaucaacgcagccacagguggggcacaccuggaauucccaucccacugagcuggugcugggcagaugagacagagucaauguggccaaaaccuauuuaaagagaaaaaguagaagccuggaggaaaaagggcccuguaguaccaucuagccccaauguugaaauucaaaaggaacauaaguacgguccaucuguaugaugccaacaucauccccuguauggaaaaggggacuggggauuuuguguuuguuguuguuguuguuguugagauggaguaucgcucugccaccaggcuggaguguaguggcaugaucucagcucacugcaaccuccgccuccaggguucaagagauucuccugccucagccucccgaguagcugggacuacaggugcauaccaccacgcccagcuaauuuuuguauuuuuaguagaaaugggguuucaccauguuggccaggauggucucaaucucuugaccucaugauccgcccaccucggccucccaaagugcugggauuacaggugugagucacuauguccagccgggauuuuuuaaagaaaaauuggaaccaggcuuuguaagaaauucaugaacauguguaaguugguaaucaguugcaucuuuuaaauaaaccauuaucuaguccaaacacaacugugggguuuucucugagaaaacaccuaacuuuuauaccccugucaagcagauuauaaguaacaggauuguaguuuaaguccaggcccugcacuuaccuguuguauccuguagccgcagcuuguaggugaggaugcugaggggcuaccugauuugaggucauugauucuuuccucaagauuuuuuuuuccauuuuucugggaaguuugcacugcaaaaagaaaacuccuccucugccucucccccagcccccagcuuaccuccccacaggcacuaugaggaagaaggaggcuaguguguaaagaggagauggaucaucauugagcuuccacauuaugcgggaugcaaggccggacauuuacaugccaauucuuuuuuuuuaaucuuuugauuuugagauaauuguagauucacaugcaauugugagaaagcauacagacagauccccugugcccaucacccagguucccccaaggguagcgucuugcauaaauguagacuaauauaacaacugagaaauugacauuggcguaaucuguccacucuauuuauauuucaccaguuuugcauacacucauucguauguguguguauauacuuaguucuaugcaauuuuaucacacauguagauuugugaaugcaccacuagagucaagauacagaacagucuuacuacaagaaucccacaugcuacccuuugcagccacagccaccucccucccuuugccccucugccuaacccugggcauucauuuaucuguucuucaucucuaugauuuugccauuucaaggaaugcugcauaaaugggauccuacacauauuaguccauuugaguuacuguaacaagaauaagaauaccuuagaccaaguaacuuauaaacagaagaaauuuauuucucacaguucugaaggcugcgaaguccaagaucaagaugccagcagauuuggugucugaugaaggccugcuuucuggcugacagcaggccaucuuuuuacuguguccucacaggacagaaggggcaaggucucuuuuauaagggcaccacucccauucaugaggccucccaaaggucccuagauccaaaugucuucacauuggggauuagguuucaacauaagaacuuuagagaggcacagacauucagugcauagcaauacagcauguaacauuuugaaacuggcuuuuuuuccuucagcauaauucucucgagauucaucuaaauugcuucuuuuaucaauaguugguuccuuuuaacugcuuuaaaucugagcagcauuuuauggaauggauauuccaugacauuauuuucaaucuucucagacuccgauggggucaugugggugauguauaauuagaccuauuuuacaaaaguaaaaagagagacccagagaugugacucuccuguggucccucagcuccucuguggcagaccuaggauuccagcccagaugcaguugacuuucagccccagaagcagcccugucuugcagccugaagagcauucaucucucuguucuccucccagaguuggacacgcccaaggaccuucagguuucugaaacugcagagaccagccugacccugcucuggaagacaccguuggccaaauuugaccgcuaccgccucaauuacagucuccccacaggccagugggugggagugcagcuuccaagaaacaccacuuccuauguccugagaggccuggaaccaggacaggaguacaauguccuccugacagccgagaaaggcagacacaagagcaagcccgcacgugugaaggcauccacuggugagucugcccugagcuuccuccaaacucuagguugauucugagguuagcagaucuccucagccaggguguccucacaugagaaagccaaaugcaaaagcaagccacuuucuccaucucugaagccccugaacaccacuuugaaagggcugcuuacucgucuuuucuaccuccugucaacugauacagcaaauuucccccacugggaaauagggguuuuaaaauauuucuuccuaggagaacuuuaaacaucaggguuuguguuugcauuuaccuaugauuuuuguuuucuuuucuuaacugugcaucacagcaucuuuucaauuguuucuuguuuauuuccuucuuuuagccuaauaauuaauuuacuuuucauuuuacuucauuuaaagaugaccaagauguugguaauaauauuuuuuuuguuguuguuauuuucuacaaacuguuuuuauuccaggucuuuugcuuucugccaagguuaccccugaagaguggcacacggcccuuugagacuuccauggugcccucucauuuucucuuuucucuuagucauuaagacauuaaccuaguuugucuaugacgacagcuuaauccugacauuguggcccaugcaacuuguguccauucuggcccaugcaaccuguucacugaaccugaggccaugguuacucgguggcuaaacugaagagacaaccagguuuuuaaaauauuucuuccuuuaugaaaaauaagccuauucaauuuuggccaccaaauauucgaaauguauagguggaaaauguuacuuuuccaggguuuggcaaguaauagucuuuacuuccaauuuaauuaguaagcauguauugaguaccuacugcauacauuguaccguacugauauuugaggaaaaguaguucccaaagucagcauuguuauguggacucauuugugccugcucauagugcuugcggaagacuagauacucagaaugcuagacagaacucgagaaaaagagugauccaaggaaaucaggagagcuggcaaagguguuauggcaagggauguuauuccaguugaagcuugauaugcaagaaaaggguuagaaguguggacauauuuggaaauggcuugaagagucuuucucacaauaucuucagucucaaaucacagucacuuacuuaagauagaaguugguuuucuuucuuauaaaaugaaucuggagcugggagguacagggauaacuuaguaguuucaaauugucaggcacccaggcugcuucuuucuuuuccaccauuuuuaguccuuggcuuccauucucaaagucaucucagugucacaacauggcugcuguaauacagccauuccaucuguguucuaggcagcauaagggaggaagaaccaaaacucccaaagaggagcaccuucugggugagucuuucuggaaaccccaccaaucacuucuccccauaguucauuggccacuccuagcuguaagggaggcagggaaagguagucuucugucugaacauguuacuuccacauaaaauugaggucauuuguaagagagaaauuuggcagacaaugagcagucccugccagagucugaaaugaguuuacguggucaauucuguugacucugcauugacugcuucccacccaacuauaagauguuuauaaaggaugcucugaaagaauaguuuaauuaaaaaauaagguggggggcggggauagaaccaagaagaaauaaaucuauaguagagauuuaaauuucagcuuuauaaacaugagcuuguuauaaagugucaaggggcaacaaaugaaucagaaaugcccaaaagaugaaaucccucucuuuucuuucucuuucucucucuuucuucccucuucccucacuccugcucuucuuccuccuccuccuuccucugccccucucccuuagcuuucccuugaguuugauaaaugcuguaucuaagagagauuccuauugccccucaaucauuccaccuucuggugauggccacauugccuccuuccuccagugagaaaaccucacaccugcgcagucacugaagaaguuuuaucucccuaagauccugagguguggggcuucuccacuagagaaaggagguaauguggcuauaaccaggagauuuacuagcuagaauuauucuguuucugaaugagagccccauauuggcauuccaaagccucagcaguugcauuuccccaccacgccuccuuaaugccauuucaaagauaucauguuucguauuuaaagacauucuucagugugggaaaaaugugcaaaguucuuuuuauugguucuucuccacuguccacagacuauuucccccaucccuuucuccacaggaaaaaauauauauguuucauuuaaggugaagcagacgcuucuuucccuccuugaauucuaacuuuuaaagccuucugcauucacucagucaauaaaauacuaucaccaugcucugugcuaaguucugggguuacuagagcaaagaagacggguauuuaauuccaaggaacucacuguguagcgaacaaacagacacugagauaacauucugcucacuacgaucgaggguacagagggugcagccagugcucaggagacacuggaucuaacuucagagaaucaggaaaggcuuacaaugggaagacgcuuuuggacagagacauaagaggcaaacauagauguguuaaauggaauagcuaaagaaguagaagcccaggcaccugaccuugguaagcauagaggaagaaagaaaacaggaaaagcgagagcucuugggugaaggagccauguggcuauaaguccugaaauguugcagaguuuuagguucaaccaucagaagcaagaaccuuccagcucuguaucacuggauucuuaauagcagaagccugccaggcgccacucaaugucuguggggcuuacagagaaaaaugaagaaucaguggcccugaagaauuuuuccuggggaauuccaggguuuuacugauggauugggccauaauguaagucuuuuucuugauguggcaccauacuaaaaauaugcauaaccuggccaccuaucacaccucucgcccaaagacccagccauggguuacagggcccuacagaaucuggcacggccagcccauccucugaccucaguccugccacucauucccuugcucacuucaccauggccucuugggccuucacacuguuccuuaagcuuucugagccugcucccacccucgggcuuuggagugugcugcucccacucccuggauaccacucuuuucccagcacuucacagagcgugcucccucauuucacucagcagcucagauaugacccagaacagagggcuucucugacuaccagccuaaaaaggcacccccauccugaucuaccccuucaagcugcucuagguuuccuugugaaacuuaucugccuugauauuaugcaaguauugguuuacuauaauaucuauggccugccuccccaucagugagcagaauauaaggacugauuccaucauccacugcugaaucccagugcccugaaggcagacaaguaugugguaugagcuucaugaguguuuagggacccuggcuacuucagagucagcauuuccauagaaucuucugauucuucccuuccaccucugcauuaacaccccaauucuuuccuuaaggcauaagggaaaucauucccuuggaaagucuucaauuccgcuuaaucuggauagaaaaggaaggaaggaaggaaagaaggaaggaagggaggaaggaagggagggagggagggaggaagggaggaaggaaggaaggaaggaaggaagggagggagggagggagggagggagggagggagggagggaggaagggaggaaggaaggaaggaaggaagggagggagggagggagggagggagggagggagggaggaagggagggagggagggagggagggaggaagggagggagggagggagggagagagggagggagggagggaggaagggaaggaaagaagggaggagggaagaacgaaagguaccgugucuguuggcauuuaaaaaaauuaguguguaccaggcaucauucccucuccuccucucccauucccucccuucucuuucccucuccuccacucuauucuccuccccucuccuuccucucuucuccccucuucucucuccucuccucucucucccuuuucucucugcuuuuguacucuuauaaacccaacuaaacccugcuuaaggucaaagccaugaauuugcugcaugccauaagagacaggaggcaggggugauaggcagaaacauaaagccagcaaagcauauuuucauagcaacauaagccuugacagugacaacccaguagcucucaggaauuuuggaagaagaaagguggaauuuuguuuuuagccacagcuaccaguaauacagaacauucugcucuuauuugcuauuuugauuuucucacagaccaaacugaaauuuauucaaauauuuauucauccagcaaauauuuauuucauaccuacugugggucaggcgaugccgguguauagaagagaaagaaacagcuucucuucucaagaaauggugcacguugcuauaagagagagaaccaaaacccaaauuauaacacuguagcuuaucuguuuuagagggauuugugggaggcugcaggagcauacagacagguacccaucacagaccuaagcaaagggaaugaaaagcacuggagaaggcuuuuuggaagaagugauguuugguugaguucugaaaaagaaaaggggcugggcaaguggagaaagaguaaugacauuuccagcaaagggaauagcaucugaaaagcugaaaagcaugagaaacuuuaccuuagugaacugcaagcuauacaguccugcuauaugauagagugggaaaacaguaggguaggaggcuagagacaucaucaggggcaucugcaaaggggcuugguucuuggcaguuacaaagaaaucaccgaauguuuuaaggcagccaaggcuucucauuucaauugucuuaucucugagagaugagaguaaagcgacugaagauacccuuugggguugucaggcuuggaugugaccaugccccugcugugggagaaucacucuuucuccccuaaguggacgcugaagugaguuccucaucaagccagcacuugguaaucacuaucuagaagaugguaacaaucuacagauuuuuaaguuggcacugucagaaauuccuccagaccagcugcucaacccaccaggagcacagcaauggguuucaaaauucugauuucccaggcccacugacauuguucaaggguagauuccagugcacagcuguaagaagaagacaacagccuuuugauaaagaaaugccaagaaauucaguguggaaucuauaauggaaacacuuggcuucuagggcaguaaguccacaguaugucauuugcaguugaaauguggagccagcauuuaugugaagccucuugguccucaucucaacuauuguccacuguauuuuuuauucauaauauucccccuucuuucauaauucugacccccucucucuuuaauuuagcuacugauuuuauuuguggaaguuguaccuuuuacucacuuggcuagcauuuauuuaauaaagggaucuggauggggcacacguagcauccacuacugacauggccacaguacugccucucugaguuauaaaccaaugcucuuucuugauuugccuaccaaaaaaaaaaaauaguagagaaauagccaaaaguguuagcagaaguaccaacaccaucacuauuacuauuuacugaacaacaugacauuauguaaaaaaaaaaucacucuaucaacuauaugaacagaugaaacaggauguggggacaauuagaugaaaguaucaguggcauacuaaauauccgauucaaagagauaagaugauucucauuaggaagagacauuuuccaacgugcaucuuuucucuccauccaucuuuugccacagcuuaaugggcaauccacaaucucauucccccaccccccguaagguaacuuucccaauaucucuuucaagggggcauuuaaaauuuauuuuauagaaaaaaauguuuuauguaacaauuagacauaaggauuaaaagauagacacccguagaaaaaagacaguaacuuaauucacacgaagggguacguugucaaugacagauuaguuccugacagguggacagcagagaaacaaaaacaggaaagugggauaagaaggagagcuaagaagacauaggguugauuuaauuuucacuuagcucuguuuuuguccuauaucucuuucuguaucaggacugcugaaauauuugagaaggacaugcucuugaguuuaguugugcuuaaaucccaaugucaaggguauaaucacuauauccagggaacuguuucuggccucacaaggcccagcaggauuaaagguaguugacaccuccuuucuuuuccuaaaucuagauacaucacuugcaguuugggguccucccuuucucauaaagaccauguuuaggugguuaagaacugcuuuggagccucugguguaagcuuuaggauaugagucgggguuaaagaggagucuguauucaagaucaaguauugcaaacauuuucuguaaagggccagaugguaaauauuuuagacuuuauaggccagagaguuuccauuacaauuauucaacugcacauuuuguaacacaaaagcagccaucaacaauauauaagugaacaagcauggcuaugcuccaauaaaacuuuaucuguggcaccagaauuggaauuuuauaugacuugcaugcaccaugaaauaauauucuucuuuggauuuauuucccgaccauguaaaaaaguaagaaaaacuguuguuagcuugcugacuaccaaaauaagcagcuggccagaugugggccucggguaacaguuugcggaccucuguucucgaucaaacaaaauuugaaggaguguaugcucugacaauaugaaacaagcaggaagaauguuccccagaacuuagaaaugucugaguuaaaucaauuccagaaaagaaauguuuucuccucugaaaggauauccucaaucaaauuccaagcuaagauuuucaacuuaguagccugcucuaauggacacauaaggcucauuugaaauuagcagcaaugugaaguauaaauagaaaaaaacaguuuguucuuuuaaaugauuuaaagucaguuucuacucucuaguuuacaggauccauuuccagagaaauacuuuccuuccuaaacuaugcaaaguccacuuaagcucagcccugggcaaauuaucucccuuaagucagguugagaccagugaguuuuuacggaauuucgugcauucgcgagaugaaugaacagggugcauucaguuuuacuugagcuucauaagaucugcuucucccaggaccucuuucuuuuuucuauuaaggaacaguuuuucaaagccuuaucaccuuccuuagcucagccuuaauaauacugugucaaugugucucugaucuuuacuaauaugaucuauguaaaugauuugaacgcuagaaacugaugaaaucccaauauaaacuauacaacagaccucccauaggauauugaggcagcacaaaaaagaagaggcuuuuuuuuuuuuuuuuuuuuuuugagauggagucucguucugucacccaggcuagagugcaaugacucaaucuuggcucacugcaaccucaaccuccagggcucaagcgauucuccuaacucagccucccaaguagcugggauuacaggcucacgccaccacacccagcuaauuucuguauuuuuuguagacacgggguuucgccauguuguccaggcuggucuugaacugcugaccucauaugaucugcccaccuuggccucucaaaaaagaaggguaucuaagaagagccaauugucucaaaauacagaaggucggacagcucaaaccaagacccccagaauaacugagggccaccccauuaugaugcaagacauguuccaaaaugaaaacugaagcucagagcaucgcuaacauagacauauaguuuucuaaaucugcaggacacugaucaauaggaaaauaccauuuccaagagaaaaacccaaauaugcaugaaggcaaaagaaauuuuuuguuuguuuguuuugagacagagucucacucuaucccccagacuggagugcaauggcgccaucucagcucacugcaaccuccaccuucuguguucaagcgauucuccugccucagccuccugaguagcugggauuacaggugcccaccaacacgccuggcuaauuuuuguauuuuuaguagagacaggguuucaccauguuggccaggcuggucucgaaccccugaccucaaaugauccacccaccuuggccucccaaagcgcugggauuacaggcucgagccaccaugcccggccacaaaagaaauaugacauuguuguccugcugguguuuuaauagggacagcaccaguaggggaugcagugaacaaagccuggcacuuggacugcaauggccuauagauguggcauuggguuugccauucccagguucucagaagcaaaacuuucugaggaauaguuuaacugaccccaucucugucauuauucagaacaagccccugagcuggaaaaccucaccgugacugagguuggcugggauggccucagacucaacuggaccgcagcugaccaggccuaugagcacuuuaucauucaggugcaggaggccaacaagguggaggcagcucggaaccucaccgugccuggcagccuucgggcuguggacauaccgggccucaaggcugcuacgccuuauacagucuccaucuauggggugauccagggcuauagaacaccagugcucucugcugaggccuccacagguaucucuuuccuuucuauuuauagcuucuguuuuucccagcaggaaacugcccaugaauaaucagacacgacuagcuuuggaauggacuuguucugccacuacuuaugucuauggggucuaauugugacacgaggccaucacgcuacagaaccccaaggcaacuuuuaauacuucacuccacaugaaugacacccuugggaguuguacagagcucaaccugcaggacuaaacacacagcucccaugcagagggccuuuagcuccauaaacagccucccuccuguuaaaggacguuaaggcacuauauaugaaagggaaagaaaaucacaaaauucucucaucuacugaggguuaaggcaauucuuuaagauuuaaaaaacaaacaaaaacaaauauuuuccugcacuuuccucucuuugcuccauuucuaaaauuuaaagaguugcaugaugcauguuuaucuaaagaaagucacauuuuuucaguaauauuauuauucagcuuauucuuguguuaaagauucccuggaucuuguugugugauuugaucacuaaacuaguucuuuguccuucuccaggggaaacucccaauuugggagaggucgugguggccgaggugggcugggaugcccucaaacucaacuggacugcuccagaaggggccuaugaguacuuuuucauucaggugcaggaggcugacacaguagaggcagcccagaaccucaccgucccaggaggacugagguccacagaccugccugggcucaaagcagccacucauuauaccaucaccauccgcggggucacucaggacuucagcacaaccccucucucuguugaagucuugacagguauucuagacgaauucacuaauucacuuccuccccuuugucucugcucgggaggaaucaaagcacuuucuugcuuuaaacugggaucagcuccuaccacauuggggaaauaccagugaaucaucucugcuucuuccuaaaugucacaucccuuauuuggcuaaguccuaguuguagcccaguuccauggaaaauuccaccuacuccuccuuuaaaaaagugagagguggcuuuucuuucaaaguaaguuucagucacaauaucuaaaaaguuggaaagcccaaccuguaaaugaagaaaaaauagcucugagcucaugagcucauuuuaagaacaccaaaggacuccccauagcccuauuuguaugucaagaauagaaauugugaacaauuccuaaaacuacuuuucauucccaaaagcugaauagaaaaacccuggcuuuagugccaacaguuugagugugcucaacaccugcuguaaaucaugcaucuauaaucaacacuaaccagacaacucaucccaaccuuagccaaaaugccaucucaccugaaucccagcgugcaauugccuuuuuaaguaacucagcaacucuguguccuuaugcagaggagguuccagauaugggaaaccucacagugaccgagguuagcugggaugcucucagacugaacuggaccacgccagauggaaccuaugaccaguuuacuauucagguccaggaggcugaccagguggaagaggcucacaaucucacgguuccuggcagccugcguuccauggaaaucccaggccucagggcuggcacuccuuacacagucacccugcacggcgaggucaggggccacagcacucgaccccuugcuguagaggucgucacagguauaugacccuccucccagacuggagacaugauaggagccagcaugucauugaaauagagaaaauucacccguguggcagaauccuaccccaauguuguugacagacagcgugaaucucuaacucaggaaggucuguguuggaauuccaccucacuagcuaaauauucuugggacuauauguguauguauauauauagauacacauauauacacacacacaaauauauacuuauauauauaguguguguguguauauauauauauguguguguguauauauagauauauacuuuuuuuuuuuuuuuugagucagggucucauucuuuugcccaggcuagaaugcaauggugugaccauggcucacugcagccucgaacuccuagacucaagugauucuccugccucagccucuacaguagcuggaaccacaggugugagccaccacacucagcuaaguuuuuuguauuuuuuguagagauggaguuucaccauuuugcccagccuggucucaaacucccgggcucaagccaucuucucaccuuggccucccaaagugcugggauuacaggcaugagccagcgugcccuaccucuauucuuggguauauuucuuuacaucccugagccuccuuuuuguaucuuuaaaucagcaaugaacccuacuucaggaaacugucgugagcaauaaauaaguuaaugaaugucagugcuuaguaaagcgcccaucacguaguaaauacugaauagcaaauagcuaaauuuaucauacagcaacagagucaugauuuuuaaaauagcacaaacguuagggcuguggcacaaaaauaagaucagaacuuucuagaaaaaccuuauuacuagccucagagccaccaacuaacacccaccugauaggcagaucucuacauaauaaccuuuagaaaugaugcaguuagcuucugcugaaacuaucuaggacucucuccucaacagauacaaaaagcagggacauuuccaagaaaggacagccaccuuugacuucaaugcuuuucauucaauuugggaaggaaaaacaauuccucucaauuuuccaccaaaaaugagcugcuccaucuguuauaaaaaacugugcuguacaugagauuucuagaaauagcuucaaaaagggcuaugggaaaaagggccaacuuuuuggugauaggguuucugugcugagcccuaagcccaugccccacucuacauaugcugccuuuugauaaugcaauccaaaucacucaauucaaaacaauuguuuuccuugcucuuauauaacagauaaacuuggugguugcuagaaacuacauaaaauuccaaaaauaagggggccagguuuuauuccuguguugccuggaauaucuucagaucaaacaagagcaaaaagggccuuugagacagguguggucugugugcaagaugcucauaucuuccucuguaguccgcaaacuuuuguuuuuagcaguacaacuccuuuugcaaaugaaaucuuccaaggaacccuacuauuugacagauaagugaacagcuguucuuggugugccuggaaguaagagggggauaccuccacccauguucucaacacaguucuucuagaaaagccccagaucuauguggaacacaguuugaaaauaaccccucuuaaaagcaagagguugcucagagguugcucagacucucacagggcauugaauccuuggauacccaagagcaaguaucuauaucuuucaacuauuuuugguugaaaucccugcagauauucuccucccuaacuucuaacccauggccacuucagccuucaaaacaguggcugagagacugcauuuaacccucagaagcaucccacaaaacaauggguuuuuccauauccuaaauccaaacuuucuaaaucaccaauaacaacuacguuaaauuuccuuucuacauuguagaagcaguaauaguggguucuguucugcaccauuuacugagaaaaaucuccuuucuuuuaauuaaaaguaggcacacucauuucacacaaacagcuuugcucugugauacagccauucuuccuuuagacauaaaguacgagcagaaaaagguggaagaagaaacaagcugagaacccaguacacaacuuuugaucccugaaagcugauagaagaccaaagaaaaaacaucauacuuguucacaccugagacagcauacacuuuaucaacccaggcagguagccaguggcuagugaugagauaaucuuucuaauuauaaauaaugaaauaaagcagggauuucucccugacaugaguaagaaauuccaagggaaaacacuugaacaaugauuucuuuauuaagcugacacuuauugggcacucgccauguaucagguaugauacuaagaaguugauaaauauuaccauuuaaucaucacgcaaucccaugaaacaguaccaucaacuccauuuaaagguaaagagaggguggcucagagagaagcugagugacaugcccaagauuaugcagcuagcaaaugcuaguauugggauucuaaucaaggacuacuugccuccaaauucugcacuuguaaccauugcuguaucucuuacccuaacccacaauccuacuuuuccaugugaauuucaccugcuagcaaugcaugcucccgguggguugugcauuggugcagaugucuuugccaucucaaggauaaaccauguagauauuucccuuucuggccauuuucaacuccugaagacaacuguggccagggaaccacaguucaaauugcaaaugcucagagaccaagaauuaaaaaaaaaaauuaucuuuccccuuucucucuuuccuagaguugggcugugggauguuugguuuccucauuuuugguuuauagaacugacaaauacuuuucuguccuucuucagaggaucucccacagcugggagauuuagccgugucugagguuggcugggauggccucagacucaacuggaccgcagcugacaaugccuaugagcacuuugucauucaggugcaggaggucaacaaaguggaggcagcccagaaccucacguugccuggcagccucagggcuguggacaucccgggccucgaggcugccacgccuuauagagucuccaucuauggggugauccggggcuauagaacaccaguacucucugcugaggccuccacagguacuuccucucccugucaaugcuuucuccccaagguucuuugcuuccuuuucaagagaucaugcgcggagucagcaucucgccauaacugaauccuuuucaugugccuuucaguggccggcugugcaugcucagagaccucccugugggcuaugacuuuguccucaugccuuugccauguggauggugaaugaugcagguguugcccuuucugaucuccagccccccagccuuucauacuuuaccuggcugauucuacaucuuuuuugaaugaugaauuuuuguuucaggaaucagccugaugguuuuaauucacuucuccagugcuuggagauaacuaaaagcuucccucccuauauaugaguucugguggaacacagauuauuuacuucugagagucuuuugcuaguuggaaauggugcuuuucuaucucuaaaucccucaaggauauggguagugugguucuugcauguaagaaauguuucuuuaaaaugcacccaguauaauaagagaacugaauuacccuccuccgggcaguucucucagauacugagucauuguuagaacaucaaauuagcaaauagcuagaccagaaggaaaaaaaaagaaauuacacaauuaugacuggagacuguaccaaagagaaagccauucauuagcacaaguacacacagcagcuuuuggaacaaggaauguccugggcuaugaaugucaaagaacugauacccuuuuugcucuuuuaaucaagaguuucucucuggaguguuggccuuuggauggcaaacucccagccccagacccaggagggugcauuauaguuuacucgucacucuaccccuguuacaagacuucaguguuucccgggggccugccaaagucagcagccuuccucugacacaguuuuccguugcucaucuuuauuaugugccuccauggguuugaagcucgguagagacuaucgcuucauuuugcauaugacugcuccccuuuuuaaauaauuauugcaacuaaacuuuaaugcauaccuguacaucccaguugaaucuagcaagagcauagcucugcauuuuaaccucagucauuucacuaauuuucacugagauaaagaaacauaaagcacaggcaaccacugccaggacggugacccugaaaugccuagaauuugcagccgaggcuacucugaaggcacccggaccuccuuuuucugagacccauaaaccaucccuucccagaaggcaaaguaaucacccaccacuucugaucuuuucugcagaucuuguggcuuggguguccucaguauuuuuauguguguguguuuuucuucuuaacaauagcaacauucuugccacugaugaauuggccuaugggcaggaaguuccauaaucccaucugaucuguaucucaacaaaucuauuagaaggaucucagagaccaggagccuucuuucuugcuaaagagacaguacuagcuuuucaaacccugcuccuaccugcccucugcauguuuuauucuuaugguuggggaaagcacuggcaggaccaucuucaagacaaaauguuauuucuucgcugaaagggauggccuaaacugccuugccuuggcuuagcccucuugguuggcaaugcaauacuagccuuuuuggcccacauagcagcaguuaagagaggacaagcuauuuuaacagaauaugagaauggcuggcugguccuucucuaaaguaugaaaaaaauaccaagaauuacacugagaaauugguaauuaccauuaagucacaaaaucagaagccucaaguuaccaccuugggaagguaauggcaucagaauuauuuagcccucauuugaauagaugggagcuccuucaaaguaaagaaugucuguggaaggcauccaaguaaucuugguuuccuuaaugcaauucaagagacuggaaguugccaggacucauaucuuuugaccaguggccagcaacccugagguagggcucccagaggcaagugugguuaagaugcaacaguuccugauaagaucauucagcacaucuucuuggccagggccugauuauauguggcaacugcauguagagaaaucuaauugccauaccuuccuuuuucuaauuucuuuuaacaaaacugcuuuuucucucccuuuggcacuaauugguaacauugcuuccuuccaucauagcccugaauuaucagaucucucuacccagcaaugguucuauuaacaaccucaaucuuaaaacacagccaaauaauuaacucaaauuuauuuuuuucuucuccccuaccccuuccuuuuacagccaaagaaccugaaauuggaaacuuaaauguuucugacauaacucccgagagcuucaaucucuccuggauggcuaccgaugggaucuucgagaccuuuaccauugaaauuauugauuccaauagguugcuggagacuguggaauauaauaucucuggugcugaacgaacugcccauaucucagggcuacccccuaguacugauuuuauugucuaccucucuggacuugcucccagcauccggaccaaaaccaucagugccacagccacgacagguacaugugcauucucccauuucuaacgcacucucuccacagucuucuuugcagggugaagccucuccuucuccucucccauugauguacaagccacagggcacuaacucuuccauggugcuaggcuggggugcuguuuaacauaacucuuuuccaacagcagcccaaauaaugcauugccauaaagacaugugccugauuuaucacugaccaggauguuuacagcauaaaauguaguucagucuaauuugccauauggaaucuagagaaaagaauucuaaccucucauaacuaaaaagcuauauaacuagaccuguucuugacuuugaaagaugucugccucagucaaagaggucuuguaaauuuuauuuuguauuaucuuagugucuuugucuuccuagucucuuggaccucgcaauacccaaauaucccagugauuuaauaaucauguugaugguguuggguauuuuuuuccaacugggaaaguaaagggaaacagcaaagauuacuuaucagaugagugcaggaggcagccaugccauucagaccaccccaguuccaacaccaccucuagaagaucagaacaugcugucuugcccucagaauagugaaugauaaauggcaaaaauaaaaguagaauaguuguguucaaacaagggacuuaguuuaaaaaacaaaagaauaaacugcucucacuuuaaauuuguggugucugugagaugugcacuaagucagaugcucuuugccaugcaguaaaagacaacccuaugugaauuuagaaaggggagccccccuuucuaaugcuacauucaaaguagcauucuuagcacaauuuagacagugccuucucuggagagguaaaugaagaaaucacaaacuagaaaaaaagaaacaauaucuacagaacaaacacaggagaaaugaagaaaucacaaacuagaaaaaaaaauauugucuacagaacaaacacaggauaauuuuuccuuauaguuuacaaaaaggggacucauggucugggaaauccaagaaaaggguugacaucguagcaucaaaauugccugucauuuaggucacccaugguugagagagggucuguccucauucuacaugaggcuacaaauugucgucagggugauccauggauaaggcagagagagccaacauuauccaguugcuaucucagccagguucaaguauaaaaaaacuuagaggagaaaauuaggcaaacauauauguuuguuucucauggcucaaaccgauuuucaacaagggacaaauuauuuuaccauuaacaaaggguaaagucuaaaacuuuauggauuuagucuuauguguuuugauuuugacucuacaaugguguuuuaaauugacacacuuucuuuuuucuuuuuuuucuugcuuuaguagccaaaccucuucuuagccaccucacugucucaaacaugaccuggggcaguguguccaucucgugggaagcucaggagucugccuuugauagcuuucuuauagaaguuaguaauuccgaucacccccaugagaccauggugcugucugugccuggggugucucgcagcucugucaucaccaaccucaaagcuucuucuaauuacacugcccaccuucaugggcugauuggcgggcagcgugcucagacccugaugguccaagcaaccacagguauuuccuauuauggcuucuucacucuucauugaauuuccucugaauagcuuuccaaaaaucacccgcuacccacuuuucacccuccuaguugcucccaauccuucucaaauuugauagagccauccaaaucaaagcuuuaaagcuuuaaaauaacucucaccccaaauuaaagaauuucagugucaaaccucuuuuuccuaaauauccauucacaucuggaguuguucuguuuguuuguauaaaguuaaccugacuugcuuugguugaauuucuaaaucaucuuuucaucugaucuugaauaaucuuuuucaaucccacccauuaucaucugccuguggucguucuaaucaaaguuugccuaugucauguucaaagagguaugugcaugccauuucuggugacuuggucagaaagaucuacacucuuuuucucucuagcaggauuuuaaaaaauaaaggugcccugagcaugcugagaauagacucugaaucacaacccaagaauugcaugagaggacccaguagucuuaucuuguucucgugauuuuugucugaagacuacucuuuuuugacauguacuuugucaagcacauuuugucacccacugauagcugucacaaagucucaggcucuucuuucaagccaucaucuuguccaaaucuuggugcauguggugaauauucagagcauuaaauuuugaaaauguuucuuuuuccuggaagcagcuagcauguccaugagucauuucagaagguuuaaaguggugggagaaaaaugccccucauuuugcauggaacauugaccauacccuaacuaccacuaucuuucucuguuuuuucuugcaucucauuucucagcuugguugcacccuuugagaggcagcuggagguaaagcugaccucaagaaccugagucuuauucugcauggugaaucuguuggcauugauagucugucugguagcaugagaagaaucccagcaugcauccuuaauuugggagauuguuucuacagcaaaauauagggaaauaacagaguuccacuuggaacauuuuaaucuuuugugugguugagggaauuugucaaagcuauagcugcaaaugauugcauuguuaccuucugaaacuaauugauaaggaggauaucccaugucaaugcuaauggcuauauucugcuucugaaccaaauccuuuuuguucuuagagauuuuaugacaucgaauuaugcuguauaauugugccauuaaaguuuauccaaaugagccccuucuuuccuccaaacuuuggagcugaagcaaaauaacucccaaguccuuggaagaaauauugugccucuucccaacccuaaauccugaucuuaauaucugaauccuccaguacuguugccucucucuaaaauacagucugggccgcacuuacuuuaaaauuaguuuuauuugauaaaugagcauuuaggaggccagccccauaaacaucuagccauauagaccccuuaacauuaaaugaguugcucucaaaacugaaugucuagacuuuaacagaaaagagauacuuaaccucagggaaaccaucuaucuguccaaauuauccaauaauugaguuuccuaagcagaaaauucaaugccuaacuucaaguuuuucuuucaccuuugcauucacugggaauuuugaauggaagccaucuucaccuuuacgguauuaaaugguaaaauauagauuuuccuacaaugcauauuaaguacuguaaaaauuucucuuguauggguauuagccuuuaauuugugcaaacaguagauacuaaaaaagaauacuaaaugaggaaacuccaaagaagcauuuucuaaaacauguucaauggaacaccagcuccuugagauguucaaaggauauuccucagauaggguauacauugaucaauaaguuuaugaaauuugggccaaacaaaauuaaacagguuuacugacagaaccagccugucagagccuuuaaaaugcaaacccaccuugugaaucucuaugguaagacauaauauucgguguuuaccaugcauacuuaaucauaaagcugucuuuucuuggaacaucuuacagggcuuguguccccaguacaaacuuuagaaaauguagccuuaauacccuucacguuacuccaaucuaccacucuaauggcuugucuacucuucuucauacaugacuagcaaauggugguguuuaugcuuuaaaagaacacagaucuaaaaaauaaaauaaaaauaaagaacacaaauauacaccugcagagaaagcaauauauuuucuaucaucauauucaaugcagguguagacacagccuaacauacugucucuucuguauguauuuggagauauugaugcuuucauguucuauggcuacauucuggaaaaauccacugcuuccucuaauaaugucucucucuuucucucugcccauauuccuucuuuagaaccaaagccacaguugggcacgcuaaucuuuagcaauauuacuccaaaaagcuucaacaugucauggaccacucaagcugggcuuuuugcaaagauuguuaucaaugugagugacgcucacucacugcaugagucccagcaauucacagucucaggagaugcaaagcaagcucacaucacaggcuugguggagaacacuggcuaugacgucaguguggcaggaaccaccuuggcuggggaucccaccagaccccucacugccuuugucauuacagguacucaaucagagguucucacuugucuaacacagagagaaaaggagauaagucaucuuaaaggaaaauucaacaaaaauacaaucuucacugcaaauguguacucucuuauuuuuaauugacaaauaguaauuguauauauuuauggagaauaguguguuguuuugauauacauauacauuguggauugauugaaucaaccuaauuaacauaucaaucaccucaccuuauuuauuuauuuauuuauuuauuuauuuauuuauugugcugugagaacauuuaaaaucuacucuuuuaggaauuuugaaguauucaauauguuauuauuaacuauggccagucaccaugcugugcaguagaucacuaaaacuuauuccuucugucuaacugaacuuuguacuccuugaccaacaucuccccuuucuucaucuccccaaccccagucaccgguaaccaccagucuucucugugcuucuauguguucagcuuucuuagauuacacaaaugagaucacgcaguauuugucuuucugugccucgauuauuucacucuguacaaugucuucuggguucauccguguuguugaaaaugacagaauuuuccucuuuuuuaaggcuauaaaguauuccauuauauauauauguguauauauauauauauguauauauacacacauauggaauguauauauuuauauauaaauaugaucuaucuauacaccacauuuucuuuauccauucauccauugacagacacagguuacaauacauuacucaugauagccaagauaauauauguaaacuucuaaguaaagagaaagcagauacuauuauaaaggagaggacuuucacagcugcucuuaggaaguggagagaacguucucaagaguuguauaaagcuuuuaggguuuuuugugcccaguuuuauuggcuguuuuaucccuaguuuagagauucugccuaaaaagugacuccuaaguuaguaaaggccuaagaucgaaauccuguucauaaaucaugcuagguaacgcaguucauauaugugacaaaaguauaaccaucuuuuucuuuaaaaaauaauuauucuuaaaacugacaacacagaugcagcuagaugcagcuaauuugaaauuccugucuccuuuuuuucuuuugauuaaaaaaaaaaugcauuuaccaguacugucagaaaaaaaaaaaaaagaaaaaaaagaaaaaagaaaaaucaccuagaaaagagacgcugaaccuucuccacuaauccuccuuaucccucaggauugccaucacugauugggguuggcuuuggguauggaaagaacguagaacuuggagucggaagaccugguuguauaucucagcuuaggcaccuagcagauguaugaccuaggauaagucauuaacuucucugguuuuuuuagaugugaucgggguuggaagauugaugaagguucaaccucagauggcagauaaauuucaaguuuaauuaagcccuacccauucacucaacuugacuucuugaacauuugccaauguucaauuuggcaaaugcugccaaaugguggcagcaaaaacuucaauggcaaaggcugcacauggugucaguuuacuaaauucuagcccaaaaagccucagaaaauauuuagaagucucuuccuuuucauuagugauaauuuucagaagacggacuuugccaucugauuuucacauuaaaccaggucucucccagggucuaaauugccaucacuaagacaugucaauuaguacaauuaaauauuuaauuauaggcagcaugguguccuggaagagugaggauuuugagaucaagcuuuugugguuucuaaaccucucccacagcuuuuuagcuacauaauuuuagcaaguucuuaacuuguuugaacccuaauuuccuuaugcauggagagaggauaccacaggcacuucugggagccuugucucauagauuaaauagaguuggugaaauuuaacugccuagcauccaguaggaauuuuauacaugcuagguucuuucugcugucucccaacauuauuaggaaaguggcuuucuuaaaaauaaccaauaaggcuagauagaacaauagaccuaugcaaucaugaacucccucucguuuuuaagagaacuuuggauguguuuuaauguaagauuaaaaaaugaguauuuuuuccuauccaguuaccuaaugugaauuaaaucauucagaugagucuucaaaugcagaacaugguaauuucuuaagggacugagacaaggaggaacgagaugagauucucacuccucaggaggggagaaauggccacagaucccaucaggccauugcuuguagcggcuugcaggaccucccacauaacagaagaaaaggaagcugagagacccagucuugggaauccuagauccaguuacagcauugucucagcuaauccaugaugugaaaagauugcguuuuaaaagaagcauauuaaaaaagaaaaaaacaaaacaggagggacucuuaaauaacaagcccuugauugccuaauuagccugaaugcccucacuuucauuggaauucacugcuuugaugguguggaggugcaaagaggccagcuaucaaagagagaugccacuuaucuaaacaaaauccaggaacagaauucgagacccuugucucucagaugaagauuguuugcccaguauaagagauuucauccucgcuuuugauagaauuaugauucuugggaaaucuuuacguggaaaaaacugccucagaauaaacaccaaguguuucaaaauaacuacaggaaguccaagccacagcaaaauuuaaaucucuauuuacaaaaugaagguauucauucccuuauucauucagucaccaaacacuucuuuuuaaaacauuuuucuuuaugucucauggauuagacccuaggcauuagugaauuaaugcaagagcauuuaucucuuuguaaguuuccauuuagcuguaauggaaaagaagugucuaaacuagaugcagcuaauuugaaauuccugucuccuuuuuuucuucugauuaaaaaaaaaaaugcauuuaccaguacugucagaaaaaaaaaaagaaaaaagaaaaaacaccuagaaaagagacgcugaaccuucuccacuaauccuccuuaucccucaggauugccaucacugauugggguuggcuuuggguauggaaagaacauagaacuuggagucggaagaccugauuguaucucagcuuaggcaccuagcagauguaugaccuaggauaagucauuaaccucucugguuuuuuuagaugugaucgggguuggaaggcagguagcaauaucuaccuuacuguaucauuuugaagacuaacuaggauaacaaugugaagccuugucaguuggcaaguaucaauggaaacuuagccaacauaagcucacuccuuuuggauaucccaaugugugaaaaggcccuuuagcaccugagaaaucagaaugccugggacauacauguuuggugaacgaaugaaggagagauggugacagaauuuacuaagacccagauguguucuuguuuucuaacuuuauccaggaaaauaaacagcaaaagauuuagcaaaucuuaucauuucuuaguggguuauaaccaugagcuauuaauuuugacacaaaaaaaacuuaccuccucccuuuauuucagcuugugaggauaucucacuaauugacuucauuaauuugauucaaacugugcacuagaagugggauagaaacacaugaaguauaccggaaagaaauuauacucgaaaaaaaaaaaaagagcugaaggcagugggaaguagacaacgggauccaaacucaacaaaaugcaaccuauuuguauaaagaacuacauggccuuuggagucaaaccugacuaaaaucuucgcucuaucucuucuuacaagcuuguaacuuuagcuaagucaaucaacuucuuugaaacucaguuugcucacgugugaaauuagaauaauaccuaccucaugggcuauuaagagaauugcacaagauaacacuaucuggcacccaauaaguucuuacugaauuuucauuuucuaagcauauaacacaaauugaaugauggacuuggguaucuauugguguucuuggaaacgugugcuauccugacagagucagugcugcuaaccugaguuauuuucacuccucccuucuuucagaggcccugccccuucuggaaaaccuaaccauuuccgacauuaaucccuacggguucacaguuuccuggauggcaucggagaaugccuuugacagcuuucuaguaacggugguggauucugggaagcugcuggacccccaggaauucacacuuucaggaacccagaggaagcuggagcuuagaggccucauaacuggcauuggcuaugagguuauggucucuggcuucacccaagggcaucaaaccaagcccuugagggcugagauuguuacagguauuucaaaucaagugagccauuuguuccucuuccugguccccuucuguguaaucugucuaccggaucgccaugacuuuaacaucuuuguucacauucccuacuuaauccauaaauguagucuacuguuucaccuucuccccacacucccucuugucauauguacuuaaugaacacuccccacucccaccccagaaaugagaaggucgaaauauuucugcuuuguauucaaaauccuuuagaccuugucuuguccauagcucuugugugcuuaccucauaucaucgucccuugugaucaaccuggcugguccccagcuacauuucagccuucucaaaagaaauauaccaaugaguauauuuccaaaacguauuuaaaacuuuugccaucucaaaaucucaaccaugaucuuaacaaacuuacccagugggcucgucauuggaaaaccaaaugugaacuuauuuuaucgguaaucacuaauaucagagagacucugcaacacggacuaaauccauaauuuucucaagacuaaugauuccuacagaaauuaacaacggaauagucaaacaucuguguuucccaaagucuuucuagagauuacuagcuccacagaauguucaaagguccuacucggugaggaaauuccacguucaaauaaguuuggaaagacugaguuaaacaaaguuaaagaggaucuuuaacugcacggcuuuucagaacacccuaacgugcaucaucuccaagaaguacuuauccaggcaguauuuuccaaacuuauuugacaaaggauacuuuuuaaggaagaggaucaaacaggaauaguucacugugagcacacuuugggaaacucagcucuaaaucuacauugacauugaguuuugucuaguuaaggcaaugcaagaugaaacccuggguccacaguauguagcacaaaagguuccaaccucaguucuaccaucugaacauuuaucuaauaguuaauaaaauaacaagaaagaaugcaaaaaaaaaaaaaaaaagucaaggguaggagccuucuuuagugaaacagcacuaagaacaaagcaaaaagaccauaacauuuuaaaagccauuuugggcaggcucaaggagaauguaaucagcaguaucaucaugagcagcucuacagaucauuaaugcugguuuauuugucuuuucaaaaagaaaagaaaaaggucuugcaggggaugggcacucagccacuggaagacagagagcaaauguaaacaauuuacuggcuuugaacuuauuuaauaauaugugggacgggccaaugcugaguccagauguggauuuacugaauugcuuuuagacaaaacucacauaugcaaacauaugcuugacuuguauugaaugugucuacuccaucuuuccccucuccugacucuacuggacuuguuaauguugaaugauuuuauuuuugguaucucaggacacuucuaucucugaaagccggggcaucacuacauauugauaccccuacuggagagaagauugcacggacugguaaaugauguugucuuuccuccuucucccaccauuuucucucccucuagaagccgaaccggaaguugacaaccuucugguuucagaugccaccccagacgguuuccgucuguccuggacagcugaugaaggggucuucgacaauuuuguucucaaaaucagagauaccaaaaagcagucugagccacuggaaauaacccuacuugcccccgaacguaccagggacauaacaggucucagagaggcuacugaauacgaaauugaacucuauggaauaagcaaaggaaggcgaucccagacagucagugcuauagcaacaacagguacuguaaauaaacaggagagaacagagaaaagucaugacucaggggucuucuucucacagggcugaguaaucacaggagcuuuggaugcaggcaggcuggcgcucugauccugacucuuucaauuacagacuguguuaccuuggacaauuuggcuaaguccuuaugcaaaaaaaguaugaugccauuuacuuaauaggguugugaggauuaaaugagauaauucauauaaagcccauagcggaaggccuggcagguagcaagggcccagcaaaugagagcuauucacguugccauuaaugcaucaucaucguuacaauuaucaucuuuuuuuuuuuacguuccaaagauucuuccuucuaucuauuaucucaucauaucucaucucaucauaucauaucucaucauuuuauccagagauacacuuccuuguucuuuggccaaauguucgagcuauaccaaguagggagauaauggagaagcagcacgucuaucuauacacauuaauauuuauaaaaugcuacaugugaauaaucaguacggugaucagcaaggauaaaggagagagcuggcaagauuaacaugcuacuguuuaugaagcucucuaacuuugauacucauaacaacucugaaaggcaccuagaguguccuuggaguuuaauuaccuuuuuccauaggagcuguuucaaggagaaaaaaaaaaaagaugguuaauaauaugacucuuaggcccagagugauggcucacaccuguaaucccagcauuucaggaggcugagacaggaggaucacuugaguccaggaguuugagaccagccuaggcaacauaguaagacccuaccugugcaaaaaaaaaaaaaaaaaaaaaucaaaaacuuagccagguguggugccucaugcccguaguaccagcuacucugcaggcugaggcaggaagaucucuugagcccaggagguuaaggcuguggugagcuguguucgugccacugcauucccaccuggacgacagagcaagacucugucucaaauaaugauaauaauaacaguaguaauaauaugacucuuuguaauaauaauaauacuaagaugaacaugacuuuuuaaagagaaaaggaaaaaccuccaacaagucaaguaaauuauuucaugaaacugagggagaugcagagacauagcauucgcuggagauggcugcuucaaagggaaccaggggacagaaccacaaaaucaccaggagagauaaaagggaccugagagaugauguagcucaaccucuucuguuugugcaugaagacucugaggaccagaauggugaaaugauuuuucuaugaucauagagcuagauuuggaguaaagcccaaugaccagcuuauucuaauacuauuuaaaaugagcagucuggaugagagaaaaccaaugcauauagcuacuugccaucucugacaggcauaggcaugacauuugccaaaaccucuccuuuuugucuaaagauagauauuuuauauuguuaaguuuucaggaccuaauaaguggcaagaaaucacccauguaaaaauaauaaucaguauuuguaggcuuggagaaaaugcuagaauccaggcagcaaccuaguaagagggaaaaacccuguuucuuauuaacagggacacccuauccugggaugcaggucucagucuccuccucccuguggcugcccauaaaacgacuccagaucagaggcagagccuugauuuugaucuugguuuauaaacaguguucuucgaaguuuacuucuucugaucauugauuuguuuugcugaucuuuuuuuucuagaagcccugcaguucuaaagcaaaaaagagaaugaauaaucaugaauugaauuuuuuuuaagaacaacaaaaaaaaaaggcaaggcagacccugcucuuuuggaaagcccucucuuugauuuucuucucuagagccuaguagcuuauagccaaagagaggugcccaugcgcgugcgugcuugugugugugugugugugugugugugugugugucuacaugccugugcuccaggaccaggagaagacaggaaagggggcucuugagcacagaagaugccuaauuucuaucuucaccucaucaaguuuauaaauuuccccuuuuguuuuuuuuuuuuaauccuuucuccucuccucucuuccucccucauaccauuguaaacucuucucuguaauguccuaucccucuuccuccugagaaggcccugcuguagcuccuccucucacucacaagguaccucuccauagcacaagcugccagcccugggugcccagggcaguagaaagggcagugggagacaguguugccuggugguuaagccaacaaccaugg

SEQ ID NO: 13994 - RNA, 13456 nt, Homo sapiens
gggugcucaacggcgcgugcgcagagggaggcaggcgggugggcugccggcgguggacucgucggagccgcgggcggucagguagggggcgggaaggaggguuggggacuggggaccgcggccggagucgugggccguggcucagcggccaggcgggggaacgugccggcgugcagcggccgcgcccgaauggcaggguguggggaccggaucuggggggggcaggacuaggguggggguggggcugcgaggggcaggcucgggagggauucguggggcugaggagauccgaggagaugcagcugggggaggggagcgaggggcucugaagagauuugcgguugcagcaucucgggagguaugagguaaugucggggcccugaggaggaacgggguguagcaugugggagaugggagggaaucagggcccuggagggaccugggugcagaauuucagaaauaugaaggaacuggggggccccgaugagauuugaggaaaucugggggcgcuaggcaucuggcaaggacagggucugagaugauaggagcaaggucuagggcgauccuaagugcuauugagaaaggguuuucggagugggcugagggugagauugaggggguggggugaguucuugagggacucuaucuuguuagcagaaagaagggagcuggcugaggugugaaggcagcacaugacauucagugcauaagaggaaggagcaggguaugagggcagcacagugcccgauggaaugcaggagaugggggcucagauugagggagagcagaaaucuggggugaggaauuggggcguugaacugaggugcggggcugaguguggcagagauuuggaaauagggauuaaacgaucugaguccgagggauuuggggcauaugagugaggaauugacgaggguugcaauauacagccccaaagauuggaauuuggaauuguaagaggguuggggacaggguuuggagaggauugaaucgugggguggagauguccuaacugggcuauaaaaucaaaggacccugaguagauuuguggauuggugucuugggcugcuaaagagauuuuccuuaaaucgcugcaugggagacagagggaguucaggggacccaaggaccuaaaaguaauguaugaaacuggaugaguauaugaagaugagcagaguucaggugcugaggaacaaagugauaaaucuucaguucagauaauccugaaggagugugguaaucccugugaagggcagaaucuucuucauuuauuaaacaaagauccguuaucaugaggcagguaugguauugccacuaacuccauucugaccaccggucccccggcccacugaaagugguaggcuuuggggaagaagaaguggaacuauucaaggucaucugccuaagcccuuuuucccuguacccccaagcuacgauagcagauagaaagugagaccuccaggggaaugaguggaauaauuuauccuauauaagauccauuacagcuugaaggggcaguggcucugugagugagguguuugggcucggagacagacaaaacaacaacaacaaccaccagaaaaaaaaaagggaacccuuagguauugagcauuuaguccugugcuagacuguaaagcagugguucuuaaccaagucuggcuuugucuccuaggagacauuaggcaaugucuggagauguuuuuugguugucacagggugggggauacuacuggccucaaguggguagauuaaacauuaaacauaauguuuuauguuaaacauuugacaaugugugggauacgcccuucccccccgcaguaaggaauuauccugccuaaaaugucaguaaugccaaaguugaggcacucugaccuagagucagauacccuggguucaaguccuagcucuaucucuuccugacuuuaaguccuagcucuaucucuuccugacuuuguggccuugaaugaguuacuuaaccacccagugccuuggcucuucaucuguaaaaugggguuaugauaacaagaccaaugucacagaauuguugugaggauuuagugaaguaaacuagcaugccuaggaucuggcacauaguaaguucucaaaaucuaguaauuuuuagucuuguaucuacuucuuuacucaguuuucaugacaguccuucuaaguaggcucuacuguauucaguuuuacacaugaggaaacuaaggcuuaggaagugacuugccuaaguuuccauagcuaggaaugacacaguuaagcucauacccagaucucuguaacuccguauauucccgcuuuccuugcuucuuccuugcuagggccugcuuagucuuauuuucucagcccauuccccucuaaugaaaaagaggauugccagugaguaucacugacuaucagauugaacucuaaaguugggggguaaaucucucugauuagguagggaggagcccuggacuuuguucuugguuugcccuuagaccaagaccuggggcuagauaaggagaggagccugagguuaucaggcaggaugaggugcaacggacuauagggugagguauggaggccauuggcuugaaaaaacaccucauagcagggacugaggcugaaggcagucauacucugaaggagaguaacuacuguucuguauggucucuuuuggucugcuuuucccuggaacagaauuuggcucuaucauuuccaggacuagcuacaggguugcugaagccaguucagaaacaaagcuagacugugucugacagcaagacuuagcuggaauaucugugcacaucccuaaaagaaaauaugucaugggaauuaaaucagcccugucuaaacuccuuacucuaauuuccuauguuaccuugucaguagcuacggcacuuguccugucagccucaaucuauuaaaaaugcaaaugauuauaauuuguugagugcuuauuaugugcauuaucuuagugaauucaauccugcuaacagucuagguuuuauuccuuguuuacagauaagaaaaauaacagguuaaaugacuuacccagggcuacagagcaaguagcuagguugggauacaaacccaguucugucuuacaccuauguuacauuauaguaguuuuauuagaagccuuuuccaacccuucagagccccuauguuuaugucuggagaauaguuggaagccagaaguuuauaaggcccuuaaaguagaucauugucuaugcacacugauguguaaccuuugugacauucccuccaucuugucuuucugguaaaacaaucaaauuuaaaaaucauuucuaggugcccuuaccaaccucucagccagacuuugucuaaagcuagggaacuaugaaacauccuuuaaguuaguaauuuuauggcugggaguugauacugggauuugaauccuugcucuauuacuuauugguuuugagaccuuggacaggcuacuuucucugagcauugguuuccuuauuuuugaagaggaaucacacuuacuuuacaugguuauuaugagacuaugagaacauauaaaaaaaugccugacaauaaauaguaguugcuuuaagaguguuagcaauuaugagaggaaggcagugcuggaagagaacuaaguguugcuuugucauauuuauuuauuuauacagggucuugcugugucacccaggcuggagugcaguggugcaaucacaguucacugcagccucaaccuccuaggcucaagugauccucccaucucagccucccaaguagcugggaccacaagugcaugccaccacaccugauuaucuuuuaaauuuauuguagagaugguguuucacucuguugcucaggcucuuugccagauuuugauaacccuaaguagucucugcuagucuccccaaaauucucaucccauuuuguauauuuccuaggaucuccuugauccuuuaaucauaaucucaugauuaaaugaacagauguuauaugcagagaaaggaauugaaagagagagaggguugagguuaguuggaggucccugagaaggggcuauugauuuuuccuuugucuuauauuccuugagucauacuggcagcguagguacuacucaaauguuugugaaagaugcaagggagucuuucuagguccugcaguuuuagaggaagacagagacaacaggcaagcauguuuuccaggaaacccuauuauucauuuagccugcccuugacauaguuuagcuauguuuaacuuaguaauuuagcuaaaguuuucuuucucuacaaacauacuuccuucuggaucguuuuguuugccccagacugguacaacuucaggagcaugccuguguuucccuauaagccccuacuuguugaguuuaucuuaguugucugcaggugccuuaaaugcccugaguaaucuaaacuucaucagaauccucucccacacacaggaguggaugucaggugaugaccucacugaauucguuaaagucaguccugcuaacgaguggccuuugguggcacagugauaguuuugcacuugauuagcauucuguuagaaugcaugaggaauaaaguuuagaaagcugacauaaaaggaaaugagauaaaccuugcaaaaaacccagucaaaccaggggagcgugucaauaguaggauggaccuuuaugucuugugaaaggaaaugcaauauuuuacauguugucuaguuuuuaggggaaagcacuguuuaugucugguuuuugcucaaaauuguaucaccaguaccguucacagggccagacacauaguaggugcuuaguaaagauuuguuuuguuaauugcuuaaaguucuccaguuuugcucauggccuaagccaccaaaggcugauauagguaaaggaaauggagauaucuagagaaccaccccaugguggcaauucaagcauuaggugaagauuugaaaccuuagaucaucucuaaucuuuagauucugggaucagguaaaacaauuucuaggagggcuuagaauuuuuauuauuuagguuuauguaucuggggccuuggguacagucugcugaaaagugccuauucauuucuucuaauagguugggugguggcagcagcaguugcugcuacugcuaauaauaauaaaaacuauuauuuauguauaguuaauugcaugccuggcuugguacuguacuuagugcuuuacacacauaaucucauuuaaucuuugcaauaacuuugugaggaagauacuauuuuaaagucccuuuccauagauaaacugagaacuacagaaguauuaauaacuugcucacgucuccacaauaaguaguagagcuugaauucaaauccaggaaagccugaucccucaggccugcuuccuuaaucuauauaauacuguccacuccuaguucgugucuuuuaguccuaguucuguugugugauuuguggucuuaauuucccucuccuggucuuaguuuucucaucuauuuuacaacuugagauuacuaccuuuucuuccccuuuugcccaggcugaaguacaguagcaucaucacagcucacugcaaccuccacuuccuggucucaaguaaggagauugcuacgaauucuagcauuucauacuuagucucugcuugaaggagcuacagcagcucauuuucugggcaagacaaguuguaaauucauuuacccaucaguuuuuagccuguaugucuggcauucucaaucaaaacucuucaaaacugaccagcccuuuuauuaaucuuuauaugccuuuauaugccaugaaaggaaagguuguucaugcuuucaaaauguaguuuguaaacugaaugcguuauuaauacuaguacuaguuauuguuaaugcuguuucugguuauuauuuauuuagcauccuuuuauuguacaccuaaggguaucaggcuaaguacuuuauaugcauuuuccauagucauuacaguacucuuuuuauaaacuaagaaaacagguuuagacagguuaaauaaauugccugcuuccccacaacuugugacagugcuaagauaugaucucaguccuauauaacuuuaagguucauucuuuuguuuuguuugcuuuuucuacuaccuugguuacucauuucauggaauggggaaaacccaguggugcuagaagaggcgagauuaauauggaauauaauuauguaauuuuucugagucuuagggcagccagaguagacacagcuuaagggacagauucucaucgggagcugaagagaugugcuaguacaguaugguaugggauguacaguauuaaucauuaggucaagggaugugggaagaugguaggcugauguuagaugaggugggaggucaagaauuaauggcacaaagugcacaacaggaaacagacauucaagggaucaugaagggagccaagaugauacauagcauguuggauacucauucugauugguuguacaguugauagcuggcagaaaaugggcagcuuacuuaaagauuuggaaugauaagacaauuccuuuuauuuguguagucuuuuggggaaacugaagucaaauugaccuucuaucugagucauucucaguauuacaguaaugaccagaugugcccuucuggaggagacgggcucuaucugccugucucuuagcuccauuucaggcuaagauccuucacaaagcaguguuuucaagucauggaagugggaaaagugguucuggcuuuuuccagguuugagacuauuuccgugccucaugcuuuagugaggggaacacagguuuuccuggcaaagcauggcagcuuuggggcaggaauucuugacauccucagagagcuuggugaagcuguagucagcugagauaauuuggggaugugggcauaguaaauucauuuuuuuaaaccugaugucuuagacagagagguaggaagcuuuucaauugaaggagggauaugauauuccagaaagcuugggaaauaauuugcugcuauuuuuacaaguuggcagccuuguuuaauaaacugaucugcacugccagcucugggaagaacacagaugucccugugcauuguaagguaacguucuagauucaaacuccaaauguccucagucuguugucccagaugauagaagagagaacuguagcuauugauuuagaauugagaaggguugcauggauccugaguuguaauuucucuuuuuuuuuuuuuuuuuuuugagauggagucucgcucugucacccagucuggagugcaguggcgcgucucggcucacugcaagcuccgccucccagguucaugccauuguccugccucagccucccgaguagcugggacuacaggcgccugccaccacgcccagcuaauuuuuuuuuuuuuuuuuguauuuuuaguagagacggaguuucaccgucuuagccaggauggucucgaucuccugaccucaugauucgcccaccucagccucccaaagugcugggauuacaggcaugagccaccacgccuggcccugaguuguaauuucuaucaguaugucuaugcuauugccccuagacacuuggcauuuaagaauuuaccauucauaguuucagauauccacaucagaccucauacgcucaugauauaugguaaauauuauuuugcugagguauggauuugagucauaauggguugcaagcuugcugugugagaguaggucacucagcuaauaaaucaaucuaucccacucuauagcagcagaaucucauaacuauauuaguguuccuucuguguuauggagaaaaugcguaugcuauaaggcagcauuccccagagcguggucaagggaacauuaguuaaucauuguuaugugacaguaaaaaauagcuugaaauaauguuggguuaaauaaaguaaaaauaucuguacuucaagguuccacuauguuugagcugugugaccuugagcaaguuuuucugagcauucguuuccucaucuguaaaauaggauaauaaaaauauuaccacuucauagugucaucaugaagauuaaaagagauuaagcauauaaaguaucugucauaguaacuagcauauaauaggcacuagaugcauaguuucccuugcaguacaaaggaagugggauaucagggaggaaggauuaacuuuagauaauugugcaugucugcugcuauauauuugucagauugcauuccaaagcuaauaugguagaaauuuguuguaauguauaucucuacauuaacuccccuucuucucuaugccuggagaaagaguugaugucaugugcaaaguguucuugagcuaaaugcauuguccuuaaaaucaaacgaacuugcccuccacuuccuccuucuccugggugguugaccaucugcagaucacaagacugcacagauacagcuguaggauuugcguuuaugaaaugcugacuuuaucauaugccucaacuugcuagaccuauucauucugauuugggguauacguugacagugaccuaaggcuacagagcacugagaucucucugggucaacuucauaaguauauguauaucaagaggguuggaguguucaugguuuguauugggugacgcagaggguacucuaagccagaaauaaacugucuugauaaggcacugcuauuuuuuaaaucaucuaggcuugagucuuuggcuaucucugcucuucaccacucccccaccauaauccacucaccuuucaaaucuuacugacuauacuucuggauauugcucaaaugaaucuuuccauuuccaccaccugcucccuaguucagacuccccauuauccccgucuucucugauguuuccccacuccauuccugcuuugaucauaucaucuuccugcuucaaaacauucaucaccucaccaugcccuugaaaaugacgcucaaaaaucucauuuuggcucugaagaccuuuuauaauuauucccccaauuuaccuuuccaagucuguuacucuauuccccauauauacucccacaguuuuaaucuaaggauaauaaaaaagagaacuaaaauucauuaaaggcuuuuuuggugcagagccaaaucuuagcauucuauacacucuauauauuauuucauucuuacauuaacucuguaaagacaguauuuuuccauuuuaaagguggagaaaauaaaaugcauagaguuuaaguauucucuguuuucuuucuaauacaugaaacuucuuguccuuuccuuugccuuuuauacuuuguuaagguugugccuuuugcccacuucuuucuucccucuccauguauuuaugcaucuuuccaggccaauauaaaaugucaucuucccuuugaaaauucuguaucccuucagauuggaaugacuccucaacccccaucaaacuuaguuuuuauuucguuuauaguaccacuuucugccuucauuauuauuuaccuacaugucuugucuuuuauaaaguuugaauaucugaagagcaggaucuguauccuaaagaccucuuguaucuaguacagaacaagauaccuaaacuuagauggguggauaggugaguaaguaggaggauagaugcguggaaaauguguauuuucugaucugauguuuugcagaucaccuaaaacuaaucaucacaauuuucugcuucuguggaugauuccuaggcccccaaacaugacacaauaaacucugugacaugauuaaaaaaaaaaaaaaaagccuccacacuuuugcuuacaugguuuucuuugcuuaaaguaccuuuauccucauuccuucauuucuuucaagacauaucuuaggagugaaacugcuuuugggaagccuuccccaagucuguuagguagaauccaucauuccauccacuguacuccagcagaacauuauguggacuugcauguuauacuuauuccuuuuacugugcauaauucuccugugcuuuucucuuaguguaaaucagaaguuguaaaauucaccaaauaugaaaauaaucauuagcucauuagcauuuauuacaaguauacuacuucccuggugcuauacuaagcacaucauauuuaucuuguuacuuagcccuuauaauaaccauauaaggcagacaccauuauuacuucuauuuuacagaugagugauggggaaagagcuuuuggaaguuugaguuaauuccuuauggucaugcagcuaaguaagugucugagacuacagaaucugaauuauuucccacuaugcaguguuuugucugguuuguuucccuaucugucacccucacgugacauauaauagaccucaauaaaauaguuguuaaguaagggaaugacugaaugacuggucauagcuauucucuaaauguuucuugagugaauuuauuuauauagucagaggaaaaugaauaaugguuucuuuuucucuuuagcaggaauuugacccucuagggcaugaauacugugcuguucaguucugagcugugcuagcaauacccuucaaaggaagagcaauggcugcagcagcagcuucucaccugaaccuggaugcccuccgggaagugcuagaaugccccaucugcauggaguccuucacagaagagcagcugcgucccaagcuucugcacuguggccauaccaucugccgccagugccuggagaagcuauuggccaguagcaucaaugguguccgcugucccuuuugcagcaagauuacccgcauaaccagcuugacccagcugacagacaaucugacagugcuaaagaucauugauacagcugggcucagcgaggcuguggggcugcucaugugucgguccugugggcggcgucugccccggcaauucugccggagcugugguuugguguuaugugagcccugccgggaggcagaccaucagccuccuggccacuguacacucccugucaaagaagcagcugaggagcggcgucgggacuuuggagagaaguuaacucgucugcgggaacuuaugggggagcugcagcggcggaaggcagccuuggaaggugucuccaaggaccuucaggcaagguauaaagcaguucuccaggaguaugggcaugaggagcgcaggguccaggaugagcuggcucgcucucggaaguucuucacaggcucuuuggcugaaguugagaaguccaauagucaagugguagaggagcagaguuaccugcuuaacauugcagaggugcaggcugugucucgcugugacuacuuccuggccaagaucaagcaggcagauguagcacuacuggaggagacagcugaugaggaggagccagagcucacugccagcuugccucgggagcucacccugcaagauguggagcuccuuaagguaggucauguuggcccccuccaaauuggacaagcuguuaagaagccccggacaguuaacguggaagauuccugggccauggaggccacagcgucugcugccucuaccucuguuacuuuuagagagauggacaugagcccggaggaagugguugccagcccuagggccucaccugcuaaacagcgggguccugaggcagccuccaauauccagcagugccucuuucucaagaagaugggggccaaaggcagcacuccaggaauguucaaucuuccagucagucucuacgugaccagucaaggugaaguacuagucgcugaccgugguaacuaucguauacaagucuuuacccgcaaaggcuuuuugaaggaaauccgccgcagccccaguggcauugauagcuuugugcuaagcuuccuuggggcagaucuacccaaccucacuccucucucaguggcaaugaacugccaggggcugauuggugugacugacagcuaugauaacucccucaagguauauaccuuggauggccacugcguggccugucacaggagccagcugagcaaaccaugggguaucacagccuugccaucuggccaguuuguaguaaccgauguggaagguggaaagcuuugguguuucacaguugaucgaggaucagggguggucaaauacagcugccuauguagugcugugcggcccaaauuugucaccugugaugcugagggcaccgucuacuucacccagggcuuaggccucaaucuggagaaucggcagaaugagcaccaccuggaggguggcuuuuccauuggcucuguaggcccugaugggcagcugggucgccagauuagccacuucuucucggagaaugaggauuuccgcugcauugcuggcauguguguggaugcucguggugaucucaucguggcugacaguagucgcaaggaaauucuccauuuuccuaagggugggggcuauaguguccuuauucgagagggacuuaccuguccggugggcauagcccuaacuccuaaggggcagcugcuggucuuggacuguugggaucauugcaucaagaucuacagcuaccaucugagaagauauuccaccccauaggggaugagaaauuaucaguuucuucugcucccaagccaacuucccuucccuuaguucuugguuguuaguggcacaugcagaauagacucagccuauguccugauuccagcuggguaguucuagaacuucagaagcuccaucuuuuaauguuuuuauuuguuaugucccccuccccgcuucccaccuaaauuuagagcuuuaaaagaugcacugcccaaauaggacacacgaugguguuagcugaaguuugauuagcaauuaggcacuuccaaggcuuuaguagagagagccacuuuagcccuuugugccauguuugaaauuugcccuuguauuaaauccuugauuuuuucccauuuggcuuugaugcccuugauccauuguuuccuuccuacuauaaugugcuucaucugugacacuuucucuugaacucugauuggauucacugugcaugcuucagugggaucugcuccaccuuucagugacauuuaagacaucauauucccguaacauuaugucucagucugaucgucuuuaccaguaugaaagucauucauuuagugcuaccaaaggggauacacaagcccuuuaggaagcaguaccucucgccuggaggaucugugccaucuuggauugagaauugcagaugugacagaauggauugacccuaguugguugguauugaugacuucagccuggaaauugcuugccuuuuaaagaagcauauauggguuggaauuaugccaaagcauaggaagcugggaauaagcaaacaaaugcugauauagucagcaaauuuggauagucucuagggcucaucauuuuucauacuaccucucucuucuggccugugucuaaggaauuguacaacauaggccagggccaacaaaguggagagguggacacauuuucauguucauuacuaaaacaaacagcaaaacuauugguuuguuauucuguguuuuccucaagucaguacauacuauuugguuucaggauuucuuuccauuucucuaucaagcauuaaauaauugagaacuguuucuucaucucug

SEQ ID NO: 13995 - RNA, 688 nt, Homo sapiens
uguguaaugaacuggcagcaagagaaagcugguugaagaaaggcagaggaacugugucuuaugagaauuagaaucaaggggcuccauaaucaucuggcauucauucaauguuguaucuaugguuagaaauguacaugacaggaacuccaggaaucuuagggauucuucuuuuaagguccuggucaacuguggccacaauauaaaacuuaugcugaauuacucucuguacuaagagucaucugcuuagguuccuuuguguguacaugguaauccuucaaaucuuggauccuuggugauccuuagagccacuccauacuucugcuccaauuucucaauuucaggcauuacacaaucaguuauacaaggaauacacuugguauacagacaguccaucauugacugcacuaagucugguuuggcuuuuauggaaaaguugauaaagguugguaucaaugaggaugugguaaggugggcccagcuguguauuauauuggaaaaauaagcagguaggguguuggggaauuucucuuuccuuuaacacgcugggauccuucuuuucuuucuuuuuagguuuuaauuuauccuuuucuguaagccucugaucccugagacuaagcauucacuucauggucgcauacuuccuuguuuucuuuugcuuccccauggucacaccacacuccugugcuug

SEQ ID NO: 13996 - RNA, 1387 nt, Homo sapiens
cacuagaaagauggcggaggaagagcaaagaaaaaucccuuugguuccagaaaaucuccugaaaaagaggaaggcuuaucaggcacucaaagccacccaggcaaagcaggaacuuuuggcaaagaaggagcagaagaaaggaaaagggcucagguuuaagcuacuggaaucauuccuacaugauuacuggcagcagaaaccugacaaggugcaucucagacgacuagaagugaaaccucaugccguggaauugccagauaaacauuccuuggccuuuguuguacgcaucgaaaggauugauggcgugaguuuacuggugcagagaaccauugcaagacuuugccuaaagaaaauuuuuaguggugucuuuguaaaagucaccccccagaaucuacaaaugcugcguauaguggaaacuuaugugaccuggggauuuccaaaucugaagucuguccgagaacucauuuugaaacguggacaagccaaggucaagaguaagaccaucccucugacagacaacacagugauugaggagcaccuggggaaguuuggcaucauuugcuuggaagaccucauucaugaaauugcauucccagggaagcauuuccaggagaucucaugguucuugcgcccuuuccaccucucaguggcccaucaugcuaccaaaaauagagugggcuuccucaaggagaugggcacacuuggcuaucggggugaacgcaucaaucagcucauccgccagcugaacuagacccaggugccaaacugcaguauauuuuugaucaaugaaguggaagcauguguuuuguuguuuugggaauuuuuaucaagugucuucagagaagauuauuuccugcucugucuucaaaaacuggaaaggaagggucaaagaaaagacaguagcuggcugggcguuguggcucacgcccguaaucccaacacuuugggaggcugaggugggcagaucacuugagguugggaguucgagaccagccugaccaacauggagaaaugccaucucuacuaaaaauaaaaaauuagccgggcaugguggcgcaugccuguaaucccagcuacucaggaggcugaggcaggagaaucgcucaaacgugggaggcggaaguugcagugagcugagaucacgccauugcacuccagccugggcaacgagcgaaacucugucucaacaaaaagaaaagacaguagcuuauguucaugucaagcaccucucaucagagucuaguuccaaggaaaaauuccaguguuuucuacauugggugcugcgucgucugaaaucggcacauuccauggaggaaggaguccugcuuuguugcaucuauccuaggguuuaauguugguaaaugagucacucuagcauuuguacaag

SEQ ID NO: 13997 - RNA, 5852 nt, Homo sapiens
aacagcacugugcaguuuuauuaaccauucaaguccaguagcaucugguaagauugggacagaauugggauugaaaagugaacagauauucagcaucuaacaguucaaaagaagccacuacauacucuuuucacaaauauguuuucacagagccaauacaguacuagccauuaacccaguacaccaaguguacugaaguagaaaagaugcaacaagaaaaauagcuacauuagaaagaccaacacuuuagaaaaagaguaaaacacuuucaguuucuccccuuuagccccuaaaacaacaucuuacagucuggaucuggaucuaccuauacaguccuacauuagcuucuaaaauauuugucaggagggaaaaaauaaaaugacacuggccaguacagucuuuggauauuuaggaaggggauggggagaaagucaguucucagaacaaauuagucagcuucagucucgucagcagggucuuuggauucuuuguucuuccgcacuucuucaaugugcuuauccuguaaaggaaggguaaggugucaucagucaaaaaaaaaaaaaaaaaaaaaagccugucaagucacgacccccagcccccaccucaaagaggcccaacacaaccucagugcauauauuacagccugugggaaccacacaauuuaaguucugagacaucaucaucaaaucuccugggucccuuguagaaccuaacaagcugccuacuggacuuccaaggacugugcaauuaugcugggaauuacugaauauuccaucuuaaaauauaccuuucauuuaauauguuaagccccaaaauggaugacaaaaagacaccaaacaccuuuuaucaaagcacuuaguucaagccaacucauuggugcaucaaacuccaagcucaacccuuuuacaaaguaagaaaccaaccuucucucgcaaacguuccaguuuggcagccauuugugccucucgguucucuuuauuagcuuccauuuugugggucaguuucucuucugccauuuuacugaaguuguuguucucuucuauugccuucugaagcacuucuuucucgugcucucguuucucagccagcugcuucaagaccucagcuucaugggacuggaaaaaaaaguuuaauaggcuaggcacucuaaaauguauucaggcugggugugguggcucacgccuguaaucccagcacuuugggaggccaagguggguggaucauuugaggucaggaguucaagaccagccuggccaacauggugaaauccuaccuauacuaaaaauacaaaaauuagccgggcgugguggcgggugccuguagucuaaguuacuugggaggcugaggcagaagaauugcuugaacccgggagguggagguugcagugaacugagaucgugccacugcacuccacccugggugacagagacucugccucaaaaaauaaaauguauucagcauaaguuaaaauuacaauaaaaauaauuuacuaaggggauugaaaaggggcagaaaauaaggucccuuuaaauaacaccaaaauuaggaccugaauuaucccuaucauaaaauacugugaaaaugauauucuuuuucuaguauuuguauuuaacuuuggaaaagugcuuaucuguucagaaaucuuacccaauuaguccuuaaggaaauccuuguaagauuuacugcuuaaugguaucuggaugacuugaggaauauguacuugcgaguggcacuuuuauuguaaagaauuucacuauuuaacuucaaaagcuacccaaagaaaacuagcucauuguaaaaauuuuaaccauaacugauaaaacaaugauaggaaauucaagacuaagucuguagauuacuauuuaagacagaaaaauuuguuucaaggaaaaggcuuauuagcuuuugucucaggaaacugcauuaauuaccagaccauaccuugguaugaccccuucaacagaacagcuuguucucaaaacacauuggaaccacugacuugcaggauaaccacagagcaucugacacugguucuauugauucucuucugccaaauccuagucaugaugggaguuucauuauauuuagccaguuacuauguaaagcacaggcuaaugacuacagggccaggguugaugucuaaaaagcuuuccacuguccaaccuuugguuguauugcuuccuccuacuccaugaacucacacuauugcauagaagacgacuccuuaguguaagcacugaggcucuucgggcggguguguguguauacuacaaaucacuaugcuggucuggggaagguuauuaccuuaccuuuugugccucacuugccccagcuuuaaaaucaauccuaucaggguuguugagaaagggaguuaaaugaaaaguuauguacaguuguuaaugaguaacauugaauggaaagaaacacaccaaaauguuaacacugguugcuucucggaagcgggauaaugaauacuuuuaauuuccauuuauaaauuucuguauuucccaaauuuucuacaacuagcauauuaauauuuauugauucuucugauuagcuuuuaaagauaguuacuuuauaauagaauuguuuagauaagagaaaagcuaccaugauaccagcugagcaacacaaucacacuagcaauuuaaaauguuauuguacagcucucaaaaaacaaaaccaaagugccaaagaaucaucuggcaacaaaucuuuucaaagaggaagcaugagagaagcaugagcuuugguuuaagauagaccagggcuugaauucugaccccaacacuuacuaguuguaugacugcagaaaaacgacuuaacauuccugaaacuguuucuaauuuccauuauuugaggcaacaccauguauuaaaggagaaaaauauaaacaaaggagcgggcauguaacaggaguucaauaaaugaggacugguauuuccuuccagucacuggcauauguaauaaucacaguguagcuacaauucuguuuucuuccuguuauagaaauaaaauugaucugcccauuacauaaauuaauauccugcuuucugugaauugcuucguuuaccuugcgucuuucuucugcagcuucuaauuucuucugaauuuccuccagggaaagauccuucuucuuuggaggggaaagggggaauucuggaacagauucuuuugaccgagggcugagaaucagcucaaaagccuggccugaggcacgcuucuccaguucuuucaccuggauaucuagaauugauuauauuuauaauucagaaaaccaggauucuccuguucuaauaaacuguacuauaauuuucuaaaacccaaaucaauuuaauguauuaaacuagggcugaugaggaaaguuguguuuuuuuuccccuuuuuauuccuaucagucuacugacacuaggggaagauguauuugcaggcaagauauuauuaucuaaauaccauuucccaaggccagguaccauggcucaugccuauaaucccagcaccgugggaggccaacaugggaagaucccuugagcccugaaguuugagaccagccugggcaacaaagggaaagcccaucucuacaaaaaaaauuuuuuuugauuaggugggugugguggcccaugucgauagucccagaugcuauggaggcugaggugggagaaucgcuugagcccacuugagcuccagaagucaaggcugcaaugagcuauaauuaagccacugcacuccagccugggcaacaaggugagacccugucucaaaaaaaauaaaaaccaucucccagaaaaacaaagcucaacauuuuuggauuaauaaauacuguuuugagacaucaguaucugacaaucgcuuucauaaacaaaagacuugugcaaacuccacaauuuugcuucagacuaagccaaacuguccaauaaacaauuacgagcucucggcacauucaagugauaaucauuuuuaaauucuucuccuauucauaaaauagguuuugguaagaccaaaacauaagugccaaaucaaaggcgaagaccugagccaucucaaucuaaaaucauaagcccauuacaauuucagauuuuccaaauagauuaccuaccagaagaagccauggugaauagaagacaagcgacaggcaguguauucugcacaaucaacugggauaaggaaaguccugaaaaugauuuucaaaaacaugcaaucacuuucuuugccuuucuauaugucaucaacccaaaaaaaucucacaucacaucuacauacaucgucagaaaaauacguggaauaaagacgucuaaauuaaccacgaaaaaaauuaucaaaaucuacuaaauaaacauugggaaauaugaccugaauaugauauugguuccagaaaaucaaguuaacugagcuuucucggucauaaaacucuuggauuuuuaaaaucagacaaagucacaagggugaagaauuuuucccccauaaacucuuuaacauuucaccgaaacuguaagaagauauuccagauucaacucaacagugcccccggagccaucuuaauacugccuacaacucauugugcaaaugaaauacccaccccugcuuugucugugucugacgugguggauaagaaaacgcccaagcuaauaguaaccaauaauguugaacuccuauugucccucagguuuaagcuuccuugcccaacagcaagcaaaauguuuaugaaccucuagauuuugacuuauauuugcugccguuaugucaugaaaaaugcuguaucucuuguugaucuuuuuaacauuaugacuuuuguagacgccagcuaguaccaaaaacguaggaugacagguucccaaaagcuaggaauuaaaaucagaggcagcgacaagauuuaagaaaagcagagaauuagacgcagcaccggacccaggaugggcguggcccugguccgggcgaggaaaagaggaccggucgcccccggccaaucagagcacgccuugcgcuccggccccuggccccgcccccuuccuccccgcgccuuuucgaaucuccccgaacucaacaccccggagcccgcgcgcgugggaaggggaggggugggcggggcuaacgguccaauccggguaacuccgccccugccugacucccccugcgcggacgccccccccaacucccgccaaaaacaccuccaggccgccgccaccacccccuucacaguucagcggguggggcaggccccgggaacaggcccccggguggucccgcggugagcucgccaccgccucccgccguccccaugcccaaccugccgccacccacgcuguccgcgcguccggccgcgaagacagaagaacccucguggggcccgggagcgccgccccucaaucaccagcugcggucgccaggggacggucgcagggagggucgcggcccuggcugcccgcaguuugguccuaaagccgcuggucccuggggcaccgccccgucccuucagacaauggggaacccggcggggcccgcagggaagggagggagggagggagguaaacgagggcccacgcccccuauugucuccucgacggcaccccggagcggacgcccggugaucgcccagcccccugcccacgaacagccgcgcccccggagagcggggacaaaggcgaggcuccgcccgagccacacacaaagcggagcgacccccgcccaccaaccccuccgaggcccgcagccccgcccgccgcccugcagcagggggucgcugccacggcccagccccucccgccgaccgcgucccucuugcuggccucagccagccgccgccuccuccgagccccgcacccaccugcucaguccgagccgccugaccacacucu

SEQ ID NO: 13998 - RNA, 552 nt, Homo sapiens
uuuauuuuuuucauagguauauaaacuauuuauuaacagacaaggccuacagacuuauuucuucuuggacacacccacggugcggccacggcggccaguggucuuggugugcuggccucggacacgaaggccccagaagugacgcagcccucuaugggcccgaaucuucuucagucgcuccaggucuucacggagcuuguuguccagaccauuggcuaggaccuggcuauauuuuccauccuuuacauccuucugucuguucaagaaccagucugggaucuuguacuggcguggauucugcauaacggugaucacacguuccaccucaucaucagugaguucucccgcccucuuggugaggucagugucugcuuuccucaacaccacaugagcauaucuucggcccacacccuuaauggcagugauggcaaaggcuauuuuccgcugcccaucgauguugguguugaguacucgcaaaauaugcuggaacuuuucagggaucacuagcgacauggcggcagcacaagcggcggcguguaggccuccugugga

SEQ ID NO: 13999 - RNA, 107736 nt, Homo sapiens
gccggcuccgcgcucgcgccccccgcccgaacggggcugggcggggccggcgcugguuagcuccggagugugaaaccgcguguuaauguaagcggcgcgagaggcgcgggcggcggcggcggugggagcggcggcugcagaagcagcagcagcagaaacagcggcggguacucugugccccgcgucccggaggcagccgacugcgccaccccacccucgcacggccgggcgggacccgcgccaccagcccggaccuccgucgucccgcggcgaccaaaacccccgcuggccccaccgcugugacuacucuggacucgcccgcagaguuugcccgccggggaggguggccgauuggcggagcgcacuccugcuguuuuccccaccaucucguggaugucgucccucggguggugagagaacuuugcagugggcuggagcgcccuuugcggagaagcacacgaaggugaaggaaggaaagaaagaagaccgaggaagaaggagcucggaagaaggguccggagcggccgguccggccgugcagggcgagugcgcccgaggcgcggcgcccugaugcuccccgggcucgaggagcauugggcacuugcgggacugcucucgguggaguagccccgucgggcccggaggguuugugcaaccgcggagaacaccgagugcuggucgcacggggcgugccgagccgccucccggcgcgcccuccgcacuuuccccgccucgucauccgucgcuccccggccaggagccuccgcugcgucuucaaccucgcuccccuuugcgucccgggagccugcgagcacccggccgaaggcgcagccgaaucuugcgggagucgccccgaaagcgucggguuugugugggguuagcgggggccgccgcgccaccugcaccucgcccgccgccgccucggggaaagcccgaagaggaggcggaccaggagaagagcaaagaaaagcaguccgucuggauuuguuugcccaggacuggcgccgcgcacgcggaucgccgaggggagugcggucggagucaccgcgcccccgccuccccgcccgggcagcugaggccggggguuggagcgcugcccccgcgcacaguccccgagcgcccgacgucuccgcgcagguucuugaagcagcugggccuggggcgcccacuaauguggcccugagggccggagcccgcaccgacgggagcgggagccggagcagcugcgggcgccgaguggccggugcgcccggcggagcgcgcgugcguggccagcgcgcuccccgcuucugcuuggcuuuccggcuuaauuuuccucggcgggauuaaaguuggaaauugaccggagaauugaguugccggggaacagagccccggccgccgccagagcgauguucccgcagagccggcacccggugaggcgcggcuggguggugguggggggccaggaucguuggggaggcgcuucucccgggcgguagggagacugguggcuucugaggcccggcggaccuucucgcccucagcgguguaaggcuggggaggucuggggcccucucuuccugggguggggagugggccgaaacucuuaauuuucucccucccuuugggcuccuuccuacuugacgucuauaccgagcggacaggggcgcuggggaaggcugggguuucucuccugcagccauauccccucuaccuuccccgagugggggcagggcgccccccccuuuguuucuccucucgccuauuuacaugucaaugcggccccgguuccggugcgucuggagguggccccggcgacucugggaauggggagcguaaaggaguuguuuuucuccucugguccccggggucauuaucgccgccgugggggaaggggcggcgacaccgacaaucuggccuggucuucccuggccgccggggagcccccuucccuuuggccuggugacccgggcgcacuuagcgcaauccgcccuggagacugggaagagcuuccgagccucuuuagaagccggggcccggggaggguccgcuuucccccuccccauagugaagggcaaacucgaguuuggggccucguuuucagccacuucuaacuuuauguuuaugucccacccguucuugccuucucugacuuacugcuuuauucauccgcccgcauucccgucccucggucccccucgcuggucgcccccagacgccgcaccaggcugcaggccagcccuucaaguucacuaucccggagucccuggaccggauuaaagaggaauuccaguuccugcaggcgcaguaucacaggugcguguccggccgcgccaugcgaguggucgcgggcgucccggugccccuugcacccagccggguggcggcggcgccuguacuuaguucuugcguccaggcgguggcguguggagucucaguuaagaccugucauucaaguuacccccuuuccugguucuucccgggccgccucuucucuugucuccuccuccucccauuguuucccuuuugccgguuugcacuguuccagggaguccuuuuucaugucuuuaggaguugcaugagaaucgucaauauuugcacuucauguauuuauuuuucagcagacugagcugaaacauugguucaaucgaugucucaguccuggaguguggguucagggaagcaaagccauguugaaaucgcuguuugccauacuagaaaauuggguuuucugaggcaaaguccauuaaggaaggcuagaugcuuauaacauugcccaucauuggugauggugagggagguggguauaauaguauaaagaagaaagcucaccugcuuuggcgucauuucggauugguuuggguaggaugagagaguggagucacauuuauauccaucucagccuuaguuucuucaaguaaugagacuuaccuucaaaggacuuauaaauuuuuguaaaauacuuugccaauagugaacuucccagaaagguuaguuucuuucccuuguuccuaugaaguuuuaccugauucuaacucagaaauaacuguauugacauuuuuugcuuuugucaugcuugagaaaaagcacacagaugaggcgaaguggcuugggugugaauuuucuuacuuugucaggggcuuucucauuauugaccuuuugucuacuuguagauaauaucucugcagcuugaggcauacuugcacacaccguguuuacccagcagggagaacuucaacccacuuuauugcaguagcuacuugacauauuuuggcagggauuuaaaaaccaaagguuuugaaagggaccagcaauuguaggaguaacuuaacagauaggauuuucaaaccuagagaccguuugaguuggcaaagauggcacagccuaugccuaagagugaagauugugcaagggccggauuuugguggaguacagagaaacaaacugaugcaggaagguagggagcagaugaccaugaggaggaaucaguuagagguucugacagauuuuuuucauucuugucaucuaaccagauaggcaccaagaagaaugguagcugaauggacaccuuguauuguucacauuauuccuuuucccuauuaaaugcaaggacaaagcuuuuggguguuuaccuagauaguuuauggcuuuuccaaauuggucuguguuuuuacuugaagugcaaauaugugaggcagauguuaaaacaagugacauaauguuuacauuaaguugccuguuuuguuuuccuagccuuaaauuggaaugugagaaacuggcaagugaaaagacagaaaugcagaggcacuaugugaugguagguaucaaagauuggacuuuuuccuuuuucauaugauauuagcaaacguguuagcagaguguaaaaaacaugaguuaaugaaaugcuugauucuuuuuucucuuuacaguauuaugaaaugucauauggauuaaacauugaaaugcacaaacagguaagcuuuaguugaacuucaagcugaaaugagacaucaguucauaugauuuaauaauacuggcuuuguucucaguagugggcucuagggguggggguuuguaugcuauuuuucugccuugguuuccuguccuguggauugaugguaguauucugcaucaaggguugcuucuugauaauuacaaguguuuaaaugacuaggagagggagagguguuuuggaaauauaaacuagccucuuuauugacagauaggaauuaagacuugaguuuacuuuuucaccuguauagauuuauccucuugaaagggcuggguaucuucuacaguugcugaaguuuagaauaguuaauguuuuugugcuguuuugcaaggaaguguggaccuguuggggggaaagaaggguauucaggaguuuuuuuuaaucgugguaaucaagguauaugacuaucuguggaguauucuuuaugcuuuggggcugcaugaagcaauagucaggauuaguggcuuauuagcaaacaaauuuuugaaaaauuucucaguuguugcagguguggaugugaaaaaagcaucuuuuuauggccagagcauauguugggaguugcuucaguccuagugguuuuuaaagcaugaaaagauuagugacuggaaagcucuagcaaugacuaugaguuugcaaguucccauaaaauucacacuuauggcuacuauaaugguguauaaaaagaguauugagcuggaacaaggcacuaaggaccucauaagagaagaaaagcuaaaugauugcucagcccaaaggacccucgauugaguagucauugucugccaaagaaagcauuaauggcaggguguaaguauucuggagauacgcugacauucacuuuuucaucaagacgcugguacaauaagucuuuuagaaaucgauugccucuuaaaaaauuaucaucagaugaaguugcacaguuggacacauuucaaagugcaacaauacaauucuuacuugauguauaugugcuauuucaucucaaacccuuguuucauuaaauuaaagagcauggcugaccggcuggggcacaguggagaaauugauuaguucagccuucagaucuuccuuauauucaaagacuuucauuaagcaaguguguuucagaguugaauucugcuuuuguaacuccgcacucuuugauuuuuaauucaucauagauuucauaauguuaaguuaucguguacauuagaucuguucucagauuuguguuuggaaagagauugugauuuucagggccuuuuauuaauaauguaauugggccuuuaaaaaugcagauuuuacuaugauuuacaaaguugguagccuacuuuauguuggguuugugccuuuguuuuuguguguuucucaguggcuagugccuuauucaggcacuuguaacuucuugauaguaaaugggcuagaagaucuguggcuaacaucuaucgucauuuaagugaauuaugcaaauaaacuuggccuaggcgguuuaaucuuuuuuuuuuuuuuuaauuuacucugaagggcacuuuuuuuuggauaacagauauuauggaagaguaagaggagacugagcuuuuucuuaaacccauaaacucaaaggauuuaauaaccucauugacucuuuuacaagggaacaccaccucagugugaugcuauaugcuggugcuggguuuauuggaggagcuaaaagagguguguaauucuucuggguuccuguagguuauguggcgggaugaccucuucuuuaucauguagggagaaggggugaagugggucagaagcaccauggugugagaauaguuuucuaaugaguuucuauacagagugaggcauuuguggcuauauacugucuguccgugagccuguaugcauuaauaauaugcuguguauaauuggcuuagcaauuugaaaaacgugaaaagcugagagacaccauguucuucauaguaggguacugagccuccugaaauuuaguugauauuggaaaugcugacagacccuuaacuagagugcugugcaaaguagugcuauaauucaguuuaaaguggacuuacauuugaaaaacauccuucugaaugucacacauuaauaauaaguucugaggaggcauuuggugcagcuaguaaucauaauucuuauuaaaacuggugacgucuggcccccaggguguagccaagcucaaauugaugcuuuuugccgccugaucaccagcauggccuaagugcucauuauauuguagagagggccuuuggagcucucauuagauuugacaggaauucucucuagggggaaacugggcauuagcgagacuccugacaggcugaaauuauuccugcuuuauggcuuauaaccaaaugcuagcaaggcaucaucaggggacacaaaaaauugucauuuuugacaacaucuuuguuacuaaaaaaaaaaaaaaaaugcagugauggggaaacuuuccguacagagagcuuuaaugcuguuaagauuugucuccagugugacgaccgcucucccuucccaccuuucaacggguuugucggagugaguucuagagauuucagugucaaaucucacugcugacuuuccugucuggaaguuuuaaagugaaagugcauccaaaucaagaaugguauaauugugguuuccuuuccugguguggugcccacagcccguguuuagguugugucaacacuuccugauaagccuugccuuuacuuucucugcucccguuuguggcggguuaccgaaaaggcaaugaaacaggaaugguaauagauacuuaagucuuucaugguagcacuaagaauauuuuuuucuuggagcccuuuauagaucccugucugcccaucuuuaucuguguggaugguaaacucuagauaucucuauacaguagagguagacaaugucucauggaaaauugaggcaguucugauaccaucagaguguuagggugcauuaaaaaacagcaaguugaugugagccuggugguuugccuagcugugccuagugugugugguggcgugaucuuuaaauguuuuugucugucauaugguuugauauuaccucauuugauauuuuugggaacaagauguacuguaaaugcacacauaaaccuuauuuuagcccacucauguuaucuuuucagcaugcugaugaagccaugcuauaaauugucauugguggcuuuaauuugcacaguaaugaacaguuuucaaugugauuugucuucugugaccuccauaggcauccuccagaguagauuggguagguguuuugcucugccuacagcugugugcacguguucagagucugggacuugcucaaggccacgcaucuauugaagcuugaguuggguugccuccuccaggguugucugugcugcugcugcugcuuuuuuuuuuuuuuugagauggaaucucgcuuuguuccccaggcuggagugcaguggucgaucucugcuuacugcagccuuugccuccuggguucaagcaauucuccugccucagccuccggaguagcugggauuacagguguccgccaccaugcccggcuaacuuuuuuuuucuuuuuuuuguaguagagagaggguuucacccauguucgcaggcugguuucgaacuccugaccucaagugauccacccaccuuggccucccaaagugcuaggauuacaggcaugagcuaccacacccggccugucugugcuucuuccuauccccucaugcugccaucaggaagaugagguggaccaugucucccuagugccugccucuucaguucugacucuuugugcugaugaacuucaugauuuguaagacaugucaggacugaauguauguucuaaaaguuaggagaaucagcagugccgcugacuggucuuucuggggagaggagggucacaggccauggguagauaaaacuacugagcaguacuguccucagguuaaaguauguuuaagaagaaacaagucaggaauccugguggagacccagugauggggagggaguuugaucagucacuuugugccuguguucugcugaagaaugggcagagugagagcacugggcucuccaggauggugaagaauuuuuuuucuuuuuuuuuuuugcgcgacggaaucucguuccgucacccaggcuggagugugguggcacagucucggcucacugcaaccuccgccucccagguucaagcgauucuccugccucagccuccucaguaguugggauuacaggaguccaccaccaugccuggcuaauuuuuuauuuuuaguagagaugggguuucacuauauuggcuaggcuggucucgaacuccugaccucaagugauuccccccgccucggcuucgcaaagugcugggauuacaggcauaaaccacugugcccggccgauggugaagcauuuaaaaauaaaugaaaagacuagcucugaaaaucugaaaggaaggaugauauauucugcaauccugguugggaaagggaaagagcuccaugugauauuucagcaagcaacaucucaggccauguaaauuuuggagugaaacugcuuuuacaguuuugaugugugcuuuaaaauuucucuuagaaaaaugcguuguucuuuaguggguuuuuaaaaaaguauuuagaugggacuguuagggacucaccugugggauauuuccuuagaugugauucuuuuacucuuuugcaaauuuuaccuuaguguuuuuuuuguuuuuuuuuuuuaacccuguguguuuuugucuacaguuucucacuuugagauuuuuuuucccccuaagucaacaucucacacagggaaaugacuagcuagaguauaggcacuuagaguuaagcuccagcagguguuaauaaucuugucauacaaagaggguagcugucaucaagauuggagugguccucaacuucauuagccaggccuguucuuugcaagcauaaguuaaaagagagaaagcucucugcauuuagagccuagauuccgaggugcaagauuagccuuuguuucuuaucagcaagcaggacugaucucucaccucucagucaccuuccccacccuucagcagugggccaguggcugguuuuuguccuggacuugcacuggaguaaggcaagggagucccugggcauggauuuuaagaaaaucacaaaacauaguuaucaugaucaauauuuugaaaauucaaacggaaugcccccaaaaucuucaaggaacaacauguccaaauuuuguauuagggcaggauccaacagggggaguugggaauagggugaggacaggagguagagucaggccauugcagggccacagcaccucccuugccucccccucuuucugccuuugguuaccuguccuguggggaguggccaugaacuauaggcucugacuugguuccguuguaguucauugaagucauuuaauuggggauuuccauucgggacugggcaagucaugaacacguucccuggcuucaguuccccucucuguauaaugaggguuagacuagacaaaagucuguuuguucccucgcauggugggagccaucccagcauacacccgcagaacccagcaccucgugcgugcaaauugaggagcguccuucgccagaggacuuaagauguucucccaaauaguguuuauuaagaaacagaaagaaaaucuguuucuuuaguaaauauuuaaauaaaucaucuugagugguaguuaaacuaaaaauauauucaguuacuggcucauggaaccauuuuaaguuuccauggaucugagucuuugcuguuuuauuauuaaaccuuuuguggucuccagaaguggauuaaaggggaggaaacugagaaacuuacuggcuuuccucaaagcuuugauugauuucguuuccuacccucuccccuccccauugcuuauuguugccucugauuuuuaaaaauggaaauucucacaacuaguaccuuuacuacaggguauuuaguauagugguuuuuaaguaaauuuuagacagcuguuucugucggugggcuuauuugacaagaauaggcaucuguaccuucaaaauacuccucaccagaggauuguucugugaauacggugugauguuuuaaguggaacuaggaugcgcaggugugggcaggaggagagagguuuucugauuuuuuuuccccgugaggugugguuugaucugaaaagugaaauaaauuugcacugaaauuuuaacauaaauuaagauauucauguauugccauucaccugauuuaacaaaaguaugguuucuaaaauuguuugcaaaggaaugauuucagauuugcugcuuguguuucuuccugagcaggguccacaggggaaaaaaaaagaaaaaaaagugaagaaaaauuuuuaaaauuauuguuuguagacuacccagucaccguaauauuuuuuaaugaaaauccaggaaguguugauauaugauuuuaucaaauaaccugugauuuagcaaaauuacauguuucauuauuuaacauuuaauuuuuuuaauggcgauagagucuuaaucuguuacccagacuggaguauaguagcgcaaucuugguucacugcagccuccgccuccuggguucaggugauucuccugccucagccucuggaauagcugggauuacaggcgugcaucaccacgccugguuaauuuuuuuuaaauuauuuuuugguagagaugggguuucugcauguuguccaggcuggucucaaacuccuagccucaggugauccaccuuccucagccucccaaaguguuggcauuacaggugugagacacuggucccagccccuaauuuuuuuuuucuuugagauggagucuugcucugucauccaggcuggagugcaguggcucgaucucggcucacugcaaccucuaccucccugaguagccgggauuacagguauguagguucaagcaguuccccugccucagccuuccaaguauccgggauuacaggcacgugccaccacacucagcuauuuuuuguguuuuuaguauagacggaguuuugccauguuggccaggcugguauugaacuugugguuucaagugagccacgugccucagccucccaaagugcuggaauuaacaggcgugagccacugcucccagccccuaaauuuuuaauaauuacuaaguugcaagccaggcauguggcucaugccuauaaucccagcuccagaggaucacuugagcccaggaguuagagaccagccuggccaacauagcgagacccuaucucuacaauaaaagauuuaaaaaaaauuaauugggccuggugguacagaccuguaguacuagcuaguacuagugcugagugaggcaggaggaucuuuugaucccaggaguggggagguuauagugagcugugaucacaccucuguacucuagacuguaugacacaagcaagaccuugucucagaacacacaaacaauaaauuguauucuauuuaccuucuuugaagcaauauaaaaaucauaauggugggcacaauuguuuauccccuccccuguaaggucucauaguagguauaaaaaacagcuauuuauuuuaguuuuucuuauaguaguauuugcugcuuagucauucuuugaccacaaaauauguuagcagaaaaagaguaggauacaagucacuuuggguagaaggaaaaagcugggaggaaaaaacaaauucugaaaauucuauccguugaauuaacuuuuucaucuuccaaauagagaaaaaauuaaguaugcuagauauacaccacuguacgcuggaagggauagaguuguauauguagcuugcugaucaucccugaaaucuauucccaguguacuaauggauauucauuauccauuagaugaaguggaaucagucuuugagaauguagguguguuugaacuugcgcguccaaaucuugcaguuugucaaacuacugaaauacauguaccaugagacuggguuugguauuagcaccaugacugaucuaaguagguuacuagucuaugauacuagucuagguauacguacaaccucuuggugaaaagcuugagugcguuuaccugaguuguuuacuuuuuuuuuuuuuuuuuuuugagauggagucucgcucuguuacccaggcuggggugcaguggcaugaucucagcucacugcaagcuccgccucccggguucacaccauuuuccugccucagccugcugaguagcuggaauuacaggcgucugccacgaugcccggcuaauuuuucguauuuuuaguagagacaggauuucaucauguuagccaggauggucucgaucuccugaccucaugaucugcccaccucagccucccaaagugcugggauuacaggugugagccacugcgcccggccugaguuguuuacuuuuaaauuuguaaggucuuuuuuuugggggggggaagacgagucucguucugucucccaggcuggagugcaguggcacaaucucagcucacugcaaccucugccucugggguucaagcuauucuccugccucagucccacgaguagcugggacuacaggcacgugccaccacggacccagcuaauuguuacauuuugguagagacgggguuucuccauguuguccaggcuggucuugaacuccuggccucaagugauccguccauuuuggccucccaaaguguugggauuauaggcgugagccaccaugcccggccaaauuuguaaguuacauacauacauuguuguauuacacuguuguauacauuuaaaauaaaugaacauuuuaaacagugguaaaaugaaaugucagcacacauuccauugacuugcccaguguccccacugcucagagacugcuagcccauaugucaaaccuggccgcacccugggaacuccagcccuggaaagggagcaucuuuaagauagcagauguaaauugucuucagggucuugggauuacauccauccuauccugcauguguguucuuuuaaauuuugacuucccccugugaugaccucuuugucccucauagccugcugugucuaccccugaguacuuucccuuccugucuuggccacugcuucuuucucuuccugcauuuccuuuuauccugccaaauaggccucuucuugcugaaaguauguuuugaguuuuccuguuuucuuuauaaaaaguccaggcuuuuguaucaaccuucagauggccuuccucagucuccuucaagucccaguucaaacaccaccaccuguuuacuucaaggcggccugggacuacccaguggcaggcugucacagcacuuguuuugcucaguguccuguaauaaugguuuuucaugugcuucuuuccuugcuccgacuagguugcagucugcuugaagcugaguuagggacuuccaucuacccuucccgaugaguuauccagaguaggcauugauuauauuguguuuuggguacuccuuauguguagugguaguuguauccauuuuggacccugaacguuugaaaaucaggugaaagcuacuuugcaagaaaaguuuguacauguuuuuacacacaaauacccaggauagcuuugcccaacgauuuuggcuguuugugugcaucucaagauccuucaacaaguccauggaauucagauuaaaaacucgaaucaagaaaacuagugugggucggccuggugugguggcucacgcccguaaucccagcacuuugggaggcugaggcgggcggaucacgaggucaggagaucgagaccauccuggccaacauggugaaaccccgucucugcugaaaauacgaaaauuagcugggcgugguggcaggcaccugucaucccagcuacucgggaggcugaggcaggaaaaucacuugaaccaggggguuggagguuguggugagcugagaucaugccacugcacuccagccuggcgacagagcgagacuccgucucaaaaaaaaaaacaaaaaaaaacuagugugaguccuuaugcuaaaauuaaaaaugaaaucuuuucaguucuaauaaccuuaucuaaccaguuuugcucaguuuuucuuuuggaagagugaucuguagucaguaaccacugagaguucuuagugaggaguuuuauuguaguaauauguuuggguuuggacuaaaaaagagagauaaacaaaacuagcauguugcuggggccuagguuuggugugaauugagcaugugcaggcauuacugucccuggaacugcagcugccaauagaguguagaugaauugcaugacaagcuucucucaaggcauuaaacuugacuugucaccagauuucuuaguaauaaugaguauaaccacugauuauuuacuuagucuuuacauagugucuuccauucucccaaacauuuuauuaugaaaaauuucaaauuacagaauaaaagagaaauacacagcaauacccauauuauacccaccuguaugauaccuggagucuauaaauuaacauuuuguaauaucuaucugucauauaucuuccauaggcuccuccuucccccaaaaucaagaaauaaauuaauaauauggggaauuuggaaggacuugauagaggaucaggccuuucuuuagcuaccgaccuuggcuuagacugauaacaugaagcagggauuuccauguacuuuuuuuaaaauuuauuuuuugauuuuuuucaguagagaugaggucucacuauguuguccaggauggucucgaauuccuggacucaagugauccucccaccucagccucccaaagggcugggauuacaggugugagccaccacaccuggcguccauguacauuuuaagaauucugucuucaccuguuuuuauaggguuuuccuccuagacuugcccuuuguacuuuuggcgugguuguauuaggugauccaccauuacacgguuuuuaggugauuucuuucucaacugucacuugagauuuuauuuaacgcagaaaagcuggacuccccuuacaaaguccuccucucuuuguucugaccccucaaugaaacuugacuuauacuuuaccuuuaagauguaaccaguauauuugcugggggaaauauuguuagcaacgauagguaagaaaauagaaauaauuuugcaaaaggacucugauuuugaacuuuguguguauggaauugucgugauggagauuuucaguuggccucagggaccuugggugguaaggggguaaggaccagaaacaaaaccucauugaggaccccaguguguggaaccaggcccuucaaugcuguggccuuccgguugcuccucaggagcauagucuuuguuuccucuuggugcccucuugaugccuugagcaaacagcuggucagagcuucuuauaaguacaguggccagccaguguauugacacgcacagacacaauagaaaacugcauuagaaggcaagccauugggauuugcaguaaauguauuacagaacacaagugacuugcugauacugcuuguuuagcaguuugcaagggcaauggcaguauggauuuuugaauuagaagggaagggcuguucuuucucugugugggaacaucuaguugauggcuggggagaaaauugauuuagagaacaaaaugcagccaccguuauuugugccauuugaaaggccucuauggauuagugagugaaaauaaaaagguugcuuucgguuuaggaaagagggucuuaacauugaucugcgucuuggucugguauggagagaauaaaggauggaccaccagauggagaaagggcauccaggccccaugcagccugcagauacagguacacacuccauucucacauaguugucuuucucagcucuuuggcuuucagaagucggcuuuuuggguuuauuauuacaguaagcuuuuccaaugacaacauuagaguugucauagcccccauccguggagcucccaugugcccuaggaauugguccgccagaagccgcccccuccccgugucaaccuucccagccucccuuuguguggauacuaauuauuccaccuugaaaaagagaaaacaggugagugggauuaggggaugacaguagcaccuaccccauaggguaauuaccaagauuaagugaguuaccaaaugcaggagcaguugcguaguuuccuggcaugggggcgcucugagggauagcugugaucuaaauagcagucccuuuaaaacucuaccccugcucuuggacuucuaggccaugcuucacugauacuuccguuuuguuuuugcaaacccagcuuccuuccuaccucugaacugauuuucccauuaccguguuuuauuucuuuccuucuaagaucauaagcauuuaucuuuaggcuuaaaaggagaaaaaaaaaaaaggacuuguuggcagucuguuuuuuuuuuuuuuuuuuuuuuaaaugaagucucgcucuugucccccaggcuggagugcaauggcgcaaucuugguucacugcaaccuccaccucccagguucaagcgauucuguugccucagccucccgaguagcugggauuacaggcgugcaccaccaugcccagcugauuuuuguauuuuuaguagagucgggauuucaccauguuggccaggcuggucacaaacuccugaccucaaguaaucugccucccucagccucccaaagugcugggauuacaggcgugagccaccgcguccggccuuguuggcagucuuuauugucuaaguaaaaugucuuacuuuggccaaacagcagaauguguccuuggaaggcaauagcuuuaaguaauguaacuaucaguaagaauaaaguuguguugaguuuuuucauuuaaagggauggaagaacaacaaaggauuugguucauucuaucaaaguaaguuuuggcagaauaaggacuaggagguauauuucagaguuuuucuuucgaauguaacauggaaaauuugucauuuugaaaacaagcaggguauggaauuagagggucaaguuguugcuugguuacagaaagaaaaaauuucauuuugaugagggauauguacaccuguggggagugugugcauguaguuuucuuuuugcucuguaaaguacugugcaaaaguugugaguagaguaguuguggugcugucuuucuucgucuacuccaugggcuugagauuuuuguugacagucaagguucacagcugcugcugauguacuaauauuuggggaagcaaaaaaaaaaaaaauuguugggaggcugaggcgggacaaucacuugaaccugggaggcggagguugcagugagccaagaucgcaccaucacacuccagccugggcaaaaagagugaaacuccaucucaaauaauaauaauaauaauaauaauaauuuauugcaggggagaaaggcagagccauugggauuggucaaacuggaaguuuaggcuguuuacucuuaaucccaagcacaaugcaguagaaacuucuugugugucuuuguaaguauuugagauaaagcagggcacaguucagacaaguugugccaguaccugcucucaaacaagcuccaaaguuggccgccuucugaucugggugugcugagaagcuccgcguucauggcucuuucugcuuagcuugagaaguggcccugacacccugaggaucuguaggggaagcacuagguucuugacaacccccuagccugccaguuggccugggucccagaacuuuuuccauuuguaagugggcuggcucauuuacagugcuugggccaugagcucccucagagccaaugucucugcacagcuacugaggagauuggaauuggaccauugaaauguauccaacuucuguacuuuuuagcugaccaaaggccaaaaucauaccacuaacuuaggaggggaacugcugacauuugaaucuuauaagaaaucuguauuuuauaaucgacuacccuagaugcuaugauauuuaugaauuaaauggaaguauaaggaggaaguauaaggagguuucaaauacugacuggauuuuucugaguauauagauuuuuuuucuuuuuuuuuuuugagacggagucucacucugucgcccagguuggaguguaguggcgcaaucuuggcucacugcaagcuucgccucccggguucaagcgauucuccugccuuggccucucgaguagcugggauuacaggcacaugccaccacgcccugcuaauuuuuguauuuuuaguagaggugggguuucaccauguuggucaggcuggucuugaacuccugaccuugugauccgcccaccuuggccucccaaagugcuaggauuacagguaugagccaccaugcccggccuucauuuuucuuaaauagagacaggguuucgccauguugcccaggcuggucuugaacuccagggcucaagcaauccgcccgcuucagccuuccaaagugcugggauuacaggcauuugcuaccauacccagccuaagaauacauuaguuuugaacugguuguuaaaucuguauucauccuuguuucuuuuuuguuuugagacagagucucacucuguugcccaggcugcagugcaguggcgugaucucaguucaccgcagucauugccucccagguucaagcuauucuccugucucagccucccaaguagcugggauuacaggugcucaccaccaugccuagcuaauuuuggauuuuuaguagagaugggguuuugccauguuggucaggcuggucucgaacuccugaccucaggugauccaucugccucggccucccaaagugcugggauuaacagcaugagccacggcacccagcccauccuuauuucuugacuaauuuauuaaguauggcuuaccuaccgaaagggucccagacagaucaaugucaguguaucacugaucuuaugcagccauuguuuggguuauuauuuuauccaagaucaaauacccaaaaaaagcugugauuuuuuuuuuuuaauuuuuuuuuuucugauuagcuucuggaacucucaaagugcugaaauugcucaaaguuaauaaggaauaaguaacaauuguugcuucucaaagcaauauaaaagguggccaugccugcaaucccagcacuuugggaggcugaggugggcagaucacaaggugucaggagggucaggaguucgagaccagucuggccaauauggugaaaccccgucucuacuaaaaauacaaaaauaagcugggcacaguggcgcacgccuguagucccagcuacuagggaggcugaggcagaagaaucacuugagcccgggaggcggagguugcagugagccaagauugccccacugcacuccagccugggcgacagacccagacucugucucaaaaaaaaaagggaagggacuuuuguguagacuuugcauugugagaauauugguauugacaccauuuauaauuuggaguagaguuugaagaccagauucuacuguuugucgcauacugguuaauauggcuguaaagaggagaugaauguggcuacuuuuccaagucuauuacucaggaggacuguaaauuugauuggcuguuacaauucuagcagaaucauucgauuugagagcaauagaaagauaagauauccaauuacccaaaugauuugcaggguuggccaacguugucauggagacacgaguuggaacaaauuaaauuuuaagcaauaaaauaaucuuaaagcccgucugggaacaagaaaauuuggcaguggcacuuaccugaauugaaucuuagcuugacacgauguuguuugacauugauauacugugggggccuaaacuuauaugugguacaacauuaucuuuaaaaagucgcucggccaaaccagcaaagggggaccguugguauaaagucaggguuauuaacauuuauuuauucuauggcuuaaaugaugauuagacucuggguucccaagaauauuuuguaucuaaggauugaaaugccuaaauaaugauuaagcagcuuuaauuggacacuuggggaaaaaaagauuuauuuagcagcaaugcgcaguuuuuggaacugcccuuccucuuugugugcaugucuuuugguguggggggggaggguggagguguaagcaugcauauauuugcauguacaagugaggagauuuuggcacaugccccuacacugcagaugauucucuguauuaguuaaaauuucuacuuuacaguacugcuugcagacuggaaaauugcguuccagacuucagcugaugaucuaaaaccugaauaagcauuagucuguggcuuagaagguuauuuccccucauuaauauauuguuuaacugguuccuggcuugugccacggauuugaaaacagccgaguggcccagaaggagggagggcuuuuuauccacaugucuauuagacagauggagaugaaaauuggucugaggucaagccauuugcagcguucucacagccuucgauuuuccucucauccucaccacagaucaucucaaaugauucaguaaugaccaaaagugcaacauugaccuuuauucccugguggauuacuguguuucacaguccaaauggcaggaagucuuuucuguucuuccagaaggagugcagcauuauugagccaacccagcccugugggaaccacacaaaugcagaccaguguaacagaauacguggguuaaauuugguuucuggugcugugggaaacgagaauugacauguccuggaacccacauaauuaauggaagacuaucuaggauguuuucuaaaaacacacaggagcauauaaauugauuuguccacuuguaaaauaacuugugaauuacaggagugguaacuucugguggccccugguuuauaaauuguucuuguuuccauuaucuucaguuccucucuccuuauuuaaugcuucccuaguauaucuuagacaauacuguaaggcuuuauaauuuuaaaauuauaaauugacaugacugagcauaaagggaugaaggccuuuuuuuuggcauacuuuuaauuauguguauuuuuggucagucccuguaacucugaauagauucugucccauacgacacuuuuuuucccauccugaaaguagguugauuguuaucuuggaggaauggugauuauuuuucucuuacuuagauuccucuguggauuguauaaugaugcagugauugggguuuuuuuugguaaagaaguaauuuguauuuaaaauguuauuccuguuugccuccacaugcaugggugagucaauauucugugaauccauacaccauggcaccugucaucuaggauccuuuugcuuacucucuucuaaauacuuaaaauaaucuuuuccaaagguuaugcuuugaaaaauuuagcuagcaucccagauuucauuuuaaucgugacuaaaaugcuuuugagaaaauaaaacuucuugacuguuaacuguucacagguucuuuuucugccucaguggcuccaaauuuuaaucccuacccuugcccaccacaacuuccaacuuccuuuacauauccuucuuuuuuuuuuuuucgagaugcagucuuguucugucgcccaggcugcuggagugcaguggcgcgaucucggcucaucgcgaccuccgucuccuggguucaagcaauucuuaugccucagccuccugauguagcugggauuauaggcaugugccaccacgcccggcuaauuuuuguaauuuuaauagagacaggguuucaccauguuggccaggcugaucucgaacucuuggccucaggcaauccacccuccucagccucccaaaaugcugggguuacaggugugagccaucacgcccgggucugaguauccuucuggcuacuuugagagugaguugcggaacauugcagguuuuuuggcaugugauauugauuaaaaacauaauuccagguuccauccgggaaggcagcaaccuuaucuuccuucccaaaggaccaccucuccccagccacucagcuugggggggagcaggaauacagcucaagggcugggacuuccccgcugaaguuucagcacugaguuugaggggccaggaauggcuuugauacauauaucaaaauuggagccauuauguggcacugggggccuagaucuccuuguagagagcuguuuucccuaagaaguugcucaggaaggagaguggcagcuguuacucauguaugugggucauucagcuguagcauggcccaugugcagaaaguuccuuuucuaccaucuagauuggcugaagauuuaaauguguuagggaaacauucagagguaacuugauuuuugcuucuuuuuuuuuuuuuuuuuuuugagacagucugucucugucucccaggcuggagugaucucucggcucacugcaacuucugccacccggguuuaagcgauucuuguaccucagccuucugaguagcuggauuacaggugugcaccacuacacccagcuaauuuuuguauuucuagccauguuggccaggcuggucucaaacuccugaccuaaagugauccaccugccucggccucccgaaaugcuggaauuguaggugugagccaccgugcccggcugauuuuuacauauuuuuaucucacucuguugcccaggcuggagugcaguggcuuaaucaaaacuccaaacuccaaaccaaggauuacuccgaacaagugauccuuugccuaagcauccccaguagcugggacuauaggccacaccaccacacccggcuaauuuuuaaauuuuuucuguagaaaugaggucucacuauguugcccaggcuggucuugaacuccugcucugcggugauccucuuaccuugcucucaaaagugcugauagaugugagccagugcuucaggccuuugucuuuauuuacacaggcauauuuuauuuuauuuauuuauuuauuuauuuauuuauuuauuuugugagacgagucuugcucugucacccaggcuggagugcaguggcaugaucuuggcucauugcaaccuccgcuucccggguucaagcgauucuccugccucagcccccugaguagcugggauuacaggcgugcaccaccacgccuggcuaauuuuuguauuuuuaguagagacugcguuucgucauguuagucaggcuggucuugaacuccugaccucauaauccgccugccucggccucccagaaugcugggauuacaggugugagccaccgcgccuggcuacacaggcauauuuuaguuucauaauuguaauuuuaaccuucaaccagugaugaugaugauguagucuacuuuuccucccacuaauccugccauugugugguauuaccuaauuucuuaugagcucucuaaugacuaagauaugugaagagguuuaaagguauaggcuugcuugggguguggcccagggagaggcuugcuugcuuuccacaggagaguaggugaugacuucacggugaugaucugugauucacucugcggaguuuggagaaagauuucuuucuccaccacagagugcauuuuccuuuaagcccaccaaaagcuguccuuuuuccauccugggacaagucaauaccauuuccugugaacaggcucuuucugaacuccauaacaaggguuucugaauaauggaaaugugcuauuuaggaacuaaaacagcugugaugcuuuugucaaagaugcaucuuuaccaaaaugacaaauuaaagcccaaaugcucugcuuggcaacaguugggucaaaacauuuaagucauuaauuagacggaacugaagggggaaaaauuuacacaaacagcauugcagacucaacuucaucuuggaaaaugcaacugaauucuuuaaaaaaaaaaaaaugagggcagcccucaaguggggccuggcaagcuugucauuugcaaauaaaucaaaagaccaucauugcaggaaggagaaccaaugaauagaguugcuuugucauucuuugaugggccccacacucaagcccgcuauuaaaaaugaaugcauucaagagccucugcauuaagaacauaaacaauuaagggcacuugaguugcucugcugagagcugcugcgaagauaggagagcuuucuccggagaugcaggccccugcaaucugccucacgaggagcuagagaaugggagcaauuaguguugcuaucugugcccaagcagccuucagcacgguuuuuuuuuuccuuccuuucuuuuaaccccuccuuguuuucagagaacugcgagugugaaagaugaggagugaaaggauaguaucugggcccaguuggagagagcucagauuuagaaugcugcaggagcugccaagugaggagauggaacauaaaaguuauuaucugccaguaauuggugacuuguguucugauuaguugagccacuaaaggguuucugucaucugguacucuuuguuuuguuuuaaucacaggcuugaagaaggggcgagauuacauugccauggguggaauaacuuaaaugaauauugugcgagguuuuccacagaaggcaaauguguuccuacacccccgguuuguguucuugccucaguguuuuguaaaaaugugugagagggcagcucucauguugcugcagggcucuggagagagacaggccugaccucuccucuccacugucuuguucugaucuuaggcaaguuauuuuagucuguucucccaggggaccugguguccacaugaagauuagagagagggugucagagcaccuggcaggugcuaagcaguagaugcugcugaaauagauggcagugcuucucaaagcauguuccccaguccaagagccucagggucaccugggaacuuguuagaaacgaauauucucaggccuagacuccaacaggaacuccgcaggugggccuagucaucuguguauuaacaagcacaagaccauccucguguacgcuggaguuugagaaccacugauaaccucacuaaccauuauaaggucaacuuaaagguaccucacuuauuuuuuuuuuucuuaauuaaaagagagauugaguuucccuauguugcccaggcugguuucaaacuccugggcucaagguauccuccugccucagccccgcaaaagugcugggauuguaggcgugagccacugugcccgaccuccccacauuuuuuaaauuuggauuuccccaaaaugugauuaguuauuuuaucggcauaauuauauuuuaaacaaaagcuacucagacacauuagauuuaaagaugaauuuaccuuuucaugagcuauuggugagcaaggcacugugaugggagaaaucuuaagacucugaguagcagauauccugaaggaggccucuuggcaaagaacucuuccuuuccuaugaagggaaagagaguauuggaagauuauuugcaguguuuuguguguaucauuuuugguacacaguuuuuauucauguaucccuaauuaaguuuuuuuuuuuuuugguagaggcagugucuugcuguguugcccaggcuggucucgaacuccuggccucaagugauccaucccgcccaaaauggugggauuauaggcaugagccaccaugccuggcuccuaacuuucuuuagguauaaaaauaagacgucaucuucaggaacuagagauguguuuguggauuuuguucuacuggugggccagauggucugauguuaggguugaugcaucauucuuucugccugugaaggagaauauuaaaguggaguuuggcugcaacucauuuacuuaagguuugcaauuuauaauugaggucccuuauaaaaugucuauucuggccaggugugguggcucacaccuguaaucccagcacuuugggaggcugaggugggcggaucacgaggucagaagaucgagaccauccugccgacauggugaaaccccgucucuacuaaaaauacaaaaauuagccgggcgugguggcaggugccuguagucccagcuacucgggaggcugaggcaggcgugagaauggcgugaacccgggaggcagagcuugcagugagccgagauugcgccacugcacuccagccugggugacagagcgagacuccaucucaaaaaaaaaaaaaaaaaagucuauucugugcggauaccucugcuaggguagcaagggcacggugacccugucauugacagaugagaggcacuuucuguagucccuuuguuggcugagggaucaugcggacuuguccuugugcugcugcagcccuguuugggcuguauggccuuucagcagcugcguugcuuugcaggcagggccgaguucaucagcucuuucuuguuuuaucucccaauucucaacuucugcuuucuggagaaagaacuagacagggaauauguggcuucuugcucuaugaucuuggacaaaucauuuccuuuagaccucuguuuuucuaccugugauuugaggaucguaagagggcuggguacccaaauaguuccagguuugccagcauuguugugucucagcaccacuguugaucgcaaacguggugagccugacggcgcuuaucucccuuccugaugaaauauuaaauuuaaacaguaaauuggucaggugcaauggcuugugccuguaaucccagcacuuuggggggccgaggcguguggauaauuugagguaaggaguucgagaccagccuugccaauauggugaaaccccaucuacuaaaaaugcaaaaauuagcugcacgugguggugcacaccuguagucccagccacucgggaggcugaggcaugagaaucgcuuaagcccaggaagcagagguugcagugagcugagaucaugccacugcacuccagccugggcaacagggugagacccugucucaaaacaacaacaacaaaaacauuuaaacaguaaaucaagggcaaugauuccaagucacuggagggaagaaaaaaaggucacuaaaagcccuaccaccucagcauaauuacucuuaauuuuggauaucaauuuacggugcuuggccacuuugcuaauuuuuuuuuuuugauacggaguuucacuuuuguugcccaggcuggagugcaauggugcgaucuuggcucacugcaaccucugccucauggguucaagcuauucuaccaccucagcuccucaaguagcugggauuacaggcaugcaucaccaugcccugcuaauuuuuuuuguauuuuuaguagagacaggguucaccauguuggccaggauggucucgaacuccugaccucaggugauccacccaccucggcccccgcaaaguguugggauuacaggcgugagccacagcuccuggcccuuuaaacacacacacacacacacacacacacacacacacacacacacacaaaacaggcacacuaauacuaacaccgugucuccugcaucaucuagugaaugucuuggucauuuuagcaucauuaucaaaguaugacuuuaauggcuacuugccaugccuguggguugguguguagcguauuuaacuguucucuuaguuuuagacaacugauuuauuaggagggcaaauguuaacuuucucaaaaacucgguagaugguugugauguguugaauugcuguuacaucuuuaccuguuuuuuucucuuuucgcuuugaaacuagugcugcagugaacagcuucaugcauggaaugcuuuucauuugaacuauuuccuuaggauaaauucuuagcugugggaagccuuaccaacggguuugaauaauuucaugcucuugaaacacauugcccaguugccuuccaagacagcgcuaccaauuuaaugucaucaguaacguaugauuguuccacuuucccugaggaugcuucaucauuggauuuuguuaauuuuuuaaaaauugccuuaacuuccugaaugaccuaccuuacuuacaacaaaauuuacauuuuuguuugguugccggugagguuucuguguacauuuuuuuugggggggggauuuaagguugucauuucacagacucagaaacuucuagucagaagggauuuagagguuaucuguuuauuuccuuugugugcuuuguuuucauguucuugcccauguaucuguugccagacacuucuuaccaacacuccacuguguuuuuaucuuggcuucccgcuugguucaaagaaaccagaagaucaguuugccagcccucagcauaagcaccauuuuuuuaugauccaucaauuugcaauuuaaugcugguggaguuuccccucccuaagcugacuuugggcaaggugccauuggauugcuuugaggcccaugggcaauuacucuuaagcaguccucacccuguuuugagcuucaaacagcacucauuaugcacuacuguauguguaguggggaagugugcgggcgcugaggagugggcucuuccguauugcaguuagacaaaguaugagaaguaggaaaggugguuuuaggaauuauagaacccuaaacucuuaaguucagcuacucagaagaccauaucuugaaaaaaagauauauauauauauaaaaauacauauauauauaaaaauacauauauauaaauauauauguauuuuuuauuuuuauuuauuuuuauuuauuuuuauuuuugagaccgagucucacucugccaggcuggagugcaguggcgccaucucagcucacugcaaccucugccucccagguucaagcaauucugccucaggcuucugaguagcuggaacuacaggcacgugccaccacgccaggcuaaauguguguguguguguguguguguguguguguguguguguguguguuuaguagggaugggguuucaccguguuagccagaauggucuugaccuccugaccucgugauccucccgccucggccucccaaagugcugggauuacaggcgugagccaccacgcccggccauaucuugaauuuaaaagucgcagaauacacuagaguuugauugauugcugaucucugagguccuuggccguauuucugcucaguuaaaacauacauguagcugggcaugguggcucaugccuguaaucccagcacuuugggaggcugagaccggcgaaucacgaggucaggaguuggagaccauccuggcuaacacagugaaaccccgucucuacuaaaaauacaaaaaaaaauuagccgggugugguagcaggcaccuguagucccagcuacucaggaggcugaggcaggagaauggcaugaacccaggaggcauagcuugcagugagccgagaucgcgccacugcucuccagcuugggcgacagaacgagacucugucucaaaaaauaauaauaauaaaauaaaaaaauaaaaccauacauguacaugaauuuuauacuuaccaacguaugauuuuguuuuuuuuuuuuugugaacagccuuugucuagcacuguuuaguaaugguuuaucugguugcaccuuggccauugaauuuaggggugcauggagauuaaguuuugguucauugaggcaugacuuugaaaguauauuaaauauguacccuggcaucaguuuuaguaggggagguacggcaaagaaaugugucacaguauuuaguaggagucguguucucguaaugcuucccaucuuguuguguugagaaggcuuuuagguagaaagcuguuaagaaacuguauggaagcuuucuuuguaugacauggugauuuuuaagcacauagguuuaguuuaccaaaugacaguaagugcuguggaggaucuugaagggccuagagaagagugcguuuauuggcguuaugggggaaaggcagcuucucagugaauuugaggcaggccuugagggauugggaagaucucucauauuuguacagcacuuuggaauaguauaccuuacauaccagcucaucagcucacucgauuuugaugaaacucucaaguagauuggugguaauccuguuaaguacgagaccugguugggacccagugguuuaagugauuuaacauagaaccccuagcaguaguuugccaagaugcaaacccuaauuuuuggaugaugagggcuaacuguauuaccauaugcaaaucagugaggagaguuggcauagguaaggagaaugaaagacuguuguagacagguaauuuggacuccugcuuccuccugccucaguaggugguggccauccaugaagaaagucuuguugcuggagccuucauccugcugcuuacauuucugaguggaggguuucaugcagauuugguuuguggauagcucuugaaugcagauuuauuguuguugccuuacacaguauuaaaaaaucuaggcacagggaaaguuuauaagcauuaugacuuaguggguaccaaauagguauucaucauuggguaggaaaauuauuucuaggugggaaauacaguuagcccucaguuuuucacuggaguugucuagccuuugcaagagguggaaggcagcagggucaaauacccagguuaaccugccagcacacuccaaucaagaauagaagcaugggcaggagucacuacgagaggccaggcgcgguggcucacgccuguaaucccaccacuuugggaggcugaggugggcggaucacgaggaucaggagaucgagaccauccuggccaacauggugaaaccccaucucuacuaaaaauagaaaaauuagccaggugugguggcgcgugccugucaucccagcuacucgcgaggcugaggaaggagaauugcuuuaaccagggagucggagguugcagugagcuaagauggcuccacuguacuccagccuggugacagagcaagacuccaucuaaaaaaaaaauaaauaaauagauaaauaaauacauaaauaaaauaaagucacuacgagacuuguuaauuugugcuaaauuaagaaucuuaccagaauacccuuuuguugaagcaagagauaauacuaagaauuauugccaguuuguaugcugcugcaauccagacuauuugaagggaagauguucaugaaguccucuuggagagcuagugauguuuuaggacucacagagcauuguuggguaagcuguguacccucaccugccaggagguagguugugcaggugaaggagccaggguauuucagaggacgucagcgccuuuucugggguaaaccagcuuguuaauagaacaguccaagacuuggauuuagauuuucuggcucaaaagucaagcuggcuugucaguauaguuuaagauuaggguuuagagaccuggcagacggaggggaagucuuggguaagacucuccucuauugcuccuauuugcuucuucuccagaccauuuauguagaauuuccaggacauaugguauggcuuucgauguuuuucaucaguuugagcuuugauuucuaacuuuucuccuccuguuucaggcuuauccagucuaacccaacuuacauaguacagucggcccuuuguaucuguggguucugcaucugugaauucagcuaaccaugguuugaaaauacuuuuuuuuaaaaaacauugcaucggccaggcacaguggcucaugcuaggauuauaaauccuagcacuuugggaggcugaggcagguggaucacuugaggucaggaguuuaaaaucagccuguucuacauggugaaaccccgucuuuacuaaaaauacaaaaaauuagccgggcaugguggcacgugccuguaaucccagcuacuugggaggcugaggcaggagaguuccuuagaacccgggagguggagguugcagugagccaagacugugccacugcacuccagccuaggugacagagcgagacucugucuuaaaaaaaaaaaaaaaaaaaaaaauuaugucuguagugaacauguacagacuuuuuucuugucauuauuuccuaaauaauacaacaaccauuuaccuaggauuuacauuguauuagguauuuuaaguaaucuggagaugauuuaaaguguauggguagaugugcauagguuauaugcaaauacaccauuuuauauaaaggacuugagcauccuuagauuuugguuuccaugggggauucugaaccaaucccucacagauaccgagagaccacuguauucauugccuuugcuuucauaugucuuucuuuucuuuauuuuauuuuugauaacuuuaauauuauuaaagguuuacaaguucauuucauucagacuggaucuuaacuguccuccgaccauguucaagucuacuuugaugccauucuagguaguaacacauaguugcuaucauaguuaaagaugagggcaucuuuucuuaaaccaaaauaaauuccaguuaaauaguuaagcauaaaaagugcagccauagcacacuagaagaaaaguaagaauggcuuuuaugauauugauguguucuaaucuuuaccuaaaggccaggagcauaggaagaaaaugcuuucauuugaccacauaaagacuuaaaguucuauacagcaaaaaaaucauauuaagcaagguugaaagacaaguggcaagcugagcaaacucugauaaaggguuaauauuugucccauucaaggaagcaccaccaaaggacaaaaaugauuaagcaacaauggaagaauggagaaaggaaacauagaguggagcaauaaauacaugaaaagauguuuaacuagaggaagaauucaaguaaugcaaauaaaaaugaggucauuuuuuaauccauuagauggaugaagauuaaaggaaggucaacaaaacucaauauugacacugggugggagagcaggaacccuccuaaacucgcaauaauugguacagcuuuucugcugggcaguuuggcagcaugcauugcaacuuaaaauaugcauacacuuugacccagcaguuucacaucuagggauuccuuuuagagaucuguguggaggcguauuugacagaguuguuaauugugcaaaauuaaaugaaacauaaauauucacuggugucaauaguacuuagacaucuauaugcuuguaugguggaauguuucaagguacuuguuaaucuguauugacugggauggugucccugacacauguuugauuaacaaauuauagaaaggcaggguauguaacggaaaccccuugguauuaaaaugugucucucacucugggcuucugugcacauaagugagaaccuggaaugaugguauccuaaaaucaccaauauguuacccaugcuuauccuuggaugaugggcucaggguuauuuuaacuuucuuuuauauuucuguauauguaucugugugcauguguaugaguucaaagugagcauauaucauuuuuaaaacuggaaaccuucaaugugaauuuccgagaagaggaauguacagaguguugcaggaaugugugguagguagggaguugggagcaaggaccuaaguaggauaccuaccaaaggcaucucuacuccuuuacaugcacucaaauagacagugcagaacccuguugcaaaggaaagccuugcccaugcuuucgaggagagccaugaccuugagguagcuugaguggguggcugugaucaaaugaacuggguggggcugacccaguucuguuuuuguaccugguacagcugcacccuuuuugcauauaucugccucgcuggcuaaagcaaggucaugcacgggcuuccucucucuaccagucauuuccccuucuaguacauuuuguccaaggcauggucugucuguaaccuugucucauugguggucagggagaauuggguugggucagacuaaauccaaucuuauaaaaccaaagacuuugcuuaguuaauucagaucaucuuagaagauacaaggcugcuguuuuuuauaugcuugauuguaaaguuccugggguuuuguucuuuucuuuucuuuuuuuuuuuuuuuuugagacagggucuugcucugucgccuuggcuggaguauaguggcgcgaucucagcucaccgcaggcucgacuuuguuccugggauuucuacuuugucuuuuuccauucucuauuucucaaggucauggacugcgugcuuuuaaguuuuuuucuugugauccuuuucauugcuuaauucaguaauauagguggcauuuaguaagcauugacaaaaugaugaaauaaguaaggucaaggaugggccucuuuacagaugacuuuuuuuuucuuuuuuaaaaaagcagaacugguucuuccuagguagaggaaagcagagcugcuuugcauugcuguaggguguuggaggugcugcagguggacccuucccugggcuagaaguagaguacccucuguucccucucuugccaguuuuugucccuuguagcagagggacugcuguggauguggagcggagcaaagguuuuuccagccuucuuuauuuuuuuuauuuuuugagguggagucucacugucgcacaggcuggagugcaguggcgugaucucggcucacugcagccugcaccucccucguucaagcaguucucugccgcagccucccgaguagcugguauuacaggcgcccaccaucacgcccggcuaauuuuuguauuuugaguagagacgggguuucaccaucuuggcuaggcuggucuugaacuccugaccucauaauccacaugccuuggccucagaaagugcugggauuacaggcgcgagccaccgcacccggccuuuccugccuucuuuaaaacagcccgugcuauagacacuaaggacaccuuuuauuauguucagcugaccccugggcccugucggugaggucuuugaguuuguuacugaacuguggcgaaacuuuccgaauacucaggauaucaugacuugaccaucacccucuagacuggaauguuuuuagucauguuuucuugguuuguuugaaaguuugagacuuagggaagcuaugaacaauaaaauccuuuuucaguuguacaagagcugggacaaguggcaaagaggucagcaggccuuucuucuacucuaucaccuuaggccucaucuuugaaagguggacugcuuugacagugcugcagcugcaguggcuucugacacccgcuugaaugaacuugcaauaaugacauaaaugugucauggugugccaucauugaaaaaguacacuuggcugggugcaguggcucacgccuguaaucccagcacuuugggaggccgaggcgggcggaucacgaggucaggagaucgagaccauccuggcuaacacggugaaaccccaccucuacuaaaaauagaaaaaaauuagccgggagugguggcgggcgccuguagucccagcuacuugggaggcugaggcaggagaagggugugaacccgggaggcagagcuuguggugagccgagaucgugccacugcacuccagccugggcgacagagcaagacucugucucaaaaauacauauauauauguguauauauauauagucaccauauuaaaugaucauauagccuuaaaccgccuagauuuuccaacucaaucaaacuacucaucucuuauuacaaugaagugugcaguuguggcuuacuuugcaagugggauuaauaucuacuguuuauuucaagauaaguauuaguaacauaaccuggggaaaccauuuuauacacauuuccagagcaagggagaggaggacugaaguguuagggguaugaaguuuuaccuuucugaacugauugugaaguauucuaaacauuuguguggcuuugucuuuauagacugaaaucgccaagagauugaauacgauuugugcacaagucaucccauuucugucucaggaaguaaguaaaauuguucagcuguuaaagugcaauuauguugcuucucuguuugcaaauuagcuaguuuuaagauguuaauuuuaucacaaggaacaagugugaagaacaucuguuacagcugaaguguguaaacccccugcuagucuauccaacacaucugagggcacacuguagaaauggugacaauagcucaacccccaaauuaauuuuuuuuccuguggaaaacugcaaaaugacuauccaauguacagcuuuugcuuuaaguagcauaagcuugagagcuacugaaaauucaggugucuuuuauaucuuuuaaauagaaagcuguucucauacugacuuuuaaaaaugguuccaucaagguagacuuuacuauggaggcagauaguucuuuuguacuuauguaucaaggcaguugucuuaaugcuguccuugaagggguggaugauaauaguccaaaauacauuaacuuaaugagucauauguauguauaagcuauuuuguuuaguuacaaagucauagagguuuaaucuuaacauucuuugagggaggaaucucuuuauaugaguaaucuaugaaacugacucaagacuauuguauuuuagcuuugccuugaaaaguuuaccuuccuucuggauauaagcuaguaaaugcuguaacguguucuaagugugcacgggaugaaugcaucuucacgcaggguggaaaguuuauuggacuaggaguuggaauacuggguauccugguuggcaccuguugcuccaugccggauggucaccaucucauuauuguuguaacagccucuuccaccauaaccuuugucugucugauaugacaauagauuugucugccuuuugaguauaucaguaguuguuagacuuuagugauccacggcucuauguuacauucucaugccucccaaaguaaauuuauggcuuuguuuuuauuuguggguggaguugggaguugggagguguggggugaguuuccaucucugaauugaggcuggaguccuuccuuugccuuguggaggguaaagaaucaaaaggcuauaaaagaaugagaggaauuccaggaguuuccgaaaaugacuggugggucaagauugguugaucagacaagugaucaaccaaucaacggauuuaauauuaaaguuuuagguauuaaaauggguauuuuauuuauuuauuuuaaaaauagagacaggguucugccauguugcccaugcuggucuugaacuccugggcucacccugucuuggccucccaaagugcugggauuacaggcaugagccauugcaucuggcuguaaaaugcauauuuuaaaauugcuguaaacuuaugaaccccuuuugugaacaagggugaucuuccaaauucuguucuauuuauuuuuuaagguccuauguuaucauucuuuauguccuuuuuuguuuucuaccauuccaagccgaaauuuacagccagaaguagugacugguguuguuuagaaauaaagggcagcgccauucucaguuuuucuuucccuaucuauguucugugaaaauaaagugugguugagaaauucugcauuuaaacccuucuacuucagccugcauugcacacagcauuugacuuuuuguuguuagaauauacagugaaguuuuuggcuguugcuaaugcccuuucuucuccuuguuuucaaagcaucaacaacagguggcccaggcuguugaacgugccaaacaggugaccauggcagaauugaaugccaucaucgggguacguggccuaccaggucuaccuccuacaguguguauaaccagcuuucauuucuuauuaauuugauggcuuuacguguguguguguguguguguguguguguguguaucuuaacguugaccuauuugauaagggugggaggaggagaggaagagacuugggaugugcuaagguauauggaggaagagggcuuagcauaaggaagaugacaggagaagcauuuuaggaggggacaaaaaaucuauuaauuaaaaaaauucuuuuuaaacagaccggggucuugguauuuugccuacucuggccuggaacucaagugauccuccugccuuagccuccugaguagcuggguccaaaggcaggcacccccuugcccgucccuaaaucuacuuuuaagugggaaaauaaauguaguucauccugugacaccuaaaccacccuugcuucauuagucuaguaaaagcuuuagguuagaauuuuaaauacuuuccucacuucugucuuacaauguuagaucacagugaggucaaaaugggucucugaauuaucauuucauuuaguuauccuugcuuuuugccuuuugcuuucugggguauucgaaccuauagaacuguuggcucuuguucuuucuugugccucuuucaugaauuuuuaagucacacaccaaugaaaagagcgcucucuugccauggaagaauuguuaauugucugcccuagugcucccuggcuuuucaccgggguucugcucuccucucuugaguucaguuagugcuccgugcuagccacugguugucaaucacaagucauuugcucugcauuaaugaaucuggugaaccgugcauuccauccccugcaugaguucauccuccgccccccacugcaggaccugggaugguucucauguguucguccccuuccacacuaagccaaagaaggagcugaaacaagggaccguccuuucugauuuuauucauaugugagugccuugagcagauucaaaucacucauuuaucaauuuauguuaauugcuugugagaugaugcccugcuggucuuuauaguucccucagacacuuuguaaugauaauuagacaugcugcuguacggauuaagagugccauaguccaaugacggccacagacaauggaaccaguuaauccaucagggcuuaaaauuacaucccaacuggagauggagaaaaaacauaagagccaaggaggauuaaagaaugagccucagcuugaaaacucuccuuucaucaguuucucaauugcagaucugcaguugaguugucugugguaagcuauuggcagucaauuaggugaaauaaacuaggagggugaccuucauuuccuuuuaauagcuuuuuccucccugaaauggggagcuucaguggauuuucagcuuaaauuuuauucaagcugcuuuauuacacuugacagcuuagcucugcauaaacaauucucccuccucuuccccccagauccaggcacugccuucccccuccuucaguaucacauuuuugacuguuacuuagugggcucucuaaucacauucaacaaaaaacacaauuacaucugcauuugucugcugccuucuguacccuuuucuuguguaaugaauugcuuuauuucagagaucaaaucaaauauucacugguacuuuugcauguacuguguuugauuagcaaagacuaauagugaauuguacuuguagcucaagcacagaauuuuuucacccaaaugaaugaggauggaaaagccuguuuugauuaaaagaaaacauaugcaaagcaguucucaaguacccgguuaaacuuuguggaacauguuuguuuucugauagacucuacauuacgacauauaauuucaugauggcaaaacucugacguuuaaauucucaaaggcaccgcccagcucuugugaaucuccuuugcaccuacacuuuaggaaggaggaaaucgcauuaaccagauguucauagguaauacccauuuugagcugaaucagagaauaaaaauagcagaucuuuuuagaagggcaaaugaauuucuaauuuuacgaauggcuuuaguccaggaaaaauguuguggagguuauuauaaaggcagguuagcucuggaugccuuggcaacaguaaaccaaaguggugaaucaggcgcaaugcaagcgagacuuaggcccauugugugucuugggcauacuggcaugugcgguuuuuaucauuguaauuuuuggauuaguauaugaauuuauguccgaaggcucuuuucaaguuuguggugaucaauaauuaucccacaccuuaaguuucaugcuguggcauaugcuugauuuuugccugaaaggaauugugugcguucuggaaaauugaaguagcauaaaauuggguugacaauucaguggaccuuugcaccccuucauugaacaugcagugugucaaccugucuccccagaggggaggagguaccgggaaacugucuguuccuacaagcagcagcugcgcgcagaguaaaugcagccugguuugauagcagcugucaguauuguucaggggccgacuuaggguaaagaacaaugggagaggccacgcucuuagucugcauccacuuucaggcuaagaaaagaaauaguaauuuaacgguuuagacaucuauuacaagugugaaagaucaugaaagaguacccuuuaaaaugcaaaugagccgaaacauucucauucccuuuaagguacaaucaaggagcuuuacugcuugcuugacagggcuaaagauauuucucuuuaucaaaccuggaaaaaguaaaucaucucaaggacauccagcuucuagguuaguucaaggugugucuugggccugugggugcucuucgaggagacagagagagguuguauuuuuucugugcuuguugagugaauuaacaguccccauuucucaccagcauagaaauuguaguucuccugucugacaaaaaauacugaauuuuaauucuuucucaccauagcaccugccuucaacuuacauagaguaccgguauuuaagaaaaauaagcuucuuagguauuugauacuggagagacuauugaaauauuuuuguagaccuuuuuuuaaacagcuuugacagcaaauuugaugacuggcagaauaauaacuacagcccuacuuuuugacuguugcuucuuaccaauucuuuuccuauuaaauguauuguagucuugucacaaugaaaaggauaauuuauagugcaaagguguacaaaauauguacaagguuuauuugguuugacacacagcucacuuaggccuuagaaaacaagucgcauugugggaggggaacuuacucauuugagaccuugaguuuuuagaucaggaucguuuuuacaccauaagcaacauuuuuguuuguuuuuuaaaauuucuauuaagaaugaucaaaacaaaauugguuauuaaauguuguaacaucuuauuuguggaauggcuaauggcugccugaaugcagggauaauugauugaaagacucuucaagaccacuucuccacuuuauuauuuggggaguuuggaacuaaaagcucucuucuaccugcucugauagauauugaauaauugauuucaguugggauugggauuuuaaauaauuauuguucucuuuacaucacagauaaucgagggauaauauagagagauacauaucuguacacacauauauuuguuuuuuucaguugauguauaauuguaauauagugaaaugcacagcuugauuuuugauaccuguguauaccugguaacccacauuccacaauaagggggugguuuccaggaccccagugaauuccauuauucuuacaguuuuuccccuucuccuaaagaaagauauuugcuuuuuuuuuucuuucuuucuuuuggcaugugaaagaagagcuaaagaugcuuggguuuuuuuuuuuuuuggagacaguguuacucuguaacccaggcuggagugcaguggugugaucucggcucacugcaaccucugccucccaggguuccagugauucuccugccucagccgcccgaguagcugggauuacaggcaugcaccgccauacccagcuaauuuuuguauuuuuaguagagacaggguuucaccauguuggccaggcuggucuugaacucccaaacuuaggugauccacccgccucagccucccaaaguguugggauuacagguguaagccaccgugccugcccauaaagaugcuuguuuuuuuaacugaaaaguuaaaagagaaucagcuaauugcauuuuuaaaaauauuaauaguaaacaauggcacaguuguauauuuuauuucuaaccaccuguugguccauuucaugguguuuuugguaauccacauaggaauauuuacauuguguugccuuggacaaagcaugggccuugggaucagauggacuuggggaggauacuuagcugccaucuauuagcuuuaugaccucauauagucaguuaaccucuaucaguguccccuaucuguagaugguaauaccgucuaccuucccacccuucccugaacaugugguccugacuccuugaacugcaguuuugucugccugguuucccuaagugcuuguagcagaucuguggguccaguuggucaaguccugguugguggugguugugccaagcagcagugcaccuccuccuuugucuuuagugguuacagggauguggguguuugagauuagacccagccagaggcuuugcuccugccauuaaguuguugugcaugaaugacuuuuaauaaggaaacaguagugaaaaaggauggccauuuagcuuuugaugugcaaacuuaaguuuggggaacagauggagacagaauugagagcaaaaacgugaagacaucauuggcuuccuuaccuaacacaaagaauaaggcagauagugucauuguuggcacaagagguuauaggaaucauucuguuaaaauugggagggaagagagaguuagaagacaucgucagaugaccaguggggacuguccucccguccacaaaaugccagguuucuauuuguggccucagagcugacaguugggugcaagaaaauuugagcaguuacccauaguaaugccugugaacuucaggagaucaagaaauuugaguuuguuuacauauaaccuaugcacaagagaaaaaaaaaaccaugaaauucggguuuaggcaaccucauuuuucuuucucacuuauuuggauguagucugacuuauuuuucaugaacauaaccuuggucaaggcauauggggcuuauaugggaaucuguuuauuggucagauuucuauauuccuucuccauaggcaaauaucugauuuuguauauuuuaaaacaacuuaguauaaaauuaaaaauaagucuaggguauuuugugaugucugacuagauguuuuuguguaggggauggcugugaauucaaacuccuaaaacauuuguagaaggagccugucuaucccuaagagauugaguuguagaccuaaagggcucuccacucuugcaugagaugauugguuuaaggauuaguaaaauguuggauuauuuuucuccuuuggcuauagcugucagcuaucuaugggauuguagugugugaaguuuaagaggaugagguuggccucuuauucuuaugaguaugugguuaaucccuggaaagccaucaguaacccagcuguaaguuucuuuauaaaacaaauucucccuaggagaauaaugcauauccugcuaccgagagaagacuaaauagcuacaacaaacauggaucuucuagcucuacuaacuuguauuuagugacguacucucuacuuaaauuccaacacucuagcccuuuuauuaaauuuccgaagggaaagagcaauauugcaaagaagucuucgcaguccguuucuccuuugguuaaauuuguuuguuuguuuuuacugagagcacaacuaggcgccugacaaaugcagaacuuuuccucaguguccggauuauugucaucaugcuuuguaguuauuagaaaaguguugaagcauuuacuuuuuaauuuccccacauauuucuuuccuuuuuuaaaaaaauuuuaauuuaaguuccgggauacauguauaggaugugcagguuuguuucauagguaaacgugugcugugauugcugcaccuaucaacccacccacauaguuuccugugauuuuuacuugauucccuggaauaaagcauuauauauucuucauuuuuccagaaggagaaaaaagcuucagaauagaaaauagaguaccccauuauaggaguuacaccuguguguuuuuaaauuuuuuauuuuuguguguacuagguguauauauuuaugagguacaggagauguuuugaugcaggcaugcaguguuuaauaaacacaucauaaagaaugggguaucuauccccucaagcauuuauuuuuauuuuauuuuauuuuauuuuauuuuuuuggagacagaguuucacucuuguugcccaggcuggagugcaguggcuugaucucagcucaccacagccucugccucccggguucaagcgguucuccugccucagccucccaaggagcuuggauuauaggcaugugccaccacgccuggcuaauuuuguauuuuuaguagagacgagguuucuccauguuggccaggcugaucuggagcuccugaccucaggggauccacccaucucggccucucaaagugcugggauuauaagugugagccaccagacccagcaagcauuuaucuuuuguguuacaaucuaaugacacgcuuuuaguuauuuuaaaauuacaauugaauuauuauuacuauuauuuuuuuuuuuuuggagacggaguuucucucuuguugcccaggcuggagugcaauggcgcgaucuuggcgcucacugcaaccucugccucccggguuaagcgauucuucugccucagccuccccucccaaguagcugggauuacagacaugcgccaccaugccuggcuaauuuuguauuuuuaguagagacaggguuucuccauguuggucaggcuggucuggaacuccugaccucaggugauccaccugccuuggccucccaaagugcugggauuacugacgugaggcacugcacccagccuauuguguguuauuuuuaaaauugagauaugauauauacaccaugaaauucaccuuuuuuuuuuuuuuuuuuuuuuugagacagugucucacucuaucacccaggcuggagugcagugugcaguggugcgauaucggcucacugcaaccuccgcuucccggguucaaacgauucuccugccucagccucccgaguaauugggauuacaggcacacaccaccaugccuggcuaauuuuugcauuuuuaauagagaugggguuucaccauauuggccaggcuguucucaaacuccugaccucaggugauucaccugucucugccucccaaagugcugggauuacaggcaugagucacugcaccuggccaaauucgucuuuuuuaaagcauacacuucugugguuuuuagcguauucacauugcuguacaaccaucacgacuauaaaauuuuucuagaacauuuuugucacccuguaaagaaacuccguauucauuaccauuuauucuucaugucuccuccccuaaccucuggcugcuaccaaugugcuuauccaucucuaugaauuugccuauucuggacaucucauaugaauggaaucauauaauauguagccuuguaugccuggcuucuuuuacuuagcauguuuucaagguuuauccauguugucguaucaccaguauuuuaguccuuuuuauugacaauuaacauuucaucaauauacugcaguugcuuauucauucauaaguugauggauauuuagguuauuuccacugauuggcuauuuugaauaaugcugcuaugaacauuuguguacagguuuuugugugggcauguuuucucuuggauuugucucugggaguagaaucacugggucuaugguaacuuuuugagcaacagccagacuguuuuccaaagcggcugcaucauuuuacauucccacaauagcguacgagaauuccaauuucucuacaugaucucuggcauuuccuguccaucuuuuuuauucuccgcauccuaaugggugugaggccgcaucucccguuuuugauuugcauuuuccugauggcugaugauguugaacaucuuuucaaucaaaaccuguauaguuuuuguaguggauccaccuucacauggcuugucauagccuuaauggccuuccagggaaaugggaugagcaaggcaguggucaugcaggaggaguuggccuauguggauuagcugaaauggagaaagaauaaagacaggccaggcaugguggcucacacauguaaucccagcaguuugggaggccaaggcaggaggauugcuugagcucagguguuggacaccagccugggcaacauagcaagacuuuuuuuccacugaaaaucaaaaaaauuagcugagugugguggugcgugccuguagucccagcuacucaggagguugaggugggaggauugcuugagucugggacuucaaggcugcaaugagauaaaaucaugccacuguaucccaccugggugaccaaaugagacccugucucuaagaaaacaaaacaaagggcugggugcgguggcucaugccuguaaucccagcacuuugggaggcugaggugggcggaucaccugagguugggaguuccagaccagccugacuaacauggagaaaccccaucucuacuaaaaaugcaaaauuagccuggcgugguggcacaugccuguaaccccagcuacucaggaggcugaggcaggagaaucgcuugaacccaggagguggagguugccgugagccgagaucgcaccauuguacuccagccugggcaacgagagcgaaacucugucaaaaaaaaaaaccaaaaaacaaaaaacaaacacaccacaaaguaccauuuuagcaaauuucaaguauacaauaccguuauuauuaacuauagucaccguguuguaccuuggaaauccagaucuucuuuaucuuggguaacugaaaccuuguacccuuugaccaauugcuccucauuuuccccuaccccgcaaggcagccgccauucuacucucugcuucugugaguuguacucuuagauuccacauagaaaggagauuaugcauuauuugucuuucugaaucugcuuauuucgcuuagccuacuguucugcacaucugcccauguugucguaagugguaggauuuucuucuuuuucaaggcugaaugguauuccauuguguuuauagguaccacauuuucuuuaucuguucauccaucaacagacauuuggguuguucgguaucuuggcucucgugaauagcacugcaguggucauggauugcagauguaucuuugauauacugauuucauuuucucucucuuucuuucuuucuuuccuuucuuucuuuucuuucauuuuuugagacggagucucacucugucacccaggcuggagugcaguggcaccguguuggcucacugcaaccucuaucucuuggguucaagcaguucuccugccucagccucuggaguagcugggauuauaggcacccaccaccaugccuggcuaauuuuuuuuuuuuuuaaguagagacgggguuucaccauguuggccaggcuggucucgaacuccugaccucaggugauccaccuuccucggccucccaaaggcugggauuacaggcaugagccacugugcccggaccucggaccccaauuucauuuucuuuagauauauacccagaagugggauugcuggaucauguacagauugagcagcccuaauucucagccaguaagaauauugcaaauauuuaaaaaucugaaaaaaauccagaauccaaacauugcuggucccaagcacuucagaaaagggauaauuaaccuuuuugagaaaguaguucuauuuuuaacuuuuugagaaaccucuauacuguuguuuugcaucagggcuguaccaauuuacauuccuaagaacaguguacaaagguuuccuuuucuccacaccaucacuaacacuaucuuugucuuuuuguuacccaccauuucagcagguuugaggugacauuucuuucuuucuuucuuuuuuuuuggagauggaguuuugcucuuguugcccaggcuggagugcaauggcgcgaucuccgcuuacugcaaccucugccucccagguucaagcaauucuccugccucaaccuccugaguagcugggauugcaggcaugcgccaccacaccuggcuaauuuuguauuuuuaguagacacuggguuucuccauguugguugggcuggucucaaacucccaaacucaggugauccguccaccucggccucccaaagugcugggauuacaggcgugagccacugcgcccagccugaggugauauuucauuguggcucugauuugcguuuccuucaugauuaaugauauugagcauuuuuuuguauaucuguuggccauuugugugucuucuuugagaaaugucuguucaggagguccuuugcccauuuuuaaauuaggauacuuauuuuuuaauuuuuguacuauugaguuuuuuggauguuaacucuuauuugagguaugguuugcaaauauuuucucccauuccuuagguugcccaugcaucauuuucugugugcuccugcauugagauggggccuuuaguggauuguuauuuuaguuuuuguuauugucuucaaguggcuggagaauucuuggccccauaagcaguuucuuccuguugaucacccuugccccucuuuacgugagaggccauucacauaaugggagguuuugcgauaacuccugcaguaguguccuugauguuuucugcugccagacagcucuuuugcacguguuuacguagcauaccaguuuucuucuuuauuuuuauuuauuuauuuauuuauuuugcugucucccaagauaggaauugaguguuuuaaagaacagggaaauagcagaaaucaaggaagagugauuuggagagaacugucaacaaaugcucuuuuucacguuuuuguccccuuaaaagaaaguguuuaaauaccgggugcuauaaaugccacuuacugucacucuuagcaucagaggugccacuuaggggcaugguuuuaguuuggguuggguuaagucugugauuuuuaugacauaguuuuucuugggguuacaaagcgggugaaguuucagaaauuaaaguugauuccaugguuggugguaaggagcuuaguuuccggucaggagaaggugggcauuggccuguguuuucauacuggguguccuucccaguuguuagaggcuacaacaacauggugauaagccaugugcugugacuguguguagaaacuauaccauuacaguaacacucugaauguaaacagcaaagucaguuucauuauaguaauauaauugacccaagcugcacuaaguaaaaugugaauuaaaauucucaaugcguggcuguuguuugacauggaugagaucgcuuuauuccuuguggguuuucaguaucauuaacucaggguuuggcauuuguuuuauuugucucacucucagccuauucaaaugauuuugguuagagcaagugcacugaucucuuuauccccaaaucugaauguuugucauucccuuuagggccccagaacaccaguauguaaaauuucccaguguaguccuuucucaaauugcuuuguaaaauacaaggauuuuuuuuuuuuuuuaauuuuugaaauuguuaguggaaucagcuuaagaaagcagauguucauuuuuuuguguugugacaggguacucagauggcgaugaaaggacagugaaugugauugaauguugaauaguauuuuuauuuuuuaaacaagaauuuggcaagucuuuuagcauacaagaacaugaauucuaauuaauggcacagaauaucagcuuaggucuaaauucaaguuagugaaccuuagcacuguugacauuuugggcaggauaauucucuguggugagggcuguccugugcauuguaggauguucacagcauccuuggccuucacccauuagaugcaccaguagcauucuuuucccucccccgcagugaccuccacacauggccauaugucccugaagcagggaggggaggggugucaaaauugguucugcuugagaaccaguggucuagaaucauagccugagaaaccagcuauauugcuagaaacugucauugcuuaucaaaaaugcuuuuucucagcugggcgcggugguucaugccuguuguaaucccagcacuuugggaggccgaggugggcugaucauucgaagccaggaguucgagacuagccuggccaacauggcaaaaccccaucucuacuaaaaauacaaaaauuagcugggugugguggugcucaccuguaaucccagcuacuguggaggcugaggcacaaagaauagcuugaacccgggagguggagguugcagugagccgagauugcaccacugcacuccagccugggcgacagagcgagacugucucaaaaaaaaaaaaaacaaaaaaaaaaaacaacuuuuacuaaucacuuuacaaacuuuugcauguguguucuauguuguauaaaucuacaagcauuuugacuuuuaagcaaauuuccuaauuacuguaaacuaaugccuagauagaagaauaaauuuccucauccuuccugucauguugaaaaaaacaucuugcaguuuuccaaaugacgggcagguuuugguuagagaguacagaugcaggccagcuaugguagcuuacgcuuguaaucuagcacuuuggaaggccgaggcaggaggauugcuugaagccaggaguucuagaccagccugggcaacauggugagaccccaucuguguaaaaaaaauuagccaagcuguggccaggcacaguggcccacaccuguaaucccagcacuuugggaggcugaggcaggaggauugcuugaaaacaggaguuccagaccagccugggcaacauggugagaccccaucucuauaaaaaaaaauuagccaaguguaguggugcacaccuguagucccagcuaaguauguacuuaggagccugaggugagaggauugcuugagcccaggcauuugagcugcagugagccaugauugcacugcugcacuccagccuggguaacagagugagacuuugcuucaaaaaaaaugcauguaucggcuggugugguggcgcacgcuuguaaucucagcacuuugggaggccggagugggaggaucacuugaggucaggaguugcagaccagccuggccaaugugguaaaaccucaucucuacuaaaaauacaaaaauuagcugggcgugguggugugcaccuggaaucccagguauuuggguggcugaggcaggagaaucgcuugaacccagaaggaggagauuguagugagccaagauugcgccacuguauuccagccugggcaacagugaagacucugucucaaaaaaagaaaagugugcauaaauucuccugauuggcagagcuauuggguuuuggcuauauaguaguaucaguaucacuuuuuccuaaaauauauucaaguagcauccauacuuuuuccuuuguugaaggugauaaguacaagauugucucagguaagccuuguugagaaaaaaugggcuuccaaagacagaugggacagaggagcgcuguccuuuuggagauagcuguuuuacucuucuagauuuggacccucuacucauuuaaauaaauauguuaucuuagaaaugacacuuuguguuuauaauguuaagcaucuacuucugagaaaagccagagccagcacuguuaggcuugauucuucuugacgugcuucuuuggaagagagcugggggcaagggauaguguccuuuugcagauguaggacaggcauugagaaggggggacaggagaugguacucaugcagucuaagcguaaacucccccgucacugccauuaggccuguuggugaggguggauuugucucuguguauguaguaucagguguucucaagagcaucugguuagcugagcagugggggaaaugcgaagucucaguagagaauggcuuugcccuuuuccuuucuuauucuggagaacaugauugagcugcugggguuacaggagaaaucuuguccuaggaaacaaaagguuuguagcccucauucuggcucugagcccuguagcaagccucuuggcuuugagccaguaucgucugugaaauggguagguaucaugauaccuacccucccugacucagauguguuccaagcuugugccagacgauggacacuuagauauuaucuaggagcacugcccugcagaaacaagaagucgaauaugagguggaauggccacauuuccuagaaucacgacaucuucagcaguugugauccauuugauuguuacuuaguacuccuuucaauuugauaggauuuugcuuaaaaaaaaaaaaaaaaaagaaacuuucauuguagccaagcaauggauggaagaacccaguuaccucuaauaacagacagugagcuguuuguucaggggaccuagaaggucagauuaggguagagguggaaguuacccauggccaguuaggcuguugaauguugcuguugauagauauuagucaaacuguuggguuuaaccacaaaaguuuacuucacagcuguggcaaagccccauuauguaagccaucaccucuucacaguaagauaucagaaucuacuacccaguucaucuuuuuucuuuuggagacugagucucacucuugucacccaggcuggagugcaguggcacgaucucagcucacuacagccucugcuuuccaaguucaagcgauucucccaccucagccuuucaaguagcugggauuacaggcaugcaccaccacgcccggcuaauuuguauauuuuuaguagagacaggguuucacuauguuggucaggcuggucucaaacuccugaccucaaguguuacacccgccucagccucccaaagugcugggauuacaggcaugacccaccuuccccaguucaucuuucugaaagcuagcuuggauuuaugggaggggaaaucuuuuuuuuucuuuuuucuuuuuuuuuuuuuugagacggagucucccucugucguccaggcuggaguacaguggcgugaucucagcugacugcaaccucugccacucggguucaaaugauucuccugccucagccuccccaguaguugggauuacaggcauccgccaccacaccuggcuuauuguuguauuuuuaguagagacgggguuucaccaucuuggccaggcuggucuugaacuccugaccucgugauccacuugccuugggcccccaaaguguugggauuaugggggugagccacugugccuggccggaaaucuuuacuuuguuaguaucuaaauauuaccggaguauguuuggucugacauaagaaucccaccucugaagucaucuucuggugacuccauucuagauuuuuaggggagugggggaagcagggagaggggugagaggguggcauccuccacccuguaguuagauuccuuccccucugcuuagccucucucaucuucuuuuaauuagugccgugcuuaauuacccgcugcacuugcuuguguaugcaucauugcauuccccccaccccccacccagaagccugacacagcucuuacucuccaaguaaugauaguaauugcugguagggcaguccuguuccucauccuucuccaagcacauuucuuauggcaggugucuaguuccuaauuaagugcuaaugagcaugccuaguggaccgugaugccacugcaagcuucuucaguuuuaugucucacuauugccaagcucuuaaaaggugacagagcaagaauuagugucuuugggaugacaggaaggugauuuuaugcauaaagaaauuguuauuaugaucucaaauggugaaugaguaguuuauacuuuccaagaaugcuaugaaugcugccuguucugaccucauccccuuuuccauuuugcuucuaauuagaaccaugcucucuuugaaaagaaugaaaguuuauaaagaugguuggcuggcucuuagacauuuuuauuuauuuauuuuuaaauagagauggaaucucccuauguugcccaggcuggucucaaacucuugggcugcagugaucuuccugccuuggccuccaaaguguugggauuauaggauuauagugagccacugugccugacccuaaacauuuuuagaaaaguuggagugcuugaaaauucauuguaaaauuuccacagacacugauuucugccuuaagaugguguuuucucuaacuuuugaggcugggaacuguguuugggauuccauuaaaaaucagugggcuggguagaaaugacugaagaucuggcaugaagauuuaauauguucagugcacgcaaagggauaauaaauaaaaugaguaauugagucccaaggaagugagcacaaaucagaaucuggagaauuuucuaacauugcaccuuagaaauugagccuuaaucauuuuuacugucucaucaaaaauaaguuuuauauuggacagcugaaauguggccagauucaugguacaggggccauuucuuggauacuuuuucauuucauacaaugugcuuuuaaauauaauguauaagagcaaugauacuguguaaugagaacagacuuagaacuucuggaauggguuaagcaaugggggcaaagugcagucauggaaaaggcauuugggaacgggggcuuggcucgcuggcuggagucccacacauaagugcuuuccucauccacgguccuacccauucuaggucucaguauuuucaucagucacaaugaaagaguggguuugaguuguggagcuugguaggaaggaaaggauaaacaaaguuucguuucuaauguuucuuccagcggccacaagccuggcucccugagauccucuccccugucuguggcagcaugguaaacagcagccuuaagaguugcuccuguacugacugcaguccccucuugccuagggauagaguuucagcaauuuagucagugccuuugagccuucauuccuucugggaaaugggaauugcaauacuuccucacaguacugagagggauugauggaauaagggggcauaagugccuggguggugcaugagacacccacccagauuacugggucuuccuuuccaaauucuauuccuuagugauaguauuuugguuuugucucaucauacuacugugguaagucaaugcaaggguguagggugaaauggaguuaccuggugacagguugagaguauggcuacuauauugugggaugcauccccacccccauuuuaaucccucugaaaacagcgugagucugaaaaucuguggcaucuuagauugagugacaugcuggaucucaucccuggaggcgcauaaagacagaacuagcucauguuuacuuacugauguagccagccuugcuuaauaauaaacagcuccccucucggagugagugauaccagaaagugacaguguagaugugaggauuauauuuugggaaggugggagagguaauugagcaggugaaagcuuuugaugaacugaaagcacuaaucgcauuuuuuccccuuuccucccucucuuucuuggcuccuuuuguguguuuguugaaccuccuguucuguuuccgccuuccccuccugucaugucuguuuuccccuggaugccgccuccaucgccaucacugucaccacuaccuccuccuccuccuccuuuuucucucucaccaccaccaccaacagcagcagcaguugcaagcucagcaucuuucucauggccacggacccccaguuccccuuacgccucacccuucgggacuucagccuccuggaaucccgccccucgggggcagugccggccuucuugcgcugucuagugcucugagugggcagucucacuuggcaauaaaagaugacaagaagcaccacgaugcagagcaccacagaggugagaggccgggcaagccagauuaggacuuuguccucauacucuuacagugcugcaaaguugugugcaucgcuaaagagagccccaaccuauacagagagcaaacaaugagauaagaggaacugucgcaaagcuuuccacugaaacacaggucacccuggaaguuugcaggguuugcugugggcaucuguagauuucucgaucucguuagauugcaggcaucuugacaucuuggcaacugccuaguuaaugccaguggccuguaccauauuauggaaaacuguuaacugcuuaauuggguaauuuucaaagaaaguaauguuguuaaauggggcgaaauaagaaguuaaauuugaaagugaauguguucaaaugaaagguuugauaauugcaucuguuacuacuuaguuucauaggcuuuaauucuaguaugcauuaaauauugggcaaaauugcacuugacuaauuuuuugaagaaaaguaauuuauucugucaagaaauaaaaaaauaggcuuuguguaugguuaaacuguaaaucuuauguuuacaaaauacuguaauuuucaggaaaucacuguauuaggaaugugcaaugacuuauauaaauaaaagccauuuuuaaaacuguuuggggcuuguguucuaauuauuccccccuuuuuuuuauuucuguucuugccucugugucugaacgggcaugucugugcguuucuugguaaccucgggagcagacagagagccgggcacaguaaguacucaaacgccugcugcacacacacacacacacacacacacacacacacacacgguccccuucugacaacacuucuccacacaggcacagacagacaugcacacucucccugucucucucagugaccuggcuuuuuucuuuuacuuuuuuuccuuuaaaauuucuuuuucuuauaugacuguucgcucugcucuugucuuuuuacaaaacuugcaucagacaagagaggcauaauuuggaggcaaaacuauuugcugugauuacuuacuuggaaauacacuuugaucuguauauuccccugccucacuuuaaaaguguuaaugguugcauucuaagucugguugacuguaguuuaaaagaauauucauuuuuauaucuuaaaucaguuuuagaggcaagagaucacaaucccuuugugaaguugguuaguaauguaccauuucuacuuaaaccagucauccucugugaaugcaucuugguugcuagguuuccauaucuuguuuucuuugcauaauuguccuuggaaugugaacuugaucuuauaucuauuuuagacauaagaacugagcauaccaguaagcucuuaaaaagaaggaaauucaguggacagggcugugugcguagaguucauguuuucaccagccuaagucacacucauuuuucauguguacauuugaucuguacaugcaucugccaguuagcucuggagagaccuguacuuaaagugugucucaaauguuguguagcaaauagagagaauucagccccuuuucagcugggauaaccuacagguuuugccuccuucuuucugaacauagcaguauuuugacuguguuuaauaugguaaaaaaaaaaaaaaaaaaaaagggauacugaacauuuaaaucugauaacuuuuuugguauaaguuuuggggggaagauaaaaguucaggguuuuuuccccccucuucuguguagaauaguagcuacuuuuaaaauugucuuugagacagaucuugguauauuucauguaucuggaugugcguggaggagugaggaaugguugaaggaaaggguagcuaguuuuaaaauucuuguccuauaaauuucucuggaaaauguugagaggggauuggggggacaaaaaauuauagcugggaaauaaaauauucuacacacagaguacagauaaguaaacuggcuuuaguuuauggaggaagccuuauuguuuugccauuccaggguuccuauagauagucuuuuuuuuuuugagauggagucuucgcucugucacccaggcuggggugcaguagcacuaucucggcucacugcaaccuccgccuccuggguucaagcgauuuuucugccucagcugggauuacaggccugugccaccacaccuggcuaauuuuguauuuuuaguacagacgggguuucuccauguuggucaggcuggucuggaacucccaaccucaggugauccgccugccucagccucccaacgugcugggauugcaggccugagccaccaugcccggugagauagucaucuuuuaugucuguucaguagagugucaaauuuaaaaaccuaacccuggaugaaaucacagaagaaauuuggggaaagcccaugcccuuuaggcuguuaugcguuuuaaaucuauugaacuuauucuagcuuugggacuucaauuuaacauguuuucuucaguacuccuguuucaccuuaaauggcuauguucauugagugcauaccauauauguaaggcauuaugggacacgcaucugcaauucgagguauguaagcaugcaacaaagcccuuucccagagaaucgaggaggagugagugacacaauuacuaaaagaagcaagacuggagaaaguuucagcaaaaguccuauaacuuacugguaucagaauuguggaagugauaccacgugguaugugccucucugaaaugccaggggugugaauaggcagagguuuguaugcuuaagcuaguagagauguauuuuauaccucugugucuuucugaauuuccgaaugugucggauaaccuccuguugguauuuuugacagaaaaauauaugcaaguacuuaauucauggguucauuggaguggguggagggaggguuauugguuguccccuucaagaaguaugaagcaguucuugaguuacaggcaacuguggguuauuuguaagucuauaaguuaggguuagcagucaacgaacuuucuaguucaaauguggauuuauguguuuuggacauguaucuuuuuuauaucaaauuuuugacaaguucuaaucauuucaaugaauauuuucagaacaaguauauaugcuguguuuccugccuaauuacugcagaaaacuguugggcaaugaugauuaaaaugggaaaacuacacuaauuguaaccuaagcauuuaauucaguccauagagaggaauuaaacuguucacuguccacauuagugggauuuugcuacaguuacauaaaauuaaguagcucuucaaacuuuguauaaaaaugaguaugaaaagcaguggauaaugagaugauguguacuauuagugccuaaaauauuauaguacuuaucuauuuaauaaagugguuugaauuagaaagucuaauuuuacuuggcagauuaagucagccaauugcuguuugcugcuguuuuuuaauccagugaaagguuaagggugguugcuacaggccagugauuuucaaagccuuauggccucaugaucuugauacccuugaaaucaaauuauugagggcccugaagaacuuuuuguuuaucuggguuauauuuugauauuuacuagguuaauauuuugauuuuugauacuuacuggguaagaaagaaaauuaaaucacuuaaacagaugaagagcuacuuaauuuaaauuguguuaauacaaauaacauuauuaaugaaaaauaacuuuuccaaagcaaaaaaaauuauagugggaagaguggcauuguuauguaugucuacaaaugucuugaaugccuuguaguuuauugaguuuuaaagaggauagcuggauucucauccucugcauucgcucuuuugugguauuuaguugacguuuaggaagagaaucugcccucauagauuugcgagggucuccgggacccuuaagggauccucggaccaaagucugagaaccuuuggccauaaauaagacgaacuccuuacuguuuuuuuuuuucuucuuguuugucuuucuauauugaacauauuauuuauaccaagugcagaaaucagagacugaugggauccgcagggaauguggguguguauggauuuuuaucugugagccuaaaacugguugguagguaguuuguuuauuuuuaguggcagaaauuaauuugcuaguuaaagauuuuaugguaggaaaacaaaugagccuuaaauaagcaaucuguuuuaaugugaagccuaggaaauagaaguguaaucagugcacugcauaacaacacuuccaucaacaguggauugcauauaugauggugguccccuaaguguauaacaccguauuuuuacuguaccuuuucuauguuuagguguguuuagauacacaaauacuuacauuguguuguagcugccuguaauauucaggacaguaacauguacagguuuguagccuaggagcaguagccuagguguguaguaggcuauaccacccagguuuguguaaacacacuauucgauauuugcacaaugaugaaauugccugacauggcuuucuuacaaaguaucccuguuguuuagugacacauggcuguucuaagagugaaaguuuuuauggaaacugcuuuaaaguuucuuauuucugaaagggaugaacaauaaagcuagcaacuuuauagagguuuggcuuugguuuaaaaaauuauuuuggcuguuuuaaaauuuugauuucuguuuuuucuuauauaagugcagcucuugagcagagaaauaugaaaugaccuaagaaaggccauuauuucuuaguagcauucaguaguaauaaaaaaauaacuuuagauauuuuaauuaauuuaaggauaaauugcauuaaauuuuggcugaagggaaugcuauuuuuaucugcuugaaagagauaauugacaaaaaguuguaugguuuaaaaaaauuuauaauagggcaugcuuuuaaauacuuugagucauuugacaaauauuuguugagcccugacuaugugcccgaguacuguuugaggugcugcguauacuugcuaucauuuugcagugauccauuuuaugucacaguuaaacauuuguugaauguaaggcacugaaauaccuagcuagugugaucacuauuuggaaaagggaggagacucuggaggagacuccagagcagacgguguauagaccuacgcaguggcauucauggauggacuggguggguccgugcucuuuugcagaauucuggggagagacuauaacucaucaaauucucagaaagggcuuccuaacucagaacagucuaagcaccacucaucugucuuucaggucauauggcacagcaccaugguuuuaucaaggaggcugggugcauccggucacauacuuaguuaacagauugagaguuaguaaucugagcgaccauguugucacucuguaauugacuucuaaaaucaccaggaguuuguauuuagaacuugccuagagauaauuaugacaaacaucaccuuguuuuauauaaagugguuucuuucuuuuguuacucuucucuagcuguucuugacuaguuaauuuugucagaggcaggaccaaauccuaguuaggaccacccauccaucacuuugucucaaaaugacaacauuauagaaggcaaggaggaguuaagaugugaggcuugcuuuggaaaagaauacuguuggucuuuuucuggaaaaaaaaagaaaaaucacguucauucccggaggccuaugggaaccauggcggcaucaggggugguagaaugaacaugaguuuuguacaaaggcagacuuuaguggaauucuggcuacacaggcaaggcuuuuucauccuuuugugccuuccuagucccaucuauaaauggugauaguagugguugccucacagggaggggguuaggaggccucaggugggaggguagcagacagcauagaaggugcuuagggaaugcccuccucccaccgccauuugcagaguagcaagacggcagugaaugcaucauucauuacauucaaugcaguuacuucuggguuucucuccuauuuguuuuuuaaauuaaaacaauuuucuuuuaauuuuuguacagucagagucucaguauguugccuaggcuggugucgaauuccuggcuucaagugauucucccaccuuggucucccaaagugcugagauuacaggcgugagccaccgcacccagccuugguuuucucucccuuuuuaaaauacacauuacacaggcgguuauggaaauaaggguccacgugccaagguggcaguuacugaugguucucagcaugucagcaccgugaaacugaucucagcugcuuauuaacgugaucacuuuccugauaaucaaauuucucaaaaguagacacagccuaggagguacuguuuuugccuaaauauuuaugaauuaaucaugaccugacauguuaagagauugccuggaaauaaaggcuaaaacugagaugagucaccuaaaauuucaauuuuugggcacaauggaaaacacuuagguuuucuuaagcagacuccugggcagguuucccuucuggccaaguuuaaaacucugcuuaaaaaaaugguucuucuuugagaaaguuggcaucacugcugugaauagggugaacccuucaaaggaaagccccagugguuucuagauugucaggagccuguaccagguagaggugucuguuuacuguggaugcaauaagucagguggauaucggggccuuggugggacuggauuaacguucagguuuuauugcacugugauuacagugaaaauagggcaucuuuacucuuaaaaaaaaaaaagugagagaacaauuuuucccuccaaaaccucuuuuugacuugaguuugugcucuguaauuagaaaaccugcaauugugagcagguuuuuuucuuuugucccuauaaucuuuuuaucauuuccucacugggacauagguggacaacaaacucuguguccucaucuuugagauaaggagguauaaauguaagugcuguccgauacacagaugacuuagucaaguccugaccuaauggcuuuuuaguuucagggccauuucuugcauuagcaaguauuucaacaggggcuggagagcaaagaggcacagaaacagcugagcagcucuuagaaaccaugcuuucaaaaaagcuuugacauagagauuuuguuuuugcugugauuagguccugagcuggggaacggcagugucaugagguuauuuaaaaauuaauuuuaaauaauuguauuuauugucugcuccagaguuuguuuuguuuugccuggaggaggguagaagggccagcuacaaaugagaggguggugacgaaggcaucgugguuuuagcacccuguccugccucaacauuaaccggcccugugugucaccugcacagcuaucuuuccaugaguccuccuaacugagucacccaccuggauucuacagugaugaguugcaaaaucgaguugcaggaaugcacugguucuuucccauaguuugcauuuaaacugugugaaacaucaaugugugcccuucagacuggcugcacaggcaggguucugagauaugauaugguugccaguggacagauuuucaacuuuguccauguuguuaacaaguggggaucucauuaguuuuauggguuaaaaauacauuaguugaaguguuaggcagaguacgugaaugaccaguuggaccguagcaaaaagugcagcgcagggugauggcuugauugacaccagguguagauggagaaggcacacagaugugauggggugcgucguuaccuaauuguuuuaauguucaccgagaaguuaauugucaguguggagugugcuaguaaauuagguuccuacugccuuaguguaacugaggauaaaugaggugucacgaguuuccaaucuguaccucugacacaaacacuuuuccugcggggaggagaaaguucccaaggggaaucagcauggcagcuaaagaaauccauuugaauaaugugcuuuauuuuugcauuagggaaaccugucuugcuuuugcuguaugcaugaauggguuuuccuuuccauuuugcugcuggugguuucaggguucgaacuuguuggcagagaaguugcuuggaggucuuaggauucaugaaggccucuguaacuaguguuugauagcauugacagggcagcauuuuauuaaaguugcuuuuuuuuuuuuuuuuuuuuuuaguaguuucugagguuacuuuccagaacauguuaguagaugugaacaaccauuacuguuaaauugcuaaagaaaagucaaauucuuggaacaagacuauaaagacugguuguuauccuuauugaaguggcugggucuuugcuaccuuggucuugaauagguguuuggagcaugaaauagacacaucacuuguguugaauggucaggauaaaguaauacagagucccaaucuuaacauuuucuuuugacgccacugggugcucucugagguucagucaacccaccuacuuacauuguaaguucuuacaugaagguaugugguuucauaauuguguuggaauguuuaguuuuguuuuauuuuaaaagaauauauuggccucucgcauccaggaaauucaaacacuucgccaauuaucugguuaccuucaggccauugagcuaccacagggaaagauccugcuguguguuuaauaaaacaugguucccagaguuaggaaauugugcucagaauuugucucagaaugcacacaggcuguaauaucagaagaucugccauuccucuuuucuucugaccagcucuuuugcugucauagccauucuguucugucauccuauuagugcaaguuagauguaacccuuaggaagcauauauuaauaaauagcaauuugcuuguugccagugaagaugcccucuugagaucugguguucucacagaauuccagauuuucgugagagagagaguccagucccuucuuauggaguauaugguuucuguguucuugcaccucaucuaaucaucucaaguacuuucuauauaaaaguuaugccaguucugcccauuuuuggacccucuuuauguuucugauacugagcauucuaggaggaucuuuucuuuuagacuucucagauaugcuucucccuuuauguacaggguacuugacccuguacccacaaguguaugccauauguagguguagaaaauuauuugguuuuagaauuucaguuuguuuugaacaguguguuuucagcugauuugcccagguuuguaauguccuccgugggcuguauuacuccuauuuugaguuucuguaggagauguaaauaaggugauuuuguuuauuuguuuauuuuuuuaauuuuaaaugaaaacuuacauacagucuagaaaccucaguccuugggacacuuguaauagaagucugcccaacauuuaaagucuuuaaaaaaauccuggcagauauuuacauuuuaccagcugcaaggugaaauaaaacuuuggguuucuuggcuggaauuagaguacaucagucaggauaguaacacugguucucauguugaucaaaaagcugauucucgauuaaauauuuauuuggcaaauaaauauuugaaaaaugaauucuacuugaugaauccuguuugguagauuaaaaucuuucaaaguauagacucuaggaagaggugucugcaguggcaaauaggucuguaggaugauuaccucuggugauuggcaugccaugaagccuguguguaccugggcugcuuugucacucugcugaggccuuuuucaguguuaauuuuggguucugaguggaaaggcaggaauuugggacuauuccuaguucauuuuaaaguagaguuuaaaauguucauuuaaaaauuacacguuucuauuuuugguauggaagacaucuaaccugauuaaagcaaggcauucuguugguuaggagguaggucagagaaaccaugcgucagguauuaugucacauuagaauguuaagugcaguaguugaaagagccaggguggauuuuaaguaaguuuuuggguacaaguguuccauguauguaaacuugaguuuaaaaaucacucuucugagaggggaggcacuuuggcuguaaugggaaucagcaggugguggacagagccgcuuggccucaggcaaaucaccucugucucuggacauccuaguccuccagauuaaaggagcaggaggaggaagaggaacgaaaugucucagugguugcuuuggccucuucucagguuugauuccaguuauuuucuguguuuagaaagcaugaccauuuuuauuuuuuugauuuuuauuuuucauuuuauuauuuuuuugaggcagagucucacucugucacccaggcuggagugcaguggcacgaucucugcucauugcaaccuccgccucccagguucaagugauucuugugcugcagccuccugaguagcugggauuacaggugucuaccaccacccggcuaauuuuuuuuuuuuuuuuuuuuuuuuuaaguacagaugggguuucaccauguuggccaggcuggucucgaacuccuuuucacaggcgaucugccugccucggccucccuaagugcugggauuacaggcaugagccacugugcccggccucaugaccauuuucaaauagcuuaaugcaaagcaaccucuguuucauucuuuugcaaaugguguccucauaaauguugccucgauuuguuagaaugggacccagacaacauagcauucgaaauuuuggaggaucaaaaugacaauuuagucaauacccagguuuagucucugaauucucgaaauauguauaaaguagcucuuaauggccaucaaaaugacuguauucuacccuggagccauaagcaacacacaguagggagugcacgaggagaaaucacaacaugagggaaaaacaccucaagaaaugcaguacccacaaagucacuuuuggguuucugggaacaaaugagggaaucaugaagguaagggucccccaggcaguaguuuaaaaaccagaauguuugcuguugcugccagcgaagcucauuaggcuggaacuguuugcuuauaucaagaacaacaaugaaagcagcgucagggcuggaagaagucaggggcaauuauacacagaaaacuggguucaugggagcaagaguaaaaggaagcggucuguuuuuggugggguagacuuuagguggaaagccugccgggcguccggcagcugcgugggccagggaucccugggucugagugugguguuucugggccuuuccagcccacacucugcugccuuguuuugagucaguuuuacagcaucaaagguaugaugaggcaucuuguuuuguaacuuguugaagucugcuguugaauggggcccauuuucagauaagcaggggugcuaauuacuagcccuguccaccacauuuagaggaacuuucagagcuuuucaaaaccuauucagauuauaagcuucauuuaagccgcucaagcggaaauuacaguaguaacuuugaacacauagacgcagaggccucaaagcuugacagucuuaaagguccagccacggaaagguuauuguuucuaacagaaauuguauuguuucuaacagaaguguaguuuacuuuuacguucacaguaccauuugacaucauuaaacgacaacaacaaaaaaaaacaagacauuaagaagcugucuuggaauggcccuguggcuuggaugcgcagugcugaugacagcaggagggcuuggaaggcuguggagagagacuugaacuuaaaacuggucagcacacccagccucugugccccauuuugcugggcacuugggcggauuuaaaguugaauaagauacagcccugccguggaugcugcacagagucuggaggaggagaccucggggcugaaguaaacuaggagggguguauuuaaacacguuucccaugugugaacaagcagcugcugccccggcccagcuuuucagagggcguguuagcacuuugcaagaguuaggucuccugcagccuugucagcugggggucuggguuggagggguuagcuuuuagcggacauguaucuagguaauuaguucggggauccagccggcucaccuuucauccccaaacacugugguaaagacauuacuuagagcuucucuauauugaauugcguuggucccucccagcugcuuuuaucuaagccuccuggcauuuguguagcuugaacagucaugaauaaaagagcccagcuccucuagagucagucccugaggcgggccaagaggcuugggauugccuuccgguccucaguuuugauuuccuccugcauaugguugagcuggagacaacccucccauggugggguccaugguuuucaggggagcuuugagggcuggccaccuggcugauuaccucuggcugguuaggaaugaaacucagggcuuuuaaaaagauaccauaaaauauuugcuccuguuguauacuguugcauuagauguggucuaacuuaaagguaucccccagccccuucuauuuuaaauuguggcagagaaagguaacauaauugucuguuggcccuggacacuguccucuuagugcucaaacaucuuucagagauugggguuaucugggcuuugugaaaggagguuuuugcacagcucauucaacauuguucagggcaguaacacaucacugaacaaauugcccccuugcauaugcuaaucccacacuuaaaagaacucauuguaacauguucugaugcuuuagccugaggggagaugggaauugaagagaugucagaucaugucaugugaccccaaaauaucuaaaaugccuguuuucuuugggucaacaguuccuacucggcauaugcgaaugaaaguauccugugucauuuguggaaaagauuaguccuuguuccugcuuuugugugugggagcuggccuugcuauugaagauucacuggcugaaauuccccccuuagaucuuaaauuucagugcuauuggcgaggaacaccaagucuuauuuucaacaauaaauuaaaagaauucaaaagaguuccuucauuguugcuguggaaaaugugauuugccuuuuaggaaaccaugcuguuaaucccaccgcuuccuuugugccuuuuuagagugguacacauugacucuuacaguuaaagaauaugucuaauagaguaaucucaagauuugcucauaggccauucguauuccugaccaggaagucgcagugggaaagaauaaaaacacauccacauacaacacagcaagcuccuauuucucaaacaguaaauaggacagaagcacauuuccaaggaggccugaagaauccaccuagcuuuggaugguuugauugcaaagucagggucucccuuuuaaguguguaaaccuguagauauguuugccaucaaagucuuuagaugagaugaauuaaauggaaugaaaggcuguguagguaucaccuuucaaaaauaguucucacaucgagguuggguuucauguguacaaagaggcuugggaagaaaucuuugauuaauuuuuuugucuugcagaguaauucccuccuggucccagacagucuaagaggcacagauaaacgcagaaauggaccugaauuuuccaaugacaucaagaaaaggaagguggaugauaaggacuccagccacuauguaaguaauuaaaggacuugaaauaauauuuguuugcuuacugcucaccugaguauccaaguauauucuaagaucuuagugauaauuccauguccuuaaacauaauacuguaaagaggagagguucuuacauuguaggauaguauuucccuuuggggcuguaaauuaugcuucugccgggcucaguguuaagcuuuagacuuccugccuuuguuacucaaaagggaauaugaaaaugcagggcugacuuugugggcugugcgguugcucagggcccugcucuuguuaggagucccccgggccccccgccucccuugguguaaugcucugaucucaccaucuuugcguucucaauuuuugaauaaggucucugcauuuuucauuuuguccuggacucugugaauuuaguagccacuccugcuaaaauagaguaaaaauuauagugucacaaaagcuuuguggaugcuguucugauaauauaggcucaugguacuucucaaggcagagcucaaugucuuccauagugagcauucuagugaucuaaguucauggucaaaauggaagaaaccccagaggcaucuuguuuaaauucuguagaugagaucacucuacugguugauggagugagggcucuugucacagauccagcuaaaaccacauucaaaaggaaaccaaaccaagccagauggccauuggcucuguucucaggguuauaaacauugcagccgauguaugacuuggaguugccugugugucccugagugucuguuucaggauggaugcauucucaggaacaguaugaaaguaaaguugcugaaauggggcuacgucccugaugcccuugcaggaagagguaucuacugugcaggcuauguggaggucuaaacacuagacagaggauagugucuccugcuggcuggcccaagccuauagcugaugauagguaacaucuuuuugagugccaccuggaguuagugccagguaccuugugauuuuuucauggauuauuucauuuaacucuuauaacaucccagugauuugcuggagccagcuguaguaucucugcucuucgacacaaugcuaagaugugcaaacccaccuccaguauuggauuauuuuaccagagauccucaaauugguucacacuuugcacuaugcuuuaauaacauacuaagaaacaaagcuguugguucuccccacccuagcccaacacuuuuuagcacauaucauucuccccuugccuguugcccagagcugaugucccaugcauguacuuucauuguguacuuucaguguuaauaagcaaguuggaagguuuaugacaugcagagauuugcugauguagaauucugaauugcccuucaugaggcuguuguguauaguaaguuauuuaguaaugagugcucuagaauccauaaagcuugccgugguaguuuuguaaccugcauguacuagguuugucugguuggauagaugguuagggaccauguguggagaguauguuggagaaucuggaacagaggccucagaccuuagaucacugaugacagacauguacuguccugugaagguuuauauuugcagaaggguccgguacaaagcuaagauuuaaauuacgguaaacucacuucagaguuccauuguaacaaaggaauaguuugcuacuuuuugcuaguuccuuauguguacuaaauuagccauuuucauaauuuucuuuuuagaagagaaacucuuuuaguuuauauuuuuucaccaccaccacccuuaauaccuggaaacauuugugcuuugcugugggcuuuaccaagagaaaacagauuuucguuaguauuaguuuuguucuuuauugcaugaaaauauuuauuucaguagacuguuauuuaggauuacccaggcuuccucauugguuguaauuugaaguuguuacuagugaauugcauggugacccuguaaccauggcuaaaauauaucuuguaacacgcuauugaagaaaauaaauugggucucucacguguagugcucuggguaugauuaggaaauaaaucauuuaagaccugaauuuagaguugaggguaaacuuucuagacuagauuugugggccuacuucagaaggccaauguggauaauauuugcacuuguuuguacuaauauuuuucagauauuauuucuauauucuucacugacaacagcaucaguaagagaauuguuuagaucauaaauucaggaccucuuccuuuccaagaauucaaaaccauugagauguccugcuuuuuccauaugccuacauuguauaauguauuacucugcccuaaaggacaugagacguuuuggcuaagaagguagacuuuuucagccugccucaaacuugauguagggaugaucgcaucauugaauuuuuuguuguuguuguuguuuugagacggagucuugcuuuugucacucaggcuggagugcaauggcacaaucucggcucacugcaaccuccaccucccagguucaagcgauucuccugccucagccuccggaguagcugggauuaacagaugcacgccacuaaacccagcuaauuuuuguauuuuuaguagagacgggguuucaccauguuguccaggcuggucucgagcuccugaccucgugauccaccugccucggccucccaaagugcugggauuauaggcuugagccaccgcgcccagcccacaucauuaaauugaacaggcuuuauuuuauuuauuuuuuugugacagagucuugcuaugucggcuaggccagagugcaguggcacgaucucagcucacugcaaccugcaccugcuggguucaaacgauccuugugccucagcugccugaauagcugugacugcaggcaugcgccaccacgcccggcuaauuuuuguauuuuuaguagagacaggguuucaccacguuggccaggcuggucuugaacuccuggccucaagcgauccaccugcccgccucggccucccaaagugcugggauuacaggcgugagccacugugcccggcugaacagcuuuuccgaaucuuuuccaaacccagugcuaccuuggaguuuccucugauuaguaaauaugauagcuuuaugaggggacaaugagagcccuauugcagaaugccauugcccuucaaauauugccaucuauuaucuuuccaaaaauacuucaagcugauugcuaaaaagguuuauuuuuaauuuacuuuuuuguuacuuaagagaaaaagauuggguuuuguuugcuuauucgauccaccagcuagcuuuccaggauucuuuuuuuuuuuuuuuuuugcauuaacuaguaaucccaugggaaaaugguuucccuugaaaucauauggaaaaacucugauauaagggugugcagaucucaaauuaaagauuucaucccucgagaaauucagcuguugcaaccauuuacugagcucuuacaaucugccaaguauuugcaacuugccaucaccuguaaacaaguugugauuggauaguugguuugcuacugcuacagaauuccugccugaagcuuugccuagccccaggucagaugagaagagggggaagaugauaauaauuacuaggacuggcaaacugauagagagccugcaggccugucccagguaguuuuuuuagucugucugcuaccaggaacuauagaaagaaaucuaacugugccucaaaccuauucuuagcuuuuaguaaauggcguuaauguuucuuuuuuccaggacagugauggugacaaaagcgaugacaacuuaguuguggaugugucuaaugagguaaccauucuuuucaucaaaguuugucuucagaaugauuugaauaauguuaugaaaaaaaacuaacagugaaugaaggaaguagagccccucgguggggggaccucuugcaacuucuuacauuaagaaguuaaugguugcucauguauggagcaauaauggucuaacugacauaaaguuuuauuuccuuuaaaaaaagauauuucucuagacauuuugaaugccuaaguuggauguuuggcuccccuuuccuuccagugcccucuaggcaaaguucuuaagcaugaggcacaaagagggauaugacugcgggguuuuuuuuuuauggcauguuugcagguauguuugccgacaccauauugcucauuuauaacaugguguuggucaccuuguacaaccccaacccgaaggacuuucagcucuguccuuaaauuuagagaaugaguguggaaagggaaaagucugucuguuacaagcuaaaucacgaaaacuuuugauuaugcuuguugaggacccuucuucuccgcgagcaagcccugcccacucgccccgggaaaauggaaucgacaaaaaucgccugcuaaagaaggaugcuucuagcaguccagcuuccacggccuccucggcaaguuccacuucuuugaaauccaaagaaaugagcuugguagguaaagaaaacugacacuugccuguuuggcaguguauuuuucauuguggacuggaggacucugaaguauuggaaauguggggguuuugcugcuugaggguuguauuuuuaagaguuuaauagugaaacucauccuucuguucuuugucaccauucaggguuuacuuuuuccccucagucaucucuuuucggccaugauuagaggguguacacgcaucuguguucauugccuucuucuucuucuucuucuuuuuuuuuuuuuuuuugagacggagucucacuccaucauccaggcuagagugcaguggugcagucucagcucacugcagccucugccuccuggguucaagcgauucuccugccucugcccccugaguagcugggauuacaggcgcgcgcgaccaugcccagcuaauuuuuuuuuuuuuuuuuuuguauuuuuaguagagaugggguuuugccauguuugucaggcuggucuugaacuccugaccucuuugauccacccgccucagccucccaaaguguugggauuacaagcccagccucauugccgucuuacuugggggauauguucuugccacacagcucucugaaacuucccaguugacaaaugguucaaacuucugagauucuuuuuuuuuuuuucugagacggagucucacucuguugcccaggcuggagugcaguggcgugaucucggcacacugcaaccuccaccucccagguucaaacaauucuccugccucagccuccccaguagcugggauuacaggcacucaccaccacgccugguaccaccauacauuagagaggguguacacgcauccauguucauugccuucuucuucuucuucuuuuuuuuuuuuuuuuuuuuuuuuuuuuuuuuuuuuuuuugagauggagucucacucugucacccaggcuggagugcaguggugcaaucuuggcuuauuacaggguuucauguuggccaugcuggucuugaacuccugaccucaggcaaucugccugccuuggccucccaaagugcugggauuacaggugugagccaccgcaccuggccucaaacuuccgagauucuuaagucuucauuuucuuaggcuggucauuuaccugguagacugauccuuaauaucggggcaugucauagagcaugccccgauauuauggagcucgucagaucagugaugcacaaaggaggccccaggggaagccaggaacuggugcaucagaacccacucauguggucacucauucaaucaaacuuuguagacugcaucaucuuuuaacaauaacauuucauaacaacccuucaguuaauccuuaccuggucccgguaggcauuaucccauuuuaccgguugggagggaugaauaacuuaacaaggcuacacagccguggcucaugauccaaggucagaaagagcucucuuuagcccgugcucuuugccacgcuguagugguucuuggacuguguuguaaagcacaugaaagguugaaaggccagagaaggugcccuguaacccuguuacugucuggucuccgaaaggccccuugcugguguucagucucugaucugcacugguggguccacuuugguuauguaggcaagugggcagugacucuuaacuccaaaguguuguucuuuuuaggcauauugguaagguuagcccuggggcuuuugucucugagauacuggccccacucucucucaccauuugucucaaucccagggcuaccuaaaaaggagacuugaaaaggggucuucuggccuggcgcgguggcucaggccuguaaucccagcacuuugggaggccaaggcggguggaucacgaggucaggagaucgagaccauccuggcuaacauggugaaaccccgucuccacuaaaaauacaaaaaaauuagcugggcaugguggcgggcaccuguagucccagcuacucaggaggcagaggcaggagaauggcgugaacccgggaggcggagcuuguaguaggccgagauugcgccacugcacuccagcuugggugacagagugagacuccaucucaaaaaaaaaaaaaaaaaaagaaaagaaaaggggucuuccuuggacuuggcggccaggacauguguuucugagugccugggaaauauucucuggguggucaucuuucuaacuuggcguagacccaaaguccacaaggcugauggaaaauacuuuuaaaauaaaaucugcggaggaagaagugugaucauguucugugucucuagcucgaguuuuaauucuggcaggaagaggaaaggucaacauuucucgcucacaaguuaaugcugucaacauuguguggauuuaugaaaauuggcugagggaguagcuagaaggugcccagugucccagcugcuguugugauaaauuguguaauauggcuuggauuaaaaauaauacucauuuaauuuguuuaaugacaccagcaugaaaaagccagcacgccuguucugaaauccagcacaccaacgccucggagcgacaugccaacgccgggcaccagcgccacuccaggccuccguccaggucucggcaagccuccagccauagacccccucguuaaccaagcggguacagcaucgccucuuguugugcuuuguuugguuucucccauucccagcuugauuuguugucuguuaauguugugacgcaauugcccuacaaauaugaaauguacguagggccacccuccuuccuaucucugaaaaagccaugauaagaaacagauguuuguccugggguuucagcagcugcacucuguucagucuccaacuguuuacauucagcuuuucuuuuuuucuugagacgaagucucgcucuuguccccccaggcuggaaugcaauggcgugaucucagcucacugcaaccucugccuccugggcuuugagacgaaagucuugcucuugucccccccaggcuggaaugcaauggcgggaucucagcucacugcaaccucugccuccuggguucaagcgauucucuugccugagccuccuaaagagcugggauuacaggcgccugccaccacgccuggcuaauuuuuguauuuuuaguagagacgggguuucaccauguuggccaggcuggucucaaacuccugaccucaggugaucugcccaucucggccucccaaagugcugggauuacaggcgugagcuaccuugcccagccuucuuuuaguuuuaaauaauucaaauccuagggacuucaguaaaguuucugauaauuauuuugaacacaagccuccccaccuaacuagcauugugcgucugacuuugcuaauacuggcugaaacagcgguuuggcuggcccaaccgugcuccuugcagacuauaguuugcugguuuucugcuaggggaggcuucaggaaucaguggucucuccugcaguagaaauuaggaggguuucucugcgacuccagcccuuaaaaaacucauaauuugcaaccugauauuccccagugggaaaggaaaaaagcaacaaccugggcccaaaggaaaauaggcaacagaauauuccuccuaaacccgugcuuugguuuacguaaauccaggauuggauuuucauuuggaauugguaccagggaauggaaaguucggacugaaagagaaaucuuggauuuuaucgagaaaaucuucuuuugagauuaagucagguaaacacuuggugccugugccuugguuugcccucuguaaauuggguagggaauacucuuaauuccccuggcuuccuggugcugccauuuacacaaaugagaaaauguguggguugugcuuccccuggagucuuuucuuuccuggagaugcauucgcucuggggaaggagggauccaguguauaaauuggaggugauuuucccccuccccuagaagccuuaccucuuucucucuccccaugagugacacuaacaaaugaugaggccagacuugcuggucagguuugauggagugggucaguugaaugaugugcggcuuguguuuccuuucagcagcuggcuugaggacaccccuggcagugcccggcccauauccugcuccuuuugggauggucccccacgcuggcaugaacggcgagcugaccagcccaggcgcugccuacgccaguuuacacaacaugucgccccagaugagcgccgcagccgccgcggccgccgugguggccuacgggcgcucccccaugguaggccgcugucgggugggcugugguugggguaggaacgcugcaugcuccauugagcgcugucagguuuggggccaggccucucugcgcugcgugggcaggagcagccagccccacacaccucggagacaaagacgcccagucucccagccacacacucaccuuccucuugucagcuuucaucagcaugcugcuucauuaagugagggccaaacguuuuuuguuuuaguguuuuuguggaugaaaaaggcaguguuuagaagcuccuucagugguucaggggacaucugguuuucucccaccaaagucgauuuuuuuuauuugaaggcgaugaaaugauucgagugguucacagaagccuuuucauucauuuucuugaacuuuuuuuuucucauuaaaccuuaggaaaaaaugucugagaagccaucgcuuucucuuucuaugccuauguuacacuuuaaacccaauagcaugacuuauauauaagcaguggucucuguaaacagguagaauucuggacagacugaaccacgggggcaggcugucucucgucuguuugcccugccucuugccacugugcaaaugaucuaauuuuugaacaagaagaaacaaaacugcauuugaaggguagaauuggcucugugaucguugauugcauuaaggguauaaagucccaccgucauuucucuuggcuguuugaaaaauguccucuaccuuucucucuuguccccucuucacauagcauuaccuccacuaguuugcggugacauuaagauucauuuguuuuuccugauauugcacuuguaggagaggcugugcaguggcgggcaaaguguugaaaguaagguggucagcugagagacuacaugcuguccuuaacgcugcacaaaguagggaauccauguaugaauccuuaagcauuaaauuagacccauguaugcaacuggggaugauuuugucccuugaggacauuugauaauaucuggagacacuuuugauuaucauaacugggggugggagggggggcagguauggauuccucuuggcacauaaacaguaggggccaggaaugauauucagcauccugcaacgcccaggacggccccuaacaaagaaaagaacuguuuggccccaaaugucaauagugcugagguugagaaauccuaauacaacauacugcucugugaacuugcuugcaagucuaagggaaguauuuaccauggggaagugguucucagugcacaaauagaucacaucuccucucuaccucccaaaaaggaagugggucuuguggcguucaggggugcuuauauuaccucuugcauaguaauuaaaaagaaaaacacuaggccauguuacuguucccauuuauguugcuuuggggaucugugaguuucuaaugaacaguauugauguucacaaagugccugcugcaauaaacugagucugcaaugccuuauuuuuguuuccaggugggguuugauccucccccucacaugagaguaccuaccauuccuccaaaccuggcaggaaucccuggggggaaaccguaaguaccucaaagaccuugguuuuguuuuaaaggugguuacucagucauugguauuagcagacuagaauuccaaagggaguacaggcuugggcguuuccaaggagauuucuggugucuuuuccugaggaguguuaacacuuucuauaaauaggcagcuuguaggugucaugccucugucuucucccugggggugaucuccuuaguuauuucuggagagaaacuguuggagaugaggacgaggugggaggaaagagcuggagguggcuggcccucuucgccugaccccucagaaagcugcucugcucugcucugccauuuggcuagagggcagcugcuggagauucccaacagugcugugcugugggcagucagcugucacgaacucuugcaggcuuagacacuuuuuugaaaugugucaucucuuuacucagcucugugccaccuuuuucuuauuuugguggaaacaagaguuauuugaaggguagguuguguuggaugccagcaccccagguuuacccccaaguaaaguuuugaugagugcuccaagagaucuagaauuauaaaaagcaaaguggcuucguggggaagcaggaaaaguuaauguucauuuuguguccagugcacaaaagaauuggaauuuaaaaaaacucaauuggcuauucuuccugggucacuuuaaaaauugcuucauuuucauaauguuaguaauuagaagugugauuucaaagaauugcuaaaguucucaaauuuuuuaaacagcagaauugaaaugugaaggucuguuuugcuuagcagcaaaacucugccuucuccuaagauagaaaauagcagaggccaggcgcaguggcucacgccuauaauccuagcacuuugggaggcugaggcggguggaucaccugaggucggggguucgagaccagccuggccaauguggcgaaaccccgucucuacuaaaaauacaaaaauuagcugggcguggugguaugugccuguaaucccagcuacucgggaggcugagaccagagaaucgcuugaaccuggguggcggagguugcagugagugaagaucaugccacugcacuccagccugggugacagaaggagacucugucucaaaaaggaaaggaaaggaaaggagaggagaggaaaggggaggggagggggcaggucuuugcaaauguuguuuuuuuucuuuuucuuuaaggcagcagaucuuugcaaauguuguugcuuuuuuuucuuuuucuuuuucuuucuuucuuucuuuuuuuuauuauuuuugagacggaguuucacucguugccgaggcuggagugcaguggugcgaucucggcucacugcaaccucugccucccggguucaagcaauucuucugucucagccucucgaguagcugggauuaugggugcaugccacuaugccuggcuaauuuuuguauuuuuaguagagaugggguuucaucauauuggucaggcugguuuugaacuccugaccucagcugaucugcccugcucagccucccaaaguguugcgauuacaggcgugagccaccgugcccagcugauuuuguuucaauaaagguacuggugcuacaugucuuaggccuucaguuuguuuuugucauacccuugccuucaugugguugcuuucagcuuuuaucaguacgucacuugcaugucacauuagugaguuuuuuauuuuuagaaacagggucuugcucuguugcccaggcugaaaugcaguggcacaaucacagcucacugcagccucgaccuccuaggcuccagccauccuccugccuuggcuuccugaguagcuaagacuacaggcgugugucaccauaccuggccaauuuuuaaauuuauuuuuguagugacagggucucccuauguugcccaggcuggucguuggggcacuugugagcauuuccuaucugugguugccagcaguguuguagcuauuguauuccacugauuggugaguggauaaggggcaaaccgguaaaguugugaggcccuggcuucacacaguccuccugccuuggccucccaaagugcuuggauuacaggcaugagccaccacgcccagcauggugaauuauuuugagcaguccacucagcugcccggucauccuugugugguuuugauaagagccuuguuucaaauaaaccaccagcaugagauaaaauugaauuucuuacccugucaccugcuuuuuaggaaagccgauucccauugcucuacuuuucauauauuauaauaucuguuucacaauaauuugauucauuaugaaaugagguuuuugucuacacuaggaaucaguagcaauguuaggaauuuaugaugaccucugugcccaaugaagggagucagggguaguauugcuuaauguucacuuagcugguaguucucuuccaguugaguacccaugaacuaguuacuaccugguguguuuucuugggaauuugggaaugccccccugcuuccagccugggagguccuuggggcacuugcgagcauuuccuaucugugguugccagcaguguuguagcuguuguguucuacugauuggugaguggauaaagggcaaaccaguaaaguugugaugagaagcaguaauaccaguaaccaaugaaccuuugguggaauaacaggcaaauaaggccaaguucagcugauccuuagggaaaaagcuagcuucaagaguuagagguacggggcguguguucagcugcuaagcccccacuuggguguaauagaagaugcagugggggaaggcgggugagcagagcugugagcugugaugcuaggguggaaggcuggugggugggcacaguuaaauuggacccuauuccuuauauguguguguguguguguguauuaacagggucaguuguaagacagaaguaauaucaugcuuauuaaaguauucauguccuuggcuugugagcaccuugcauuucuuuguguucagagccaugcaaacuagaaucacaaugugccuaaggacaaggacaguggacacaguggccaauguugugauacuaugucgggguacuuuucucaucuuggucaaaaucgccauuggccuuuggcaaucauugcuugcucuaaaauaauuaaaaucucucucucucuccauuuuuuuuuuuuuuuagagacacugggucucccuggguugccuaggcugguuucaaacuccugggcucaagugauccucuugccauggccucccaaagugcugggacuacaggcaugagccaccaugccuggccuaaaauauauuuuuuaggauucucuuucauguuugagccauauuaugugaggaagauagacuuaauaucagaaggaaaaaugaacuuugccauuguugccaggaucuggguuauauacaaucuuacugccucucucucuauauauauauauaugguuuuuuuuuuaauuauacuuuaaguucuaggguacauguguacaauguucagguuuguuacauagguauacaugugccauguugguuuucugcacccaucaacucguuauuuacauuagguauuucuccuaaugcuaucccucccccagucccccaccugcugacaggccccagugugugauguuccccaccuguguccaaguguucucauuguucagcucccaccuaugagugaaaacaugcaguguuugguuuucuguccuugugcuugugauaguuugcugagaaugaugguuuccagcuucauccaugucccugcaaaggacaugaacucauccuuuuuuauggcugcauaguauuccaugguguguaugugccacauuuucuuaauccagucuaucauugauggacauuuggguugguuccaagucuuugcuguuuugaauagugcuacaauaaacauaugugugcaugugucuuuauagcagcaugauuuauaauccuuuggguauacacccaguaaugggauggcugggucaaaugguauuucuaguucuagauccuugaggaauugccaugcugucuuccacaaugguugaacuaguuuacagucccaucaacaguguaaaaguguucuuauuucuccacauccucuccagcaucuguugucuccugacuuuuuaaugaucgccauucuaacuggcaugagaugguaucucauugugguuuugauuugcauuucucugauggccagugaugaugagcauuuuuucaugugucuguuggcugcauaaaugucuucuuuugagaagugucuguucauauccuuugcccacuuuuugaugggguuguuuuuuucuuguaaauuuguuuaaguucuuuguagauucuggauauuagcccuuugucagauggguagauugcaaaaauuuucucccauucuguagguugccuguucacucuaaugguaguuuuuuuuuuuuugccgugcagaaacucuuuaguuuaauuagaucccauuugucuauuuuggcuuuuguugccauugcuuuugguguuuuagucaugaagucuuugcccaugccuauguccugaaugguauugccuagguuuucuucuaggguuuuuaugguuuuaggucuaauauuuaaaucuuuaauccaucuugaauuaauuuuuauauaagguguaaggaagggauucaguuucagcuuucuacguaugacugcccauaucuauuaauuaguaugagaggacuuguuguucuuacuauuuaguaaaguaauauugccugaggcagugcugcucaaacuauuuauggugacagaccaguuccccgccccgccccguaagucaaagauagguacauuuguaacauacaauacaaaugaauaggagggaaaagauaccaaauccaaguccauuuuuuguuguuacaagagucaacagcccuaaguccucagguugcugucgcucacucucgaugacugcacucaucucacugcaaacaguagccaguguuugcugaccacacguugaguagggcuggucugaggcacuuaagagaaaugaggacaaacucauguguccaggauagagugaacaaggcguuaaaaguuauacaaauaauucucugaaaaauacccacggaaagaaugcuugggugaggcagacggaaggcacaguugccauucauagacugagugugaacugucaggcuuugugugcgaugccaggcaugcuccaggaaagagggugcucucagccuucucugcccuugggggcuugaugaugucauuaaaagaaaaguaaauauccugguuugacuugugauaugugcucuugaggcagagcagugggugauagggagacauguaaagaagugaccaaaauuagggucagaaagacuucguggggugaagcugaagcgcaugcaggaaggaaugaguuucccauggaaccggggaggcacagucugugucgugcacagagagagagcuugagggauccaugugcagguggaugagugccuccugaguguuacagccagaagaguucaguuggggcaggagggaccuuaaugucccuuuaguauaaaugcucauccaugguucaagucugcuaagauagccucgugcagugacagugugccucugaccgugcguguccaaggaugggggacccacugcugcccagaacaaugcauuuuccaugacugugugaaaacucuucuagcccuugagcugaaucugucucccuggaacuuugacucaucaauccuggcucuuuccuacccgcugagaccacacagcacacugcuaaucuaucauccucauggcagcucuucaguguuuggagaccuccacaccacccugaggcuucucuucuggcuagaauuugucugucgcuucagcccucucuugugggccaugguuuaggguucccacaucaccugcucacuaagauccagauccugucacuuccuuuccauccacacuuucacagauuuuauugagaccuccugcauaggcauaggggaccccaccgggagcucacagccuaggauggggugcagggaaggaaaaauucuccuuugcccucucagagucugccgcugggccugagaaucaaacugacauaagauagauuaacaggagaaaugcaugcaagucuuauuaagaauuuagguguacaugggagucuucacaaggaaaugaagacccaaagaagcgaccagagcagacagcuuguaucaccuuuuuuuguuguucuguuuuguuuuuuugagacaaagucucguucugucauccaggcuggaguguaguggcccaaucucggcucacugcaacuucuaccucccggguucaagcgauucuccugccucagccucccgagucgcugggauuacaagcguacaccgccauguccggcuaauuuuuguguuuuuaguagagacaggguuucaccauguuggccaggcuggucuugaauucauaaccucaggugauccacccaccuuggccucccaaagugcugggauuacaggcaugagccaccacgccugaccuuguaucacuuuuauacaaagaaaugacaaauuugugaagacaugacaagaaaaagaguuuugggcuggaggcaguaaauuguggggaaguaacuaagagauagauauauugggggaaaacuugugggagacaaagguuauuuugguaaguuuauuuguggaaaucccuuuuaguguugauucccagacucuggugauaaggcuguucuucuguuucugguacagggagggcaccuuucucgugggaaauuuuauggccuguuuuuguauagaaagagagaggucagaaagucuuuccuggaucucucauuucucaaguguuuucagcucaauauaaccaauauaccgaaagggcauauuugguguggcauauccugaacaggauccuucaaggggaacaugaguuaaauaaucacaaaauccaaggcagaauuguagacccugaggcuaccacggagcuauuacagaggaacaguguccuagaaagccuaugacacagcaugggggacugaucccauugagaauagucaagcagggauucccugcagaaggguuuucagagcugcacuaacccaauaggggaaggggcugaaccucuagguggagagagcagcaugugcaaaggcccggugacuucacgcuguugucaaucagaguggaacagaguaagaugacuuguagugcuaccauuccacacuccuguuuccgguguuaagaugacaagauggguuucccaaccacccuggucaccuucccuccucucucauacccauuccagccuccccaaacuucuucucuuuguuaaagcaucauucccauucccucugacaucugagcccaaacuuuaguguuagauucuuccccauuuaacucguuuuuuuuuuaacagucuuauucuuuguuaaaauucucaccuuucucaugcccaguuuugucaguaagguccuagcugaguguugucuuccuuccucaucagauugcugucaguguauucuuuauuguaaagcacuuaucagguccauguguugcacagagaucuucaaaaguugaauacagauugagcaucuuaauucgaaaauucaaaauccaaaaugcuucaaaaucugaaacuuuuugaguaccgacaugagccacacauggaaaauuccacaccugaccucaugugacaaggugcggucaaaacacacaacacacaguuuauuugguauccccaagggaaaacuaaaaucaccuucaggcuaagugcauaaggucuguaugaaacagaaaugaauuuuguguuuagacugggucccauccccaagaugacucauuuauguauauguaaauauucugaagucugaaaaaaauccgacaucagaaacacuucugguccugaagcauuuuggauaagggauguucgaccuguauaaaccgacgugcccuucaaggccccgcugguaauauccccccagccugcuuuuccggugccauguccugugugcuuuacauccugugcuaacacaaugggaugagccucuguucccugaugacuccagccccugcucccuggagcagcuucccuucucacuggucucuuucuguugaaguauuuucuguccuucaaagcccacuugaguugcuaccuccuucaugaagccuucauggaugccuucccaucuauggucucccuccaguugcaccgugaaacaucuuaugacacuucucacacuuuugagagcuuggauuauaaucguguacaagccguguuucuaucugcuuccuccccaggaggauggaaguucccgaagucuugucccuugagcauagauacccaggaaacaaauguucguugccuugaauaggugggagacagguccaggauuguguaagauccugugauucauucuuuucuaaaggagaucccuuguucgcauuuucgaauuauuaaguaguguugguuuauaagagguaacccugagcuuguuuucauacccucaaggcuggauuuaauugguauuguuuaguucagcauaacuugaauucauuuuuaguuuuaggacauuuauuccccugagcucuguggagaucauugguaagagaaauuccaaaguuuaguuagacuuuuuuuuuuuuuuucuggcacuguagcacugcuguucucccuauaaauaccugggggcugugcucuaccugccuuauauauuagcaccuagaggucaguaauaacucaggcuaauaauaguuuggcuuaagagucuaggguaguuacagguccuuucacccuauguuuuaaugccagacauguaauuuagaaaucuucuacccacuuguuuaguguuuaaauaaaucuuuaaaguaccuuuuugguuuagagccuaaagggaaaagaaaaaucuuaacuacguuugggguaaaauugccucauaggaaaacacuugcagcagugauuagagacccuuuccaggcuuuuagccaagaaaaaguuucaguggccgggggcuucccccuuucaccccacuuuuucuguuucugaucuucugguuucucuguuuuugucuagauuccacagcucgcuuauuuaguggacuugaaaauugauucagcccucuuuuuauuugaugggguuguaugacucuggguucuccagagaaacagaaccaauaaacuauagauauggauauggagaaggaguuauuuggagggauuggcucacacgacuguguagacugagaaaucccaugauuuauugucugcaagcuggaggcccgggaaagcuggcgcaguucuacuccaagcugaggccugagaaccaguagcacugauaaucgagagcagcagguagauguuccagcucaagugaagggcacacuugcuccuccucuaacuuucuguccuguccaggccuucagugauacccaccugcacuggugggggaccuucuuuacucagguuaccuauucaaaugcuaaucucuucuagaaacagccucagaggcacaccuagaaauaguuuuaucagccacucuggugucccuuaguugauuuaaucaaguugacauauaaaauugaccaucacagugauauuuggguagguuuuuuuuuuuuuuuuuggucuauuaaaugcuaaaaauaacaugcccauuuuguuccuuauuauugccauguggguauuaguuuaauuucuguuuuucuaccuucugauauaggaauauguagcuuaauuuuuugaaauuaaguugaggugaggccguuccuuuuuaaaaagaaaaaugagauggggaucuccagggugaccucaaacuccugagcucaggggauccuccugccucagccuccugaguagcugggaggaccuuccuuuugaugucaguuguguuuagcuauaauaauuccucacuuuacuucucucucucccucuucaccuugucagaaaugacuuuugguuuaugggauauaaauguaguguguauauuucuugcuuggauaaugcucguuuuugucuguagugauaguuccuuugcuggaauuuuuuaguuuagcuuugaaauagcaauauauuaagccucuuuuuguuuuacuuuccauccaagaauuucuccauuuguaucuuuguccuguuuaggagccuuguuccugccccagcacauugagaaguuuggaaacguguaauugauagaggaaguuagguccuagaacucagaaucuuaaauguugacuuuggcuggaauacuuccucauuuaucaacuuaggucaucuguuucuuguuuucuuugcuuguaaucuucuuuuacauauccauuuuaagaaguuuuguauuugccuuuaaaaaaaauaaaugaaaauagaguguaugccucuaaauaaggaaacaaagagucucccaaccuaaugcuuugaaguuugcuacuuucaaguuaguuguuaauaaagcccuccguuaacacagaaaugcugucuuccaaauaaggugggaauuauacccuguucugcauauuuucuauuuggaagaauacgcaaauggccaaacuggaaaaauuuuguagaugucauggguuagaugugcagacccuuaaaaaaaauugacagaggaagguuuuacccauagcagguaaauuauacuuucuucuaaagucuuagaauaauaagacugauuuucuuaugagccccaugucacuauuccucccagccaccgccuuuauuaguuuucaggcuaagaguauccucuggaaucauaaauuacauuauucucauccauuccauaaggagcccgguucccccagcccccacagucacacucacgaugucgacaugccuuauguugcucacgaugugugggguaggugucuuuguccuggugggucccacguuaucccucuugaggggauaacgucacagguagugcugauguggaagcuaagguaaagauuaacagcuccacuuuugcagcugggcugagcuggaguuggucuaccgcuuacuagccgugguuaugggcgaguuacuuagccuauccugugccaccuucccucaucucuaaacaguaagggauagugagcccccuccugugauguggcaaacaaagguugacuauauugcgcuucauaguuuucuugaaguacuuucccauguggcuucauuacuucacaccucagcaguccuguucauaggcuaaguuuugucagggcacauuguaaaaauggggaaaugaggcucaaguuaguuaggcuuggugcccacauguuacuggucauuaaacugaagcaauugcuugugccuucugacuucuugcacuugacuguguggguccugcuuuccagggcccagaugcaggauggagcuuguuccaugugaccucugguugcuucugccacagcuuacuugggaagggcccagcauccacuggauuuagcuggcuuaggggaaagcuauggauuucacuucauuauugucauugcuuucauuaucuuuucuguggucuaagucagcugucuagagacugccuuucccccuuaggaaacugcuaccaucucuuagugacauuugguauaauugcuagacguugccugggaaaaguuggcuggcauaacccaggggcuuagagaggaaugcccaccuuauuuuagcagauuuuccuuaccagggcaacuuuuccucaauauauaagugauuagguaacaguagacagcuugugguguucugauccuuugauggagugcuggcuggugaaaccuucugccugccccugaagaacucuggaaucggaaagacuuaaauguucaccauaugagaaguacuauuagagagguuaauaggaaagguuaggacccugggaaagaaucaucaaggcuggggaguucguggcaggcagagggagggaggaagcggcguguacuugggagggaagcggugcuguucuagcgggagggaacaguuugugcgcaacuuggagaugugacagcaugugauauuuuaggggacuggccuguuguccuguguggcugggaguuuaaggucacaugaaguaagacuuguuggcacuaaauuguaaagggcuucaugagcccuaaagagcuugaagagcgaaugaagguuuuugacacgaucagauuuuugauccuuguuaauauagcuaacaauuucacauccagagugccaaguccguaggcagcggggcuugaccacagccguccucucuggggucugugguucuucauuauuguuuacuugauucugccacugcaguuccuauuuccaggaaaccaacaacccuguaaacaccuguuuuccuuugaccacagaacacagcauaguuuuauuaacaggagccuggucugcuaggaaaaaacaaccugcccccuuggaacacagucuuguuuuccaguucaccacagcugcgaaggagcccgguggggacucuuugcuuuuaguuccuucaccucugcugugugcccaguaaaugaaaagccccuugcucuuaauggguuuuuauaucauucauguuuuacaucugugaagucgagugggcuuuauucuuuucgauucugacaccagacuucagaagcagaagcgauccugaucuguaggagcuugauucagaaagcuaggugggggcugggucucaguucugaggcuuucugagaugcaggugggcuucgcuguauggccccuaaggagggauccaggacugacugucugcccugcaguuugccacgauucuauccaaacguccaucucuacucuuugggcguuuguucuagucuuugccaacugccauuucccccacucucaccuuugaugacuuaagaauuuuguauuuuuuguugccucaucacugcccuugugcuuuccugauccccacccugcgucuuccucccuuuccgcauucccugacccacauacuuguccacugguugagauaaagcccucaauucaacguaucuucacuuggcuuuuuuuuaagucgugguggugcgauaacaauacugucauuuccugaagacucacugcaggugucaagugcuguguuaaguguuuugcagcuguuaccacuuuaauccuuacagcaaccccugcgaccucuguguuuuauuauuauuccuaucuuauggaucacgaaacagacacauucuagacugcaggcuggcugauuggcaagaccgcaguugacguagccagagaaccagagagagguucauuuaacagcaaaguuugggcacuugauuugccuguggaccuaaucuaauguguuaacugguuacgagccuuccccucgacuuccucuugaauaaguaaaugaaucuaaacuuuaaauauuggaauaccauacacauacagaaaagugcaugaaucauacaugucuagcucagugacuuuucaccaaaggcagccaccuguguaaccagcccuuggaucaaggaacagagcaggaucauugcccagaaaccccucccaugccccuugcagucaccaagguuaaccaccaccuugacuuucaauacugcagaugaauuuugccuguguucgaaauucuagaaaugcggucauuuccauguccauuauuuuguaucuggcuucauucugaauucaggugugagcgauauucaugaaugcucacuaucuguuuauacauuccucuuucugauugguuuuacuuuuccuaguuccucaaccaguagagaaaguuaaguuuccuucugggaucccuucaccauggucaugaugagcccucaguguggccuuuuauugaaaaagcucuguuauuauuguaggugaauaauuuccuccccugguuuuuuccuuccaguugaucccuccuaaaggcccauccacccuuuguguugcucuggcguguucauuugauuuggcucuccagcacagcaggcagcaccagcuuccugcgaggcccccugugacugauguauuaacauccauaugggcuucccgugggacggaugaguguucacagcuucugacagcagcucgcugcauugugaaucaauuuuaaauugccuccauaugaugaucgcaggccuccugugcaguuuaaagaagaggacaccugggagagaagugggugucuuccaaagaucagcagacagaucucccgucuguuacucggugcaucuauuuaaucuggaacauuuaacucuaugauaagcaggcuuccaguuggaggaagauaaaaucuccuuucucugaaaaaucugagauugaugaaagggugccucauggaaaccuggccuuaccuggaggcgcccagcuugauuugugguacacagagaaaaacuaauccucacauguguaauuucucucauggcaccgagaucuuugagaagcaguuucuccaucuuaaacaccauccuuuaaaucaugugcaacucaauuguuuuacuuuuauuuuuuaauuuuuuuuuuuuuuuuuuugagacagagucucugucgcccaggcuggagugcaguggcacaaucucggcucaccacaagcuccgccucccagguucacgccauucuccugccucagccucccgaguagcugggacuacaagcgcccgccaccauacccggcugauuuuuuuguauuuuuaguagagaugggguuucacucuguuagccaggauggucuugaucuccugaucucgugauccgcccgccuuggccucccagagugcugggauuacaggcgugagccaccgcgcccagccucaauuguuuaauuuuauggaaauuuacuugucauuucuucaguaucaccuggcaauuuuuuuguuguuuuuggacccagaguauggagccugauucugagucauagaacuuggcuacuggacuuuguucguugagcauucuucaaagccuagaauucuuguaggacaugaauagacuuaaacucccauaguucuguggcagucuucaagggcaacaaaaugcuauuugauuaugacuccaaguaucccauaauaaguggcauagguuccuguucaacuaacuauaaugugcauguugaaauaucauguggacucgauauauugcuaaggacaccaaauaauccuguuggauaaaaaaugagauugagugguuuggugaugugagggcuuugagcuauauuguuuuuauauguguauuuauuccccaggacagucuccaugguucccauuauacgugcuuauucauucaaauuaagaguaacauuaaggauuugggccaaaaagcuauuuacuauuaguuacuggaaccaauuugccagcagauaacagauugagauuauguccugugauugaguggaggggaaguuuaaaagucuucaugugucugauauuuugcuuuuauggagggaagauaauagcaugcauuuuauuuucaagcaaauguauguggguuuuaagugcagggugcuagagaccuggcauaaucgguuuucaguuuugugcuugcuaaguuacuuuacaaaauuugaguuuguauuaaaaugaaaauuuaagcucuguguuaguacucaugguguuuacauuauauuuaaagcugccaaugacaagcuccagaaagggcccagacuuucucgaggguaaugggaaggaggaagcagugcauacuucacuuauuguuuaugguuugaacuucuagcucucuuagugauuucaaguuaagaaaguggaaguaguggucuucaaaguagaaugugcauaauuuuuuuuuuuuuuaagacguagucuugcucuugucgccuaggcuggagugcaguggcgcgaucucauuguucucauuguccaacucccauuuaugagugagaacaugcaggguuugguuuucuguuccuguguuaguuugcugggaaugaugguuuccaguuucauccaugucccugcaagggacaugaacucauccuuuuuuuuauggcugcauaguauuccaugguguauaugugccacauuuucuuuauccauucugucauugaugggcauuuggguugguuccaagucuuugcuauccagcaauugauuucugucuuugaaaucaacuuguggcccagaggggccguaggagcaccagucaucuugcucuuagcucaggcagugggaaggaagaagagaagagggcaaguaugcucucucccuauuuauuuuuuuagagcaguuauagguucuuggcaaaauagaguggaaaguuacagagaguucccauaucccccaucccucuccccucuuucaaguucagagcuuccucaaaaugccauccaacagcuucuucuuacaccucauuggucagaacauaggcaggcugggcuaaaggagaccggggaagaguaguuuuuuagcugcacacuuugcuguuuuauauaauggcguuccugaccaagguaggcaaggaagauuguugaguaggaaaccuaaaaucucuguuuacagccauauaagauaaucucuuauuuucucuuccuuaagcaagagaaaguugaaguccauaccauaaacugguauuuuuagaaagcuguuuuuuuggagguuguuuuugcuguugaaauauaucuacucuguuuaauuauuauuaguucuuaagggcuucaucuuuagcagggaaaacaaucauuuaaaauuauacuaagaaaucauacaauuacacaagauacauggaaggagguauuuuauguucauuuggaaguacauuaaguguuuuauaaugagauuugagggaaugcuuuacagaauggguaagaacaauuuaaaacccuuaaaaaauuuuacauacaguucaauauauaugucauuugguacacgcuagauuucugcuauuaauuauuuuaaauuugcaccagcaguaaaugcuucaauuuguauugauuucaaaggaaacuauacaagagaaucuuuccuuuuuuucaucuuuuucauagucguagcacauugccgagauagggauugcuuccucuguaaauguguuuucugucuucucuccaaucguuuuuccaaaagugcauacuccuuccacguuacugcagacggucagaugcagccugucccuuuuccccccgacgcccucaucggacccggaaucccccggcaugcucgccagaucaacacccucaaccacggggagguggugugcgcugugaccaucagcaaccccacgagacacguguacacaggcgggaagggcugcgucaaggucugggacaucagccacccuggcaauaagagcccugucucccagcucgacugucuggugagugaacaggaacuggugcacaagggcaauuucucccuggagauucaauaaggaaauagcugugugggccuggguuuuauucccauuaugaggaaauagaagccccuucuguuuccuguguugguuauuuaacccccucggcuccccauuuaaaugcgaagguuucauuuguugcuguuguacuggcuaaaucccagaguugauggauuucuuuuuaaaaaauauuuuacagugguuuacagaggcucuccucauguauggauguguauuacaaaagagaguuucccauuuaauggacaaaagcacaacugggccuggacucugaucccugccauccacucguuuuuuaauugaccuacagccuuuagauaaauauagaauaguaaauauuugauaacauggcauaaaaaccauucugaacagggucuguguuuuuaagggagaccugagagagcugguuagguuuuauggccuuaacuucaggaaaggguuaaaggcugucacugcaaagacccggggcagccaucaacgaaagagagcagugagaaugcuuucccagaguaccuaagccacguccgcucagagccugagaauaccauuuagcauuuuucagggacauaaaacauguugggacauguucggaucucuuuuuucuuuuuucuuugagacggagucuugcucugucgcccaggcuggagugcaguggccggaucucggcucacugcaggcuccgccuccgggguuuacgccguucuccugccucagccucccaaguagcugggacuacgggcgcccaccaccacgcccggcuaauuuuuuguauuuuuaguagagacgggguuucaccauguuagccagaauggucucgaucuccugaccuugugauccgcccgccuuggccuuccaaagugcugggauuauaggcgugagccaccgcgcccggccauguuccgauuucuaaaccauaaccccaggauuuacagagcacauaccacuggccuuaagcagacuccgagcugcccugcccugcccugcccugguguggugucugccugcacucugcuguugcagauggugccacguacccacugccugccuggaaaauuguaaggauuccagagaagguguuuccaaaaagcagaguggcgguguuuuggaaacacagacuuuuuuuagaguaguuauuagugcauuuuuuaaaaaaaccaaauaacuucaaaaugucuucauucaugaaauucuuauuuaaauauggcccaauauucuauagcaguaggaguauccuuuguugaagucaugugcuuaaaguuucuuuaaucuuugaaagauaauccaucguuaaaagcauguaagcaaacuuuagccauaucugcaucuuucaggaguugaucauaugagggccccccacccacagccccuucauaugugucgguuuugauggaaagaugccugcuuuuaucagguucuuuggccuuugcauugaggggcuuaaguguaacagcagccacaugacaacuugagaaagcagcucugguaaauucuuagcaagaauccuucugacuaaugagguaaugugcucagcauaacgaagaccgaaacauagaggaugggccugcaguuuccaagugguaaauaaugcagggugaugagguagauuuauaaacuagcuuggaaaagugguuucuucucagggaacuauguguacaccuguaccucauaccuagauaguuucagcucugugaugcaggacaccagaagcaguuaccuaagcuccugugaauuuguuuuguuuacuauuuugaaggagacaguuguacuuggaccccaaucuugacuagagaacucuugcucuguuagaguguccaugaaacaccacucuuaacucaaaaaaccaagacagccauuagagaacauggugcuaugauugcucgguaauucauuauagcaaugaauuauguuuauucuacagaacagagacaauuauauccguuccuguaaauugcuacccgauggcugcacucucauagugggaggggaagccaguacuuuguccauuugggaccuggcggcuccaaccccgcgcaucaaggcggagcugacguccucggcccccgccugcuacgcccuggccaucagccccgauuccaaggucugcuucucaugcugcagcgacggcaacaucgcugugugggaucugcacaaccagacacuagugaggugagcaaagauggucgucuaaggagggguucgcuucuuuagcagcugggccuaucaccucugcuucucucuggcugccugcagcccacacaauaagagccucuugaaugccaggcauggggcuaggugaugagggaacaaagacaacuguguugcugccuuuggggggcuuacagucuuauuacuaugccuggugucacccgagacuuucuaucuccuuaaugugccaauucuucagcccacauacagacuccaaacuuguucuaaaaauauuucuggcuuuugccaagggguggccuaauguggauuacacggcagcacaaaaggcccuugauacuagauguuuugggcuuuggcuagaacuuggugcagacaagagccaacugauaaaagauaacagaaaaucaacaaagggacaugagaagaggagauucugugaauuuugccuacaaaaugauuuuaaaguaucucaauaaugaaauagaccugcccaggggugguuccacccaggagcccgcagggcucugccuggccuucuggcaucagcccugucaccuuagcagcagcugcaguucugguacccaugugucucuccucagcucccccgccaaaugcucccuucagaagucagugcucacaccagagcuguucucaaaaagucuuuuuaaaguaagcaugaaugaaacaugaaagguaaaaugaguacauguuuuacucuuguuucaucuuugcugggaagccgucccugcggauggugcaguuuggggucuguggcuuguuugguaaguccccucucaugcugcacagagaagggacgggcuccagaagucaucaugacagcucacucucuucaaaccuccgcuguagaaauccaugaagugucauugagccgggcccggucccugcgugugggugacagugcggcaguuacuuuccucuucuguuugcuggguaguguaggugagcaaaauggaaugauggagccagggccgaacgcccucuccaccuuuuauccuagcaaaaguuacuuguuuuuuucuuuuuuuaaaacuccauaaguagcacuuucaaaauaucaauucuaagcacuuuucaaauauuccuccacuuaguucucauaacgucuguccugcuauuugccccauuuuauagaggaagugccugaggcucagagaggguaaguuacuggcuucaggucacacagucagaugugguggagccaaguugaggcccaggcauucugcucucgucuguacucugaacccuugcuccgugccggcuccuggggaguaaauaccuguuggauagaaugggguagcgucuuacaaaucuuucucuggaccacucacagguggcuaguggcugcugcauguaauagggccauguaaagccuauugaaugucuuuguauccacuguaacccagcacguucugaacagucauaggaugugccugagaguaaugcuggaguauaguauauggacggagagagggcagagggaugggggagcagcugccagguacuguaugucagcagaggaagguguuuucagucaaggaggaacagcguuucaugaguuagaaaggucaaaagaagucagagggucacuggauuuccagagcuguuugaagggaaggaaagcaacacuuucaccaagugaagcagggacugcuccaggccuggguguucuguggggaugucugggaagcaagcggaaacauuggagguccagcugcacggccgcaggagagaggacucaaccuggauccuaaagugcagaaguuggggauggcuugcagagagaagauuuuaaaagugaugguucacgucuuggcuuagaauuuagggcaguaguggugcuuuuuccuucccuugcacucuuuaaaauccaagcucagguuaaaaguuuggagcucuacaggaaugauaagguguggggauccuggaggaagaagcagcaugguaacuuucuucucaguguugaaauucccacgcaguucuuuacuggaucccgccugcuucugagggugggucuagacuuugcucgccuuuucuggcugccucccccaccaccuuccucucagcaugcagaacugaguccaccagucaccgucccugcuggggcuuacacugaccuccccucagcagcucugcuaguugccuugcacagcaucugugcucagcagaucccuguuggcugaucguuucugauggcgauuuuugaaugaagcacaagguucuuuaaagaacaaccuugugcuccgcuuggaggcagagucuugcugaggugcccgugggucugccucagcaauuaccugugucucugcccaaugccucugaggucaggaggccggcaugcgugacccuuugucucugggaguccagauuuccuaaugcagggcucuuucuaacacagaaagcaagguugaguaaauacaugagcucaugcucuguuggcacguagggcauugcuguguugauucacucauggaaacaggaaugcuucuguacacccugugcuuguaacguccccauuucuuucucucacggacucaggccugcacgauuaaagaacagaccuuuaucuucccauaaggaauacaaucgggauuuuguguguuugucuuuuauuuucuauuuaacaauuaaacacuuuuccagaccuggaaagaauuuuaccuuccagacgguuuugucagaguagcauauuuaaguucuggguagugaccugcaguggcauuccauuucuuuagcacuuggaucguggaaaacagggaaagacaaucgcaggugcuguuuccccuccuccucaggggaagguuaguuugaucuugcacaucagcagacacuggcgggaucacacacacacacacacacacacacacacacacacacacgguccaaaacuaacaacacaacaguguuuaccuugagcucuggcaggaaaucauuauucaaucugguuuguuuuaucaggcaauuccagggccacacagacggagccagcuguauugacauuucuaaugauggcaccaagcucuggacgggugguuuggacaacacagucagguccugggaccugcgcgaggggcggcagcugcagcagcacgacuucaccucccaggugacugaguggcuuccgccugcccuggagucugggagguggcuggggugugucuuccuccucacaacccucccuccuuuacccuaggaugguaguggcuggacaaacagaucagggcugaauuugagauaacuaauuuaaaaacaaugaccaccaccuccuccuucacgacccucccccuaccuuccccaaaacuagagugguuuuuagaauccuguagguuaagguguguucucuguuauauuuacauaugaguuuguuuaagggauuuguacauugaagaauguauaguuuuccuucagcaguguuugaucuguggcacauauucucaccaucuaaugcaggaguaggagaugauuuuuugauuccuaaauaaauagaacuugagaaaucugcagaaugucacuaagaguagagaaaagucacagcuccucugaaaguucauuuauuuaccccgcaccagagagcucaaaaaaaugcacagauaccucagugauacccauuuuauuccucauccuuuaaaaaaugaacugguggcugacuagauuugcagacuuuugaaauaauguauaaauggcaacuuuguagauugugaaaaguauuuugauguccaaugucugaauguagacuuguuuuggaaaaaacaguguuugccauuuuaaaugcuuucuggugguagaauuguucuuucgaucaugacuuggcauuuauuuuuuaccuuguuuuguaauaaaaauaauucuacucagaaaacuaggacagaaacagaaaacaagcauauauacuucuaaauuucauauuccuguuaacauuuuguugaguuucuuagagucuugcuguuuucacucuuucccaacauaagcaggauacaauuuuuguucugccuuuuuuuaaaacuucuuagagaaauucucaaauacauaugaguacagcaaauguccaagcauuuaugaaagcacagagaauuguacaauaaaugccacaugcccaucgcucagcuugaaguuauuuggccauaugauaacucucguucccacccccagacacuggauuauuuuaaaauaaacucuagcagcauaucauuguauccauaagcacagccaugcaccauauaaccuuuuagccaaggacagaccgcauaugugacaguggucccuuaagauuauaauacuauauuuuuacuguaccuuuucaauguuuagauguaucuggauguacaaauacuucccguuaugcuacaguugccuacaguauucaguacaguaacaugcugugcaggguuguagccuacaagcgauaggcuccacucucuagguguguguaagugcacucucugaaguucacacaauaaagucaccuaacaaggccaggcacggaggcucacgccuguaaucccagcacuuugggaggccgaggcggguggaucacaaagucaggagaucgagaccauccuggcuggcacggugaaaccccgucuuuacuaaaaauacaaaaaauuagccgggcgugguggugggcgccuguagucccagcuacuugggaggcugaggcaggagaauggcgugaacccaagaggcggagcuugcagugagccgagauaacgccgcuucacuccagccugggcgacagagcaagacuccgucucaaaaaaaaaaaaaaaaaagucaccuaacgacacauuucucagaauguaucccccuugauaggugauauaugaucguauuucaguuagugucucuaaaagguaaagccuccuuuaaaauguacagaugaaugccauuauuauuaggaaucauuucuuaauuuuaucccaaaagacagagggguucaaauguuuccaguuuccuaaagguuuugacacuugguucaucugcguuagaucacuugcccuguggaccuccccacagucuggacuuggcugauuacuuccccccauucuugcuauuuccccacuuuucacauugcgucuucccuuccuaaguguaucaggcggaauaaugagugagccugucuugcuccuuguagaucuucucccugggguacugccccaccggggaguggcuggcagugggcauggagagcagcaauguggaggugcugcacgugaacaagccugacaaguaccagcugcaccugcaugagagcugcgugcugucccugaaauuugcuuacuguggugaguucagccgaaaggaaacuggaggccguugauggcccaaauggaaaaugcuucuuaaaaaaauaugguagagaucauaaucuggaaaaaauguucuccgagcagcuggaugcaauaauucuauuguuuuaauaugcccuucagagcacagcaaugucuguuucagucuguuuugcuaauuugagaaaagucagcaggcaaugugauugccuaauacacgguuuggacacaaguuuguuuuggagggguugggagacgacaaugaguuucuacucugaagaggggugggcgggaauuuauugaagaauggagcaggggcaguggaagucauuaugagcuggccaugaugaggaauccaggguuagagaagucgauauuuagguauacgcagacacuuaguuacacucuacucuacagugaggaugaagagggaagaaguucauguggugacccuucuugugugcugcagaugggcagauaucuguucacaguaugcauagauggauggauggauggauggauggauggauggauggguggaugagugccuaucacuuauugagcauuuuucuucaugcuauaugaugugacuggcauuuuacuuaaguuggauguuuaauccuuuaauucccauuaaagaugggaaucuuuaaucccauuuuaucaugaggagacugacuaaaauagaacacauucuucauugauuucuauauuugaggguuaccguguguuggauaugaugcuacuaguccuguauccagugacuaaggaggcugauaccucuuagauuauacccaagaucacugauaaaucacugaggagcccagauuaaaaccucuguucauaucauggaccaguccuuagggcaugauaguucauauauuaaaaauguucuuaguuugauuaaguccaaguugcuaauuguauaguaggaauuuuaaccuugugaaaacuagauauuccuuugcuaauucuagguaaaugguuugugaguacuggaaaagauaaccuccucaaugcuuggcggacccccuauggagccagcauauuccaggugaguaaguacuccucaccuagauccacaguuugaccacagugucgccucugaagccaggagugaaggugccuccgagggagcagggccucugaguaccguuguuccacauuaaacacauguccauuguuuucucuuccaguccaaagaguccucgucagugcuuagcugugacaucucuguggaugauaaguacauagucacuggcucgggggacaagaaggcuacagucuaugaagucaucuacugaaaacauuaugugguuuaacguuuauaguugaauugggccaaaauguuucgaauuuauagaaauagaaaaguuguaacuuuaaaagagaaaaaaaauuacaaacaccuguuuccaaaccuugacagaaaacuacuuugagucuacaaagaggaggcgacaaguccaucagcagaaagucaccugucuacauagaccaaauggagcaccaaggccaagcggacagaggggccauggguuguaggauugaggaacggaaucugccgacucacaugacagcccauucuuucuuucugggugaucuggggaucacgccuugcccaagugugagauuaccuuucuguuccuugcaguucaccucacuuuccguccuuuguagagcaguggugucuccaaugaacuuguuuccugguuuugcaucuugugaaauguuuuuuuguauuuuuguugaagguuaaacauuuguauaaauuguaaauauauuugguuuauuacaguaaaggcuuuaguaccaauaagugguuuuccuuuucuuucuuuauuguuuuuuauuaaagcuuugggaucaucaauguggguuuuauaagcaaagauuauacauuuguagaggaaguuuugaauugcacugcuuauuuuauaaauauauuuggugguaggcucccauugcauuagaaccuaauccuucacaagcuugaguuacugggagcucaagacuaggaauugugaguaauugaagguuuacuaaugacaguuuucuuuaggaaaguaaaauuacuucaucaagauuuguucuuuuguuaugauacuauugugauucaaggucaaagauuaaagcucuacuuuuuucuggugauucauuggaaggcaaaauauuccuuuuucuaggaaggcccaaucuccucuuccuuuucccuuucucuuucccuuucucucuuucuuucguucucucucucucucuccuuuuuuuuuuuuuuuuuuuuuguuuaaagauuugaguucacauuguuuguuacccagguuggagugcaauggcaugaucacaucucacugcagccuugaacuccugggcuuaagcaauccucccaccucagccuccugaauagccaggcuaauuuuuuuuuuuuuuuuaauuuuuauuuuuuguagaggcagacucucacuuuguugcccaggcuggucucgaccuccuggccucaagugauccucccgccuuggucuccuaaagugcuaggauuaaaggcaugacccacuacaugcuggccucaguaguuucaaaucuguauucucucucuucacaagcuucacuuggguuuuguguuaugaucuaugauacacagaaagcugcagaguucauuaaccuguaaaagguggaaagucagcugguuuugucuucauuaauacuuauuuggucuauuauauuaaguuacuuaagccaaccauacccaucacuucuccgcauucuucucauuaaggcccucccugcagcucuagccauuauuaucuaucauuagucuuuggucuuuaucuuuguggacaugcuuuuacuaaugugauuagaugaaaucuguaauccugggcuuuuaauaaguuaccauccauguuuccuccugaaaaagcuacauggcuuauuuuuuauauacuauauacuauuauacaccauuauuuucuauuauuuuauaaaauaauagcuaauaaauuuaaggcaguguucccggcuguuuaaaaauagcaccuaaggaauuuuuaauguucuuguucucuuaugauccagcgaguuguuggcaguuugucuuaauauuuuucauuuguuaccaagaccuuguucuuuauauauucaaaaacauuacuuuguuugcuuuuugccaaaaaaaaauguuuauauacugaguuaaauauuuucacuucucauuaagugaauggcaaacccccauuacuaaagcugauuaugcugucaucccuuccuuguauaacgaaguagguuucuaucugacagacucagauggcuuguuaauggaguaauggaguguuuaucuuuucuguucucucucccuccccgccuuacuucccuauuuucucuaauaccaacaaugaaguagcuuaaagaccauuagaguuugucucccuccuaccugugacccggagacccaggcccacaaugcagcucugcacuuguaaggccucucuaguugccaccacuuccagccagcaguggggaaagagcagaaguccagggaaagcgauguguuuuuaagcaggugacuagaauuuguuccaucacuuuuauuugccaguccgucggcaggga

SEQ ID NO: 14000 - RNA, 2616 nt, Homo sapiens
auugaauuauuauaaguauuuauuaauacaugugaagcucugaagacaguguguagcucacauuacuguucuaaguaaguguuagguugcauauuuauuauuuuagcauauccaauuuacuuguaaggaugguugggauccugacguuacaugcacacauuuggaaaauucccaguugaguauacguuagccaaguucagaauuguguguggccgggugaaguggcucacgccuguaaucccagcacuuugggaggccgaggcgggcggaucaccugaggucaggaguuugugaccagccuggccaacauggcgaaacccugucucuacugaaaauacaaaaauuagcugggcgugguggcgggcgacuguaaucccagcuacucgggaggcugaggcaggagaaucucucgaacccgugaggcggagguugcaguaagccgagauagcgccauugcacuccaaacugggcgacacagcaagacuccgucucaaaaaagagugugucuguguguguagcggaacuuuguuuuuaacaacuaaagaaauauggugacccaauaaucccguuagccuuagcucaauuaaucacauuccaucuguccucacaauguucaccccagugagaaacgaguucaagcgcgugguaagcggugucgauauauuuuuaaaauucuguuaucaguauaauguaacagaaaauucagcauauuagcccaacuuugcucacuggugugaagauaugcccaaucuuucuuagcuaagacguuagagaaaacgccacaagggacccagcugggagcucuguaggaaguuuaaaaaaaaaaucauucagcuuugcaaaacaucugaugcucaaccaucugucuuuggcaguacaggggcuuaaggucugguugguuccuucugacaccucggaaggcggaguuacagaggaaaagcaacaaguuguaggaaguuaacuuaucuagucucagacgcuggaggcaccugcauuucuagucacuucaguucuggccaaacuguuaucaacucuaguuucugagggaccgccagcccaggauuccuauuggggucaccuuugugccucccuaucuuaagagcacacuugggcgggucggggcgggacgugcuggguguaggugacucaacaccggacaguuuugcuuccagaggcugacacgcuccugcgcgguaguuguuaaaggguugggacacgaagauacucuucgccuauucgggaucucccauugugggaaggaggcucaguggucccggccaccgggugaagggagaacgggaacacagcgcugucaucgccggagagcugcgagccccgacuuucucgccaggcucuccaguacauuccgaggcuccaccccgguaacgccacgcugacguccgcgcgucggaggccgccauaggugcgcgucggcgcccaggaggacguguggcgcguggacuacaucagguccagcccugcgggaccccagccagcgcuuccgggcaagguucugugcaccuguuuucuccuucuacgcgaguaucuuuccccuccggaaagaaugggauaugccuguguccaaaggacaagaagaugcgcgccagcaagccuaaguuaaccacagcgcggaaguugagcccaaagcaagagcgugccgggcaccuuuaagcuguuuguaagcccacgugacucaccaagugcgggccccagcggucacgugacggcgcgcgcgcccucgcgcagggagagccggcggugcgcgcgccuucgccgcugccucccacccacccccucgacgggagggugaggcgcggcgcagugaucgggcggccgggguccugugcgcgugcgcagcgaacagcugucaccuagugcggaacaagucucccaaauuucccaaaucucccugggccggaggccacugucuucucuuccuccuccaccgagucgugcucucgccccaacccgcgcgccagguaaccgcuuuuccggagucugggggccagggcggggggaggguccggagaggucuucccggcacugccccccuccgcguggggcacgggggugcgggcguccgggcgagcggcgacgcuggggcagagacgcuccguccgugacugcagcgacugucaagcuggggagggagcggccggccgcggccgcaggggagggaugcgggggccggugacagcccgcuccggcccuuaccgagguucgguacccgcgcucgccguuuucccgggauccggagucggggucgccuccuuggggcagaggagcgcucgggcgguccugggaugcggaccucuuaacgccgccagucggcuguggcggacuccaggaaggccgggccuggugcaccccucggggcccucccuucccugggagugucacgacccgcggggugagggugggagcuccucuccugaccacccguugcaggcagucaucccgucauucggggucgucuucagcccucgcggcuguccuuuugguguuucuuucccccggcauggggccauuucuuccugcagugccuggaggaaccaugaugcgguguagacggcgggugcuuaaauaaaugcgaguuggauuagggcgcguggacug

SEQ ID NO: 14001 - RNA, 2616 nt, Homo sapiens
caguccacgcgcccuaauccaacucgcauuuauuuaagcacccgccgucuacaccgcaucaugguuccuccaggcacugcaggaagaaauggccccaugccgggggaaagaaacaccaaaaggacagccgcgagggcugaagacgaccccgaaugacgggaugacugccugcaacggguggucaggagaggagcucccacccucaccccgcgggucgugacacucccagggaagggagggccccgaggggugcaccaggcccggccuuccuggaguccgccacagccgacuggcggcguuaagagguccgcaucccaggaccgcccgagcgcuccucugccccaaggaggcgaccccgacuccggaucccgggaaaacggcgagcgcggguaccgaaccucgguaagggccggagcgggcugucaccggcccccgcaucccuccccugcggccgcggccggccgcucccuccccagcuugacagucgcugcagucacggacggagcgucucugccccagcgucgccgcucgcccggacgcccgcacccccgugccccacgcggaggggggcagugccgggaagaccucuccggacccuccccccgcccuggcccccagacuccggaaaagcgguuaccuggcgcgcggguuggggcgagagcacgacucgguggaggaggaagagaagacaguggccuccggcccagggagauuugggaaauuugggagacuuguuccgcacuaggugacagcuguucgcugcgcacgcgcacaggaccccggccgcccgaucacugcgccgcgccucacccucccgucgagggggugggugggaggcagcggcgaaggcgcgcgcaccgccggcucucccugcgcgagggcgcgcgcgccgucacgugaccgcuggggcccgcacuuggugagucacgugggcuuacaaacagcuuaaaggugcccggcacgcucuugcuuugggcucaacuuccgcgcugugguuaacuuaggcuugcuggcgcgcaucuucuuguccuuuggacacaggcauaucccauucuuuccggaggggaaagauacucgcguagaaggagaaaacaggugcacagaaccuugcccggaagcgcuggcuggggucccgcagggcuggaccugauguaguccacgcgccacacguccuccugggcgccgacgcgcaccuauggcggccuccgacgcgcggacgucagcguggcguuaccgggguggagccucggaauguacuggagagccuggcgagaaagucggggcucgcagcucuccggcgaugacagcgcuguguucccguucucccuucacccgguggccgggaccacugagccuccuucccacaaugggagaucccgaauaggcgaagaguaucuucgugucccaacccuuuaacaacuaccgcgcaggagcgugucagccucuggaagcaaaacuguccgguguugagucaccuacacccagcacgucccgccccgacccgcccaagugugcucuuaagauagggaggcacaaaggugaccccaauaggaauccugggcuggcggucccucagaaacuagaguugauaacaguuuggccagaacugaagugacuagaaaugcaggugccuccagcgucugagacuagauaaguuaacuuccuacaacuuguugcuuuuccucuguaacuccgccuuccgaggugucagaaggaaccaaccagaccuuaagccccuguacugccaaagacagaugguugagcaucagauguuuugcaaagcugaaugauuuuuuuuuuaaacuuccuacagagcucccagcugggucccuuguggcguuuucucuaacgucuuagcuaagaaagauugggcauaucuucacaccagugagcaaaguugggcuaauaugcugaauuuucuguuacauuauacugauaacagaauuuuaaaaauauaucgacaccgcuuaccacgcgcuugaacucguuucucacuggggugaacauugugaggacagauggaaugugauuaauugagcuaaggcuaacgggauuauugggucaccauauuucuuuaguuguuaaaaacaaaguuccgcuacacacacagacacacucuuuuuugagacggagucuugcugugucgcccaguuuggagugcaauggcgcuaucucggcuuacugcaaccuccgccucacggguucgagagauucuccugccucagccucccgaguagcugggauuacagucgcccgccaccacgcccagcuaauuuuuguauuuucaguagagacaggguuucgccauguuggccaggcuggucacaaacuccugaccucaggugauccgcccgccucggccucccaaagugcugggauuacaggcgugagccacuucacccggccacacacaauucugaacuuggcuaacguauacucaacugggaauuuuccaaaugugugcauguaacgucaggaucccaaccauccuuacaaguaaauuggauaugcuaaaauaauaaauaugcaaccuaacacuuacuuagaacaguaaugugagcuacacacugucuucagagcuucacauguauuaauaaauacuuauaauaauucaau

SEQ ID NO: 14002 - RNA, 1696 nt, Homo sapiens
uuuaaaauaaugaaguaaaauagcuaauuuucccguugguuuaccauaugcuguauuuaaaaguuuuaaaaauuauacuaacuauauaacuaaacauauuuauguuuauuauauauaauaugacaugcaauuauauaagacauacuauuauguuuauauauaaugcuuaauuaagcaauuauauuuaaauauaaguuauacuuuccuuccccagauaagacaaagaaccuguuuacuucucugagggauuuauugguuccugugaaaucugugaaggccacaaacacuccauagccagagaaugacaacauacgauuuucuucucagucuuguaguauccacaguagugaugucuguccauguacaagugucuguccagaacacccauuaaauuccaugccugcugugugugucacggggaaagggacagagacagaagacagauucacuggugguacuuucaaacaacgcgguaggccuucccuuuggggucugccaugacaacgauaccccagguggcaaugccuagaaaaaaaacaacaauaccuuaccuuuaugcugcauuuaaauuuaccaaguguuucacauauacgccaucuuauuuaacccucacaacacuucuggaggauauauuaccauuguaucuuucuuauaaggcaagugaagcacagaaaaagaaaaaaaaaucaggaaaaaaaagaauauccuguaggagaauuuaccuauacaggaucaagaagguaagacaguuagaaaccuaaaauucuauucacugacaaucgguuugaaagcuaaaaaaaucaugacguuugauuggaugacaucuugacgaucacagaacggggcugugggccacauuacccagguguaccaaguaggugagcuuagaauccacgucuaaagaucugggauucaaggcaaauuucuuaaauuaaggucaagggcccucgcucaggcuuucuccaggaccuggagaaaaaguaugggcuuugagaucugauauaccugggaucaagugacugucauuuccugaccaugaacacaauacuccucguugccucgguuugcuccacaguaaauacuauaaucauaccuacuucuaacagcuauucugagaauuaaaagggcugagucuaauaaggguucucaagaaauacuaacuuaaaauuaaaaaaaaaaaaagaaaggcguuccaacaacuuccucucccaccuuguuugaggugcccccaccaccugaccagcggcagcaccccgccuccccgccuccccgcccacguggcugcuccguuuccuuccucuaccccgcagauacccaacccgcccaagugcugugccuugauucucacugaggccgaugaccaucugcguaaugguccauggacucgggggguaucccaucuucaugggcuuccgugccacccaguacacguacccgcccgcccccaucagccccaacccagaaagcacgcgacagcuccagcaggucuucaacaggcgguguucugcuggggaggucggcgcuccggguguagcugggggcgcagguuuggcgggcgcggcggcgguaccgggaggcgcagugauauaggacucaaaaggcugggacaaccgagaccccaugcucuggaacucggccucaaccuugggcgucuuugguucaaacuggcguaaacgacgcaccggaaggcagagcg

SEQ ID NO: 14003 - RNA, 1696 nt, Homo sapiens
cgcucugccuuccggugcgucguuuacgccaguuugaaccaaagacgcccaagguugaggccgaguuccagagcauggggucucgguugucccagccuuuugaguccuauaucacugcgccucccgguaccgccgccgcgcccgccaaaccugcgcccccagcuacacccggagcgccgaccuccccagcagaacaccgccuguugaagaccugcuggagcugucgcgugcuuucuggguuggggcugaugggggcgggcggguacguguacuggguggcacggaagcccaugaagaugggauaccccccgaguccauggaccauuacgcagauggucaucggccucagugagaaucaaggcacagcacuugggcggguuggguaucugcgggguagaggaaggaaacggagcagccacgugggcggggaggcggggaggcggggugcugccgcuggucagguggugggggcaccucaaacaaggugggagaggaaguuguuggaacgccuuucuuuuuuuuuuuuuaauuuuaaguuaguauuucuugagaacccuuauuagacucagcccuuuuaauucucagaauagcuguuagaaguagguaugauuauaguauuuacuguggagcaaaccgaggcaacgaggaguauuguguucauggucaggaaaugacagucacuugaucccagguauaucagaucucaaagcccauacuuuuucuccagguccuggagaaagccugagcgagggcccuugaccuuaauuuaagaaauuugccuugaaucccagaucuuuagacguggauucuaagcucaccuacuugguacaccuggguaauguggcccacagccccguucugugaucgucaagaugucauccaaucaaacgucaugauuuuuuuagcuuucaaaccgauugucagugaauagaauuuuagguuucuaacugucuuaccuucuugauccuguauagguaaauucuccuacaggauauucuuuuuuuuccugauuuuuuuuucuuuuucugugcuucacuugccuuauaagaaagauacaaugguaauauauccuccagaaguguugugaggguuaaauaagauggcguauaugugaaacacuugguaaauuuaaaugcagcauaaagguaagguauuguuguuuuuuuucuaggcauugccaccugggguaucguugucauggcagaccccaaagggaaggccuaccgcguuguuugaaaguaccaccagugaaucugucuucugucucugucccuuuccccgugacacacacagcaggcauggaauuuaauggguguucuggacagacacuuguacauggacagacaucacuacuguggauacuacaagacugagaagaaaaucguauguugucauucucuggcuauggaguguuuguggccuucacagauuucacaggaaccaauaaaucccucagagaaguaaacagguucuuugucuuaucuggggaaggaaaguauaacuuauauuuaaauauaauugcuuaauuaagcauuauauauaaacauaauaguaugucuuauauaauugcaugucauauuauauauaauaaacauaaauauguuuaguuauauaguuaguauaauuuuuaaaacuuuuaaauacagcauaugguaaaccaacgggaaaauuagcuauuuuacuucauuauuuuaaa
